United States Patent 8,105,826 (NUCLEOTIDE AND AMINO ACID SEQUENCES RELATING TO RESPIRATORY DISEASES AND OBESITY) - sequence listing, part 3

SEQ ID NO: 808 - DNA, 18339 bp, Homo sapiens
  misc_feature (1)...(18339): n = A,T,C or G
ttttatacaccagcgctgatccttccacccccgtggtgaagacgagccaggctttgtgggtgcaggagccggagagcagcccccagccacacacctcaggctcggtggacatctgggaggggtgcctgggccggtgcaggcgagcactgcgctgcccctgtggcccctgagccagggctgaggctgagcgggtgctgcctgcctgcctgccctctcagcctgggtctgggagatccacaaccacaatgggggttctctgaagctcaggctggaagagacgccacgtggaggaaagcggaggaaacagaattcccagagacggagctggagcctgaacaacctccaactgcagcctgggaatcaagggccaggtccctcctccagcgctgtgttgatcatgctggtgcctgaacaacctccaactgcagcctgggaatcaagggccaggtccctcctccagggctgcgttgatcatcacggaaagttgtgcagccaggggaggaggctatgtggccccacgccccaccgnacgctcccaccgccagcttctctctggagctctgcaaggatgggctatgatcacccgtgatactgatctgccgtgtttcgtgtttaaattgctgagctgcagcgtggcttcgtgggggctggcaggaagctgggacaccgcagatgtggaacaaagcaagaggccgctcgagggtcgtcgggaaaacagttagaaccaatgaatgcttgtcaccttcacactgcctcccaccacggcagggtccatggccacagccagcgtttgcgagaccccaggcctgcggacggtggggctcccggggtctgaagggttgggggccaagcactagcaagagtcaggagatttctggagactgaggttgaggtcatcgaggacacctctgtttgcccctctttcaagtaaatgaccccatccccccagcggagggcaggaacccagtcctcgggttggggctcaggatcacttccaaaggtatccctgtttcctgcacagccacaggccctagagtagagctgggagggctccagggtgggtgatggggcacgtgacaccagtaccgctatgcgtccggcccacccgagcctccgtgctgtgcaaggagcgggctgcaccccagagctccccggtggcttcggggcggcgggcaggcgggcgggcggtctgacgaggcctcatgtgtcccactctctccctgcgcgggagccacgtgtgcagcagccactgcgtctctcgacagcccctgagggctcggggccgccgccccgtgagggaggcgaggatgtcctgcctggtggcctccggggcccctcggccctgcccatgcctctgggaacatctgtctgccgatgttcatgtcaatggcttcctgctggtgcccttggtgactgagaacaccactgggtctccaacgctgactgaaggcagccatgaggctggaggtgatgaagctgcaggcaagagggcctcatgcagctccgtatcctagaaaccaacacccactgccgcccgtcacccccaagccacctgctcaccccacaccaccatggtccacagtactcacaccatcactggccccagtggcagcaccgccagacacaacaccaccgcccgccccagaccagccccacagcacccccggccctaccaccatccctgccgccaacacggccccgctgccggccggcttgtctttgccaccgacaggctgagcatgagcccccacgtggggcctggcccagtgttggggaacccagagtgaagttgacagccaggggccctgctcaggcagtttctggtccagggacggtgagaggcagcgacagatcagcacacacgtgtggcctcgccggggccggctgtggatcgcatgaggcctggtgcaaaaccaacgggcagggccctcgttctaaaagcagaaaacggcgtgatcacaggaactgcgttccttccttccttttttttttctctttttgtgacagggtctccctctgtcacccaggctgcagtgcagcagcacaatctcagccagaagggggagaaaccacagtgagctcgagctccacaggctgcaacaggcgcaaggctgggtccatctccgctatccacagacctaggaggagacgccgcggttcctgagtctgaactggaggtaacaatattcctgctctgaggagctcccggagctgctccggaaatggagaaggtggctggaactctgtcgtctgaaagcgagagctcacagtataatatacgagcaaaaaatataaaactatggcctatcacttccagacatgggagatccaacctcgttctccatccccatcctcccccatggtggaggctcgcaaggccctgaggctcgccaggatctccagatttggggaaggtgaaagccgtctttaccctcctctacctcgaactggaccgcctgacatctcaagccaggaaccaccgcgcaggggcggtcatggcgagggactcacagcctgggggacgcacaccgcattttttaatggctctagttttatcaaaagtaaacatccatgtggcttaaaaagccagttttacggccaggcgtgtggctcacgcctgtaatcccagcactttgggaggccgaggcagggggatcacttgaggtcaggagttcgagaccagtctggccaacacagtgatgtagcaggacaagccgcagacaaaactcctcagacactgagttaaagaaggaaggggtttattcggctgggggcgtcagcaagactcctgtctcaagagctgagctccccgagtgagcaattcctgtcccttttaagggctcacaactctaagggggtgtgcatgagagggtcgtgatcgattgagcaagcagtgggtacgtgactgggggctgcatgctccggtagttagaacagaacagaacaggacagggattgtcacagtgcttttccatacaatgtctgtaatctatagataacataaccgattaggtcaggggtcaatctttaactacgaggcccaggacacggcgccgggctgtctgcttgtggatttcatttctgccttttagttttttttttttctttctttggaggcagaaatcgggcataagacaatatgaggagtggtctcctcccttagtgaaaccccgtctctactaaaaatacaaaaattagccgggtgtggtggcaggtgcctgtaatcccagctactcgggaggctgaggcaggagaatcacttgaacccaggaggcagaggttacaatgagctgagattacaccactgcactccagcctgggcaacagagcgagactctgtctcaaaaacaaaaatgccagttttacaaggctgctacaaacaagagcggccccaccttctcatccatcgttctccctggagacagccccgtttagacttctctcccctgattcccgaaacgcagccccgggtctctgcatgacaagcagggcttgctgctccccggctgtgtagcactaacgttgtcttccgacttcgaactgtgaagcaaggattcctctctggtctcccccaccataacccaccccacgtggaatctgaggccatgttaaacatgcagattccctggctctgccggtcttgggcaggcggtcctaacacacacaaggctctgtggtaagggccagggccccagagtagggggtccctcaggggctctgagctgcggctccaacagaacctctgtccgctccgctccctgcaaggggcctccggcccttgttctgctcatccggaccacagacctcttctcgttcctggggaaggacagttggcctccggcctggagctctgtctttagttttttagcctcaaatctgccagcttcaggtttggggactctgctgaggcagactcgggggtggcttgaccctgccagcgagtgggttgagggcgtgtcaggagccgggtgtgggttgagagcacgttcggcgccaggcacaggggcttcggtcggcttatgtgctcttcccgggagctcctcagagcaggaatgttgttatgtccatttcagattcaagaaccgcgacatcttctcctaagtccatgggagaacaaaatggacccagccttgcacctgttccagcctccaaagctcgagcttggccgggctcctctgcctgtcttcagatgggaagagctgggcactggcctctaccaatccctccccactcagccatccgtctgagtccagtgccatgggccctggcattcagccatgtgtccaggttcagtgccacgggtcctggcgtcagcagctccggctctgccagaggccagtggaggcaccctggttcccacgccctccctgctcctgccatgcgtccggtcacagcaggtttgcggtcaccctctgggtccctaccccggccacccactcgtctggtcagagcaggtttgcggtcaccctctgggtcccaaccccggccacccactcctcaggcttcgctctcctaggggaggctcccagatcactgggtcttcctcacctgcctcggtggaatcccggctgttcgcagccgcactggatgaagctctcgtctcctctctggttcctcacaggtgtcggtggacttcggggaaggcaggtgcagcctcctgcgttggctccatcgcctctggccaaggccatggcacacactctgcccgcgttcctctgcactcccaggaaggcgatgcccccggccccagcctcggagaagtggacacgaagccccacttgctttgtggccggttccattttaatttggtctcaacggagtagaaaatgggagagagccggcgcgtgctccagacagaaatcagccaacgagcccatgagaccccaagtcactgaatccccccacactctggcgtctctgaacaacccgcaaggacgtcggtgccacggctgctctggggtctacagtgcacgtccccgtggacccccggctcctgcaggtgaaacccaccactccacggtgatacaagaaccttcccacgtccccatgtctctctgcatgggccgggcaccatggctgccacactctatgcgtgttttaaaacccacagtgcaggccgggcgcagtggctcatgcctgtaatcccagcactttgggaggccgaggcgggcggatcacaaggtcaggagatcgagaccatcttggctaacatggtgaaaccccatctctactagaaatacaaaaaattagctggtgtggtggcgggcgcctgtagtcccagctactcgggaggctgaggcaggagaatggcgtgaacccgggaggtgaagcttgcagtgagccgagatcgcgccactgcactccagcctgggggacagagcaagactccgccccgaaaaaaaaaaaacccacagtgcactgtgaatattttgtttaaacagtcaattaccttcgacggatacttcatccatttgtcaaatctcaggtatctaattcaccacgccgtggctgttccgggggctccgcgtctgtcgtcccacatctgcgctgctcctgccgggaggacacgcccgtgccccacagcgggtccgctcaccactgctctttcaggcattacctccggagacactcgttccacctttgtctctgagagatgttcttgctgacaggtttcttcttacgacgctgcccttgcgtgggttcactcgcgttgctcctcaggagaaatgagagcgtgtgttttcctccggtgacctggaaagggaccttctgtggctggccgggcactctggcttccatgggcctctgtcccatttcttcgcctttcatgtccttgaggcttgttgagcttctatcatctgtgagttcacagttggcgtcagatttggaaattttggagtcatgattttttcatatcttttcagtgtctccatggtcggctcttcttcagggacccccatacgtattacggttgtgcgtggggtactcttacactcacgggggtgccgggcccctggaacctgcaactcacgcaggatgctcttttaacttactctattatgtttcctgttttatacggtgctgtatcgttggctctgtctttaagatcattcaccttttcctccatgtgtggtctgtgaaccccatccattgtagccttgatttctagaagtttggtttgcatatttttaaatggtctatgtttctacttagctctttcaacacagggaatgcagtcaggatgactgtcagtgtctgtctggcgattctaacacttgtgttagttctgaccaggatttcgcagtggatttttcctccccttacgggtgggttttcctgcttccccgaatgtaatctttgaatcgatggcagacattgttaacatcgcctttgttgggtgtggatgtttgtgtttatgtggaaacattcctgcacctttttctggcgtgcggttcagttacatggaaaaggtttggcctctcaggtcttattttaaagtggccgtcagggccgaatgttctgcccattttgtccacactaattatccctctttggggagcaagacccttgtgagatgccaccgccaccctcgggaggcctccaggctgggggacgggcactgtgggctgctggtgtagggccggacgctctctgacagtgttgcccctggcctccggcggcttcctcccaagctgggttggggctcttctgaacgctcccctccatgccctgtcctgggaactttaaccctctgggcctcccggagccctctgtctcccctgtcccagggggtctgctgggctccaccgggccccgccctgaatgcagcctggagcaacgctggaggccggggctaggaaactgtgagccccgccttgtctgtgtctttctcagggattctcgtcctttccaacctggtgcccgatgtccggaagcacctcttctgtgttttcaaatgggagagcgaatccagtccttttcactccattttggccagaaacagaagtcctccgtgatttatatttttactagaatcttttaaaggggcacaaatgggggtgttttgcaggcatacagaagcccccgtcactcctcccgccttgtctctgaaccgctgtggggtggggaggggtctcttctctctccaacccacatcactttcaccccccgccggccaaggctgcgtttccctcgcccccaccccagtcccccgcgttggtagtgggatcggtttggtattctgaggcttctctcatttctcctttatcaccatctgccccacagcaggcaggcccggagcctctgcagaagggggaaccgggtgcaggcccaacgccggtctctcagtgtggcagccttgcgcgcgagcagaagcagaaggcctagttcctactctgcagccttggctgccgggcacggagaacgttttagcagaaacacctctgcaaaaccacttcctggcccgggcccagccaaacaccatcttctcctccaccccagggctccgcccccatctccaggctcagcccagcacccccacccccgaaacccccagccccactgcatctgccctggccatctgcctccgccctgcctcgctaacacagttattaatgagcaattttcctgtaattacaacgcagttatgccagttaccccgacctgctgacagaaaacattcacttccatgtggcactagcccccaggcctgagaggacgcaaacacttgcccctcattcgctgcccccacccccactctgccagccagcaccaccctccacccactctaggcccttaagaaaggagggaagggccgcggggaggagctctcagatcccgaggccccactccccctgcaaggaaggctgtgagctcggccccagcccacctgccagctccccaaacacctcccacctccctccgccgcctgctgaagggactacactcccctggctcctccaaaatccgctaatgaacagcaggcgcagaggctccgccaccggcgtgctcctggcctcagccctccctgttctgaaaccgcctttgctaagacggtagtagtgaggaatcacgacagtggcagaggccaacctgacccgctccacctgcctccaccccaacccgcccggctgcttcctgagcgtgggccaaactaactttgacaggaacttagtttacagtttaagttgggaacaaaaaggataacagcccctccccaaaacagattccctcctcgcttggggggaccagtcccgttgtaaaaccgacaaataacagcaggattaggaattccggctcaggattcacgcagccagacgccacaggactcctccccagccgctcctgtatatgacgtcaccgccgtaagaccacaggacaccgccccagccgcgcctgtagatgacgtcaccatcgtaagaccacaggacccttcccagccgctcctgtatatgacgtcaccgccgtaagaccacaagtcaccgccccagccgctcctgtagatgacgtcaccacagtaagaccacaggataccgccccagccgcgcctgtagatgacgtcaccatcgtaggcccacaggacccttcccagccgctcctgtggatgacgtcaccgccgtaggacctaagattgatgctggagaggttcttcagaccctgcgttctgacggctccgctggcaccacccagacgggtaaactagctcttccggtctgtggccctcacaggaaccgactcggtgcaggaggacagcttcagcccctgtgatttcatccccgaccaaccagccagcactccccactccctagccccctgcctgccaaactatcttttaaaaaactccagtttccaaattttcagggaggctgatttgagtaataataaaactccagtctcctgctagctggctctggatgcactagactctattgcaattctcctgtcctgataaatcggctgtcaggcaagaagaacccgttgggtggttacagtttcaaggctatattcagagaactatccactaataaaatctctgtttatgcagtaggtcccaccccacaccctccctgctcaaactgctgcaatcccggcacagctttgttgacaatgtacccatcagccaacaaaatgtaacaaaatgcactttcttttagttatctcctgctacgtaataaacttccccgggaggtggaggttgccatgagccgagattgcaccattgcactccagcctgggcaacaagagcaagactccgtctcaaaaataaataaataaataaataaataagcctccccggagcttgatggcctaaatagcaatctaccgtgagtgctcagggctctggagttgactgggctgcgctgggtgcttcctgcctagggtctccagtgtggttgcagcaaatgcaggctggagctgtccagcatctctttctgagtagcctctccacgctcagcttggaccccctcacagcatggctgccagggtcatcaagcttcttggcaggcagctggcctcccctaggacaaatcccacaaagctgaggcaggagttccagggctactaagacgccgtctcagagtcacagtctgccacctccagctcatgccactggctacacaggcccagagtccgtgcgtctggggaggcaccatcctgagaagccatcttacgagtgagaagtgggtgccaggaaatggggtgccaccatgattagcaccccaaatatgtgctgtcacctttggagtcacgcagaacctgggggcctccaggagtctacgggggatggtgggaaggctggggaggaggatgggaaggagacccccgctgagggcaggcggagcgctggggtggcaccacctctggctgcggggaaggtcgtggccctgcgaggacctgtctagacagaggctgaagttgggggcggggaggtggggggcaggcacgtgaggagccgttgagtttgcagaatctggaggaatcaagagggcccaggacagtcttttaagccagtaccaggttctcaaagtgagaaatggcctctggcctaagggtgaagacctcaaaggcgtggctgaagcagctttattgagatttgcaagattcacaagctatcttttagactcgatacagtcaggcctctgggaacctcgagggcgcccttccgcagcctcctgggtctcagcccaaggagacaagagcttgccccagcgagcaggtgtgggttaactcagtcacgcccgcaggagacacacagggtttctgcagagagctctgttgtggaagtgccgtcagagagaggcggctcggtgtggaaacaggcctctttatgctcaggaggcaggctgagaagctgcccggccacaagcacaggccacctcttgcagaagagggaccttaactctgacctcagccaagagcccaggagacacagcctggggtcacaaagagtcagctcctaggagcaggcggtgctcacctagaagctgctggtgtggacctggctggagctcaggtttctgccaaccgtgtctgctcctcctgtccctgctgtttgaacgggggtgtcggcgtgttcgtcccgcccctgccttgtcatcgcatattgggtctagggccccagagaagtgcacgcctgtgatcccaggcttcttagttcagttcctcagatggagatgtgggtgagagacgctgagggcctcctccccagccctcgttctgatatgatcaaggactccaagcctgggcctgaggatgcagcggaatgagaggccgaggtctctggagattgagtgtgttttcacgtggagctaagggtcactgagtgagagggtggccgccccttgtgctggcttctcccttgatgaatctggactggccccgagctacagactgaatcatcccaaactgggagacttacacaagcctccctccggcttccaaaagttccttggcttgaggataacttggcaatctccccttgtggaaggaccccagtccaggatggcctcatctttgctcatcacatctgcgacacggccctatttctaaataagctcaccctctgatgaccctatttcattcttttgagacggagtcccgctctgtcacccaggctggagtgcagtggtgcgatctcggctcactgcaggctccgcttcccgggttcaagccattctcctgcctcagcctcctgagtagctgggactacaggcgcgtgccaccacgcccggctaattttttctaatttttagtagacacggggtttcactgtgttagccaggatggtctcgatctcctgaccttgtgatatgcccgcctcggcctcccaaagtgctgggattacaggtgtgagccactgcacccgcccttttttttttttttttgagacggagtcttgctctgttgcccatgctggagtgcagtggcacaatctcggctcactgcaacctctgcctcccaggctcaagcgattctcctgtctcagcctcctgagtagcttgaattacaggcacatgccaccacacccagctaattttcgtatttttagtagagatggggtttcaccatgttggccaggctggtttcgaactcctgacctcaggtgatccgcctgcctcggtctcccaaagtgctgggattacaggcgtgagccaccgcacctggctgaaaaatttatttttttaaaaagagagaagtgcttaggaaattcaataaacttaccttttttttttctttcaaaaattgccccgcttggagcatgctttgaaagtcacaaataaaggctgttatgtcgtggcattcaaccatttttgtctgaaaagcaacttccaaaaatcagctgtagattcattgtgtttctttctaaaaatgaagtgttgtaattaacactacccagtttcataaataaacaaaacatattttcttgcattctagtttcgggtttcaggatgaaacctccatcgatatctctagttccttcaagtctgctgaaatgtcaccttccctgcggcaagcatattttaggtaaggcgtaaatgcagcctgcccctcccggcaccccacttccccttgacttatttgagtgatgtgtttacctgtgatgaccgcggctcatatctccccaccaacctccgggggccccaggagggcagagagcatgtgctgtgttcactgttgctttgaaagtgcttagaactgtgtctggtacatagtaaatgttcaattaaatttttttttttacagtttcacttttcacacttaagcgtttaatccacttgcagtatagtcatccctcgatatcctcgggattggtttcaggaccgcccttggatcctgaaatcagcaggttcccaaggccctggtataaagtggcctggtatttgcatagagcctacccaccttctcccaatactttcagtcatctctggatgatttgtaatacctaatgccatgtaaatgcatcccctggcgttcccggatacctgcctgcatcacacagtccctgcctgtccatctcgcagctttacagcccaggaaggcccaggcccggctcctcccgacctctcccgaagtccctttcccccagccttggtcccagaaacaaccagctcgaggtgggggcagtgaacgctcagggtggagttgcaggctaagccctcctaagctgccagggagaagcgcttttctgccagcagctctgcggaggaaaattgatttccttggtaatgaagtgttaacccgctgggggtgctcggagccgcgccaggcaggcgggaggccccagtttgcacaggcagtcttcccagacatgtctcagagtcctcgtcccaagctgcctggggccccgggtgggcctggagtgaccaagggcacacagacctgcttgcggggtgagctgagccggcagggcccagctccccaggccgggaggctccatcacctcgtaatcatctggtggtctggtgcctgccggtccaggagagtcgcacacacagtaaaatcctccaaaatcaaacacagctgcttttgctcctcctggaaaggcaatgagaagccccagaggaggttaatgaagtgccttggagccctcggccttagcctgcagctgctgattttccaagcagggccatctgaatgggggaggcttctcccagggtccctgggctgatgtaggggctcagccatctcagtccctgaggctggacccctccttgatgagggtcatggtccgacagggagggccaggcagcatcagcgcaggtgtggccactccctccctcccctcctcctctgctggccccatggcagccccccaggagctacacagccttgaatcccctcagggaggcccccaaggcccgtttggggagctgcccacgcggagcccagcacgcccgcccggcttctgcagggaggggcccatctcttcctggctgtgctgggttttccagtgcaggccagaggggaaactcccatgatcgagcccagctgagccccctgctccagccctggggggccgaggaagagcaggttctgagaccccgaccagctcagggcatccaggaggggccagggcaccctctgtgcggctggggtgtcctcccagtctcccctcctgctgtcactggcccgcgaggcatctggagggcccacacctgccagtgacccctctggggggttgtcccaggctgcgctgacttcctttctgtggcgcgggtgacacagacggcgactctccagggcggggcaggggctggcagggccgccgggtgttccctgaccctggaggcttcggggagggaggggaggacgccaagcaggggcgggagcttagagtcccccccacagctcatcaggccacgcgagtcctgcagggtggtctgggatggcccctcaccctctgacgtcctcttgggctgggccagtgaggagcagccacaggaaggcggagggtcgggggtggaggttggaaggcagagggcggagggcgggcgggggcatccattctcccgaacaggggtcttgctgcgcgactcttccatctcacgctgccggacctgtctcttccccgccgtccacgctggggacggttttagtgatttccccgggttctgtgccctaaatcctgccacacttcagccacatccccctcattactcctaatttggattcccaggtggaggggccagcccaccctggctgcagtgggagggcagcccctgagtgcacagcctgtggcccacagaggacggggtctgcgctctgaggagggttcccggcccgcatcggtcaaggcagagatgaggaggaggccatgaggctggcgtggtgtggccacagcccagctagaggggagggcatttgcacgggatccagtggtgtttccccaaattcgcatccactgaaacctcggaacgtggcctctgcaggtgtgatgtgaagtgaggatgaggtcatcttggattggggtgggccctaaatccaatgactggtgtcataagagaggagagacagatacacacagagaggggatgaccgtgaagagggaggcagaaacgcacacagatacacacatactcagggaagaggaacaacaggccagaggggccgtcaaaccctctcgggggtttgaactccacctacggcgtgtttcagtcttaaaatgtccatgattcttttgtcacgatttccaattctctgatgaaattctccctcttacatattgtcttgaatacaccgatgctgctgttttaaactcccgtcgctgctgcgtctgtttctattgactttcctctgctgctgctgctggccttattacctggtcctgtcacccccatgcctggatatttttgattgaatgcttggcgttgtgaatacacatttacagtgggcttgggtgatgttgtcttcctctggagatgagttgcttttctttaggatggtagttagggttaggggtcgactgccatgaccccatcagggccgggaccactggaggccgccagtctccacgagggcgggaactggaggccgccggtctgcatgaggctgctctcctctggtccccctcactcccaggctgcggcattcaagggcatcaacagaaagcctgatgcaagttcttccctcccagctctgactgccaggaaacctgaggctgcctcagggaaatgaggtctcctcctcctccttggggccgtcacccctcaagtcccagctgccttggttactctctggcacctttgaactgccacctgttcctctggcccagctttgaaagcaactcccaggagcaggtgtgcttggaccctgcggccctgcggacagacccctcactgacctccccttcattaatcccatccaaacgaggccacgttctgagttcatcctggtgaatttcggggacactcttcaacccagtgcgccgtcccccacagagcaagccaacatcctgatggggcagcctttgccactttgcccccgctggccccatcacactgccccccagccaccacacctcccggaggggcctcacacgctgcagccctccatcctcaggcctggcgttggctgctccttggcttgtgtgcccctccctgcaccccaatatgccaggatctccccgcacctcctcattctaccatcacctcacggagacatcctggtcaccccgtgaggcattgctcacgccctccccggcactccacagccttgaagggcactgaccgccagtgcctccacccactgtgcctcctgcccagactgcaaccccccaagccagggctcgtctccggttcacggctgtgtcccacatgtctgtggtgcctcccagctccagggaggtctgggtcctgtcggggggtggggggcagcctccgtggccaagggtctcccaggctgctgtcaggccaggctcgccagccgggctcctgatcaccttcctgggccagcctctccaggaacccaggagccagagggcggctgatgtaactgaattccagaatccgtcatgagccgggaagtgagtgcctgcggtttgtggggctgaggtgaccggccaacgcctttggggctttgttactcctcacacggggaggttgattggagccaggagccctgcagtggctccaggcctgctgctccaattaacctccctggccctggggagccgggccttagggctggggctggagggctgctggcatcggtgcccgggctcagcctgcaggtggcaggccctgaggtggaggggagcatcccgcagccctgccgctccctctgggtgcttggcctgcaccctgccaaggaaactagctagttaaccatcccaagtgcatcccaggggctgggcagagcacagcaggcttggtcagcagtgatggggtggagagatgcctgctcggagccagggacacaagacagctgtggccgactctgccccccacccccagcccgggcctcctgggaaggccgtgtctgagttcatgggccagaagaagagagatggatggagtcaggcggaacagctcttggcgccaaggagacagccagtcttaggtcctgaggagggacagttaggggttagggttaggtgtgattggtggtgggggtgaggggcgtgggtgttgttaggattagggttaggggtagatgtgatgggtgttggcgggtgagcggggagagagttaggtttagggttagcgctaggattagggttggagtagatgtgatgggtgttgggggtgagggggcggggatgttaggattagggttggggtagatgttatgggtgtgggggttgagggaacgggggtgttaggtttagggttggagtagatgtgatgggtgttgggggtgagggggcagtggtgtcaggtttagggttagtgctgggattagggttggggtagatgtgatgagtgttggggtgtggtcgcaggaggatttggcttttattctgggggaggtgctgcactgggctgcacagggtaccagcaccggcctcctctgaccagatgctatttagacccctcccccaacccctgtgtccttggagcccctccctctgcccagcgtccctccctgagtttgctcttctctgtggtaagagtgagggctgcctttggcttccaggcaggcagcttggagggtgggcagggtgaggaagtgggttctgcatctcccggggagtctgaggccagaggcagctctgagcagcccggccgtgcagggggcagctgggggaggctgcggccaccccagggctctcctccatgctaagccagcaactggaaggccaggggtagccggttgcagatggggtgggagccagggtgaccagccacccgtgttccccaagacgaagtgggccgtggggggtcccaggtaaacatgggggaatctgtcacccctctgagagcagagtccagtggggacgatgcaggtctgggcacgacctctgggaggggcagcaggtcagggggacccctggtttccaaggagcagacactgccaggggagaggaagctgttgaccctggtcagaggcccaggctgaggagagtggggtcagggccaccaggaacagccgggggcagtagctccaacctcacagcagcacctggacagacaccgactggggaccacagaaaggtctaggatccatgagttatgcctgccaacagcagaccctgtgtatgtgtgcatgtgaacgtgtgtgaacatgtatgtggatgtgtgtgcgtgtggacatatgtgtgtgcatgtggatgtgtgtgcgtgtgttgtgtctgcatgtgtgtgtgaacttgtgtgtgtgtgcatgtgtgtgcatgtgaacgtgtgtgtgaacatggatgtgtgcatgtgggcgtgtgtatgcaagtggatgcgtgtgcatgtggatgtgtgtgtgcatgtgtgtgcgtatgtgtgtggacgtgtgtgatgcgtgtggatatgtatgcatgtgcattgcgtcagtgcatttggacgtgtgtgtgaacttgtgtgtgtgtgcctgtgtgtgcatgtgaacttgtgtgtgtgaacatgtatgtgtgcatgtggacgtgtgcgtgtggtgtgtctgcatgtgtgtgtggacctgtgtgtgtgtgcgtctatgcatgtgaacgtgtgtgtgcatgtgaacatggatgtgtcgcatgtgggccatgtgtatgcaagtggatgcacgtgcatgtgcatgtgtgtgtgcatgtgtgtgcgtatgcgcgtgtggacgtgtgtgatgcatgtggatatgtatgcatgtgcattgcagcagtgtcttcaccacgggggtggaaggatcagcgttggactatnnnncgccgcc

SEQ ID NO: 809 - DNA, 791 bp, Homo sapiens
tgacgcgccttcttccagccccgcggtgaagacgagttcctgtcaacaggatttagatccaggaaaagagaccgagaggcatggccgctgccgaggaagagcctggggctgtgggagcagcgaggccaccatctgactctggatgcctggagagccgggagacaggaaggctggcttgttcctgcctctcagatgtgctcagctagttacatttgcctggctaaaacacaggggccatctctttaacatttcttattaaaataggtgtgtgttttcagaatatctatacttatctccatagaactcttaactattttaattctttttttttttttttgagacagtctggctctgatctcagctcgctgcagcctccacctcccgggttcaagtgattctcctgccacagcctcccaagtagctaatatttttttgtattttttagtagagacggagtttcaccatgttggccaggctggtctggaactcctggcctcaagtgatcccccgaccttggcctcccaaagtgctgggatgacaggtgtaagccaccctggccagcctattttcattcttaatatacacattgttcatcctccctgacttagctcttccagaaaggtggttgctcaccaatctcctctctaagaaccttctcagcacaggaggtcttgtctgtgtggtaaaattcacacgagattaaggatcttgccgaagatacgagagaacttggctctgatttttggcaagaggcccagttgaaattaagaaaagggggggggggcgccccc

SEQ ID NO: 810 - DNA, 1072 bp, Homo sapiens
  misc_feature (1)...(1072): n = A,T,C or G
atacgcggatcctttgcgccgctccttgaaataagaggctgtgaccatatgatgctgagacggaacacatttcaatctggatgggtctcacacgaccttacaaaatcattgtgtgtggggatgggacacatttcaatatggatgggtctgacacaacattacaaaatcattgtgtttttggtgttttttagataaggggtctcactatgttgcccaggctggtcttgaaccctaggctcaagcgatcctatagtctcagtctcagaaagtgctgggattccaggcatgacccatggtgcctgggccggaattgttaattttgtcaaatgtgatcgtgatattgttatgtaggaaaatgtgcaccttcttagagagagagagaaaatatttaggagagacatgtcatgatatctgtttttatttcaaaattgctataacaagcacaaaaataaataaagcaacatccaaagccctcacaatgctggaatctaggtgctgtgcttataaaaggctgttcattcaactactttcttttaaaaaaaatttcttttgagacagggtctcactctgttgccccaggctaaagtgcagtggagaaatcatagctcactgcagcctccaactcccagactcaagcgatcctcctacctcagcctccctagtagctgggactaccagtgcacaccaccatgcccggctaatttttgaatttttttcacagacgggattntgccattgttgcccaggtggtcttacactccagggctccagtgatccacctgcctcagcctcccaaagtgccggaattacagaaccactctttatttttttttttttctgagacagagtcttgctttggttgccaggctggagtgcaangggcgaatcttaacttcgctgcaaccttcaacctccaggttcaagccatttctcttgccttaaccctcctgaagtacttaaaataaaagcaacttgccacccttgctgggaaaattttgggatttgggaaaaatcggggtttcccccatgttggccaaactttggtttgaacttcttgaccctaaaggaattt

SEQ ID NO: 811 - DNA, 597 bp, Homo sapiens
  misc_feature (1)...(597): n = A,T,C or G
atgaaccaccgcggattcttccagccccatgtgaagaggaactccacgtgcatgacactggcctntggtgtggtcntcccgcggtggaagggtggaaaacnagagggtgagtgattgcagagagaagagacagcacgaggggctgggctcaattcataacaacccactcgcaccataactaacccactgtcaccatgactcacccattcctaccataactcacccactcccatcntggctcacccacttccatcataactcacccaatcccaccataactaaccctctcccaccataactcacccaatcccactataactaacccactcttactataactaacccactcccattataccgcttttaaaaaaaaaaaaaatttttttttttttttannnnccccntattcccctccccccccacaaaaaaaaaaaaaaaaaaaattggatttctcgggcccccccccgcccccccgccgacaggggggagaaagggggggagagaggaaatttttttttttttttttntttattgggtcggaacacgagacaacagggcgcgaaaagaggagagaagagacaaccccctccctaccag

SEQ ID NO: 812 - DNA, 1099 bp, Homo sapiens
  misc_feature (1)...(1099): n = A,T,C or G
ttgaccagtgcgcggacccttccagcccgaacgggaagcaacctcatctctactaaaactacaaaaattggccaggcatagtggtgcgcgcctgtggtcccagctactcgggaggctgaggcaggagaatcgcttgaatctgggaggtagaggctgcagtgagttgagattgcgccactgcactccagcctgggtgacagagcgagactctgtctcaaaaaaaaaaaaaaaaaaaaaaagccaggcaagatggctcatgcctataatcacagcactttgggagtgtaggccctgcttggatacaaactctacaacttgtgtcaaattcttaaagtttatttgagcatttttgatntgagctgggtccagaagttacaacagaaactgggactggatccagtacaaggcctatgggagcaggactgagtccagtatgaggcttatggtaggaaagggtatgagaatacagggaatgatgccttcatttggatccaaggagtctgaaactcctcaacctggaactcnagccaatttcatgtataagaacctatgaacccagagtctgcacttttccagagaaatgggtgaacctaccaaaggtaatctaagagttaacaatggtcaaagtgaggaagttttaacctagataaaattgttcactttgcatgaccttagacaaggaagggttttttgcaagactacgtctgaaaggaataacatcaagtattatgacgggacaaaagaccctcttagaaagccaaaggaggaattttggattgcgatgccggaggctttttgaaagggttaaatgaaccgcaaacttgccgtttctaaaaggacttctttaccaancctcaaatggaggcacctatagtccgcttattctattgaaaaacagaattggtgttttggatggtatatggactccctgtacaatcctatctttcgtatcccttactgggcgtacatcagaatctgcccaactgtcttgtaccgcaagttaccttgcttaccgccgggagcaatggaaaggctctaaccaaaggcctttatattactgagacccctgctaataaatacaggcctcctttctttaaca

SEQ ID NO: 813 - DNA, 1065 bp, Homo sapiens
  misc_feature (1)...(1065): n = A,T,C or G
gtgacggaccatgcgcggtccttccacccgaggtgaagacgtggtatccctgttattcgtgaaggtaaccatctgcgtggtgccagcgcggttatcgataaagactgggccagcgcccgtttagcagaaatgattgatgccgatatgctgatcattctgactgcggtagaaaaagtggccattaacttcggtaaagagaatgaacagtggctcgatcgcctgtcattaagtgatgctgaacgctttatcgaagaaggtcattttgcgaaaggttctatgctgcctaaagtggaagctgccgcctcgtttgctcgctctcgcgcaggtcgtgaagcactgattaccgtattgagcaaagcgaaagaagggattgaaggcaaaacaggaacggtgatttgtcagtaatttaaaggccgggtgggtaataccatccggccaaagattgtcaagtaagtgcgctttgttgatgccggatgcggcgcgagcgccttatccgtcctacaaaacatcgcaaattcaatagattgcaatgcacttgtaggcctgataagcgtagcgcagcaggcaattcgccgcgttttttatgcctgacgaattgcctgttctatctcaaagcgattcgtcactttgctgtcgattttcacataagctgaatgttcttcttctgcaatcaacacttctttgatgccttcagtttctagcaaacgcacttttaacgcctcgtttgcggcaatgttcgccgggatttcaatgcgcaaactgctgacatacggcggttctttcatggtactggcgactgtcagccacactgcggccagcattgcgccagcgnagnaaaaannaaaaattttttttnaaaaaaaaaaaaaaaccccccccntttttccccccccccccatttacccccccccccccccccccccccttnttatatattttatccctctaccccccccccttccctcaacatatacanaaaacnnntaaataatataaaacacaaaaaaaattaatataatttattatatcctccccacctcccaccatattataatttattttttg

SEQ ID NO: 814 - DNA, 1213 bp, Homo sapiens
gattttgtatctggcaactttgttgaattagtttattctttttttttttttgagatggagtcttgctctgtcccccaggctggagtgcagtggccccacgatctcggctcactgcaacccctgcctcctgggttcaagcgattctcctgcctcagcctcccgagtagctgggactacaggtgccagccaccacgcttggctaatttttgtatttttagtagagacggggtttcaccgtgttggccaggctggtcttgaactcctgacttcaggtgatcagcccgccttggcctcccaaagtgctgggattacaggcgtgagccaccgcacctggcctcatccaggattttgaccaagtgcatcaggacaacctggtttccagagcagagacccagccaaagcggctgtagtcaaggaaaggaagcgtatgggtatgggctcaggaaacggtggcgtcctagcgtgtgccaaagtcaggcagggctggaccaagtctcacagcaacagcgtcagaacgcggtttctctcagtccatctctgtgtggggcaaagacggcccagggcagctcctgtgcatccttccccctcagcaggcccagccagagacagactctttctcaaccaatggtcccaaggccacctctctctggattctgggtcaggacctgatcgtggggccaggggcagggaagtgagctgaagccctgggctggaagggattctctacaggaaatcagaggtgctgaagtcagaggaagggagggtggatggcaggcaaagctgggtcgaggactcagaagagggaacgcggccagtgcccccactgcatcatggggctcatacacatctgagacttggaacaggacgctgttgaggggctgtagctcggtgctggccaggggcttcaccgcggggcttgctggcattgaagggagatggcttgtttatggagcttgggcgacagtggctggggatgtacaaatgtgagaagggccttacaggcaggccactgttctccccaaaaagccttgtggcggcttgtgaactggaaatgctggttagacatccggaatttgaccttcctaaagcagttgcctgcaccatggctgctgggttcccttcaacctgccaccccatttgggactttgaaagccgctgaaatccaacccccgcaagaaaaggttcttttccataagttttgcaagcttaaaaa

SEQ ID NO: 815 - DNA, 1418 bp, Homo sapiens
cccccatgatttttaatttaaaaatttggaaatttaagctttttgggaattacatggagaacttttgaataaaaaaaaaagtgtcgttaaaaaactggggcttgtggtggtatagacaccaatattcctcaatcacttcacttagcgtcgagaggtccactaccacagcgttgcatcatggtcagtcgttaattagcagtaatgctaacatgaacctgacaccttaaagacgggtcagtatattcaggatattctgtttaaaaagaagaagaacattaacttagaaacattcaaatgtttacattacatcaaatggagatttaattgtagagctaatttaatctgttattctgaacttcatcggtttctccttaagtaacactttttatctttttaaatttttttattaaaatacacaataatttaaaaaaagagatggggtctcactgtgttgcccaagctagtctcaaactcctgagctcaagtgatcctactgccttggcctcccaaagcactgggattacaggcatgagccaccacatccagccaagtgacacatcttttaacaagtatgaagcaattatagcactttagtagtaaagcaaaatgatgtttgcccttccatcctgtgactgcactatggttctacccatcggcactctccaagggctgcgatcctaacggaatgataggacgtggggcaaacgcacacaccggctttccttttgccctgtctttagtcctgctccttactttgtgggcacaagaattactgttgcacagctctattttatgagcttttagagaaactttcaagtgtaattgtaattatactgagttaaaggccagttaaggtatttaagactttttgcattgactttcaaacctacccatccctcagaagttacgatgcactagaaatgttctatcaggtctaaaacgtaaacacccatttatttatccagaataagctctccttcctcgggttctggatagttctgattttgttgtcttatctctaagccacacacatgaattcagctatctatctgcggtgttcttatcagaaggaagaatagatactatagccacttcacaaattaagagttgaaatacagtcggcttattgggtccacctctgtggattcaaccacccacaaatctaaagttttggaaggaaaaaaccaaggtttatgggaacacaccaatgctcatttgtttacatatggctggggccactttggcacttaaccaacagagtttagaaaatgaaaacccatatggccccacgaacccagaatttttttttaaaccggactggctattataagagtttggcccccctctatctaaagagggaccatgtctttgggtatttattggtctataagaaggtcacattggtatatttatggaag

SEQ ID NO: 816 - DNA, 1263 bp, Homo sapiens
ggaagactttcatcaataaaaatttccaaagagatacaggaaatttattaaagtatcaatacatcaaagtttagtgttccttttttttgaaaaaacagacaaggtctcgtgctgctgtccacgctggagtgcagtggtgccattacagctcactgcagccttcacctcctgacctcaagcaacctcctgcctcagcctcccagacagttaagactagggggcgcagcttctggtgctgcttcttcctttttcttaagagatggggtctcactctgttgtccaggctggagtggcacttcttcctgacctgccagttgtccgccgcttggtgataccgcttagcctctgggcagtggagcctgctctgtgggcagcagctcagctctgactgctgtcccctgtccccttgcttcccagagtccacgtcaccaaactggcaatcccgcaccagaaatgctttccagacattctggcctgcacctgcccttagatcatccttctctcctgcctggagaggccgacccttcggcttccacctggtctagcttcattccacacctgagccacgtggctgtcttggccactcccctacaaacacctaagagagtgaacatgtacttggtaaaggcagacaggcctgagcccttcctgtgaggccctccaggccctgaggtgccctacctggcatcttctttcagaattcgtctgtaacagacgctgcagcctgcgcttctggccctgagtacagtgtttcttggagagtctttgcatgggtcatttgcatcactgatttccttccttccttccttccctcccctcccctccctctataatatcgcagcccacaacataaggaagcccatagcctctctacgacgcgcaacgaccctagagtaccttgttcccccagaagtacagccttcctctaaacttttccgaatccttaccggacgccttgtctctgagctccacgtacatttagcccgagccgcacatatcacagcttttctctgaaaggtcagaacgtaccttatggtgcagcatattaagactttcgaccacggattggcaggggagccaaggcagacactgtggcaggaggacataaaattctgggcctcgagatcaagatatccgacgatacacactagcgccatatgacactagtctgcatcatttatgtcttgggcaatcgagtaggctgcatgtgtcgaagattccactggtgcggcagtggcggagcatttaggcatatacaacacc

SEQ ID NO: 817 - DNA, 1053 bp, Homo sapiens
cttccacccgggtgaagactcaggctagaatgcaggctgcagtctcagctcactgcaacctccacctcttgggctcaagtgatccaaccacctcagcctcccaagtagctgtgcaccaccgcacctggctaattttttgtttattttttgtagagatggagtctcactatgttgcccaggctggtctcaaactcccaggttcaagcaatcctcctgcctcagcctcccaaagtgctgggtttacaagtgtgagttgccacacccactcgtctttcttacaacaattacaaaaaatattggctggaatgccaaagctgtgagttttatctcaaccccattagaaaagtcagcagattcaaagtaagcagaaaaaaaaaaaatagagaacttagaaggctctccacattagccctatagttgaaggcttgttttttgaagagactgtttgaataatgataatttgagctcttaatttttcttgatgtaatttgtccaccagttaaaaaaatatgcatgagaatgggctataatatgtaggtgtcgggagtcccagaaaacttggcatgtcttcatatttaagaatcccattccgtttcttattaatatctttagagcaaagaaaattctgtaaatcctgtcagagaatgtttggagtttgaccaatgttttagatggtggtgactggcccagcagctttaaaaaagttttttctttgtatcttctagtatgtattttttccagttatgaattcaacgtggaacccagttgtttttaattagccaccctgtgcccaccatttagaatgtttatttttgttcttggaaggttttagaaacaaagaagggaaaatggccaaatcatgcatttaacccaactataatcaggatttgcaaaaaattttgacccagcatgtagattcaaagaaattttcagcttagagcaagggccacaaatgaatttaacctagaagaccttgcaccttgcaccgggcaccttgatttttggaaagggaatctgaattcttctaaaaccccaaaagacatctggtttttt

SEQ ID NO: 818 - DNA, 1128 bp, Homo sapiens
atcgaccgctcggatccttccagcccagagtggaagacccctgcctgtgggttagtttctgcattagttgctgatgtccgtctctggcacttcccaccaagagcctgaaccccacacacctgggctcagtccccgagacacgggccacgcggcacctgctagggcttctgtgttgagatggttgcagtggacaccaggagagtcgtgggtgacagtcgagaaactgcccaagaacaatcgctcaatcccgctggtttaatcacacactaaaagcctagtcattgaaagagggtgacatcaggtgggggttcccctcccctccctgggaagggagcgcggagctcacttgtgggtgctggatcctcacggcctcctctgcttctaaaggacgggggaggcaggagaacaggtggggcccagactggggcgggaggaaggtggagcaaccccatggcctccaggggacggggcggggaagaggtggggcccagactggggcgggaggaaggtggagcaaccccatggcctccaggggatggggcagggaagaggtggggcccagactgggggatgaggaaggtggagcaactccatggcctccaggggggatgggcaggtggctctgggatcccccctcccccaggcagcccctggactaatgcaggggaggggtaagtggtggagggcacgcctattgtatccattatttatgctgatcccttctcattcgtggtatatatgcgaggacgtttgtgtctggattgtctgcattaatatgactgctgcgcaggtctaatttaagtggctcgtcaaggttcatctgttcgtaaaatagatgggtgtaaattctatgtatttgtatctgtgccggcacctacactcattattgtttatgtagttccagactaacgattctcgatcagatggatcaccgttatgccaccgctgcatgtgggcatctcttaataccgaaggtggcccttgccgcttacatcggttcgagtcatgagcacgtgtgtgtgcgggctaagaatttcagttgactttaactatgtgcgatgatgatagtctattttcatgtataaaatgtgtgtgcgtgcttccgtaattatatctctcactctttca

SEQ ID NO: 819 - DNA, 727 bp, Homo sapiens
ctacaaggagcgtacttccaccggggaagagctgagtatgcagcactgcattctagcctgagcaacaacatattgagaccctgtctggaaaaaaatgaacaaaaataaataaaaggttacatccacgtaacctttttaaaaaaactctttttttttttctttgagacaaggtctggctctattgcccaggctggagtgtggtggagtttaggacagtcacaaggtggcatctgcacaaccttgtaaatgtcctaaatgcagggcaagtgtacaccctgaaatggtgaatttttttttttttttgagacagaatcttgctctgttgccccagctggagtggagtggcacaatctcgtgcgtcacatgacaacctcgaggctacagggtacaagcacacactcctgcctcacacaccaaagaagcaagacatcaagccacagcgcccccccaggagaacacgggcactacctcctggacaccttcaccaataatatacgacaggaggatggtggagatgagcgatgccaacttaacactgggcatgtgggcatctctggaggcatgggctggtctcgctctgctgtccatgctgtagtgccacggcaccctcatggcttagtgaagtccagatcttcggaaacaagcactccgcttgattgaacccttaagaactggaatgtcacgctgtaaaccatatttgataacgcacgtatcttttcaatgggtc

SEQ ID NO: 820 - DNA, 1069 bp, Homo sapiens
gaagacattatctccattctcatgacttctgacttcatctcctgaactcagataattttcaagaattcctaaaagatcccttctggcaattgttcgttttaggcagggtggttatctactagctctctataacataaatctcatattgcaagaataaaaatggtaaaacaaaccaaaaactccttaagatgtaagcccaaagtttttaagaaaatatgatcttccttcccatcctcccaaatacttaaaagcatttattatttggctcatcacacattgtgtccaagtattttccaactgagataaaactggtatggtttggctgtgtccccacccacatctcatcttgattagtaactagcacaattcccatgtgttgtgggaggagcctggtaggaggtgacagaattatgggggtgggtctttcctgcgctgttctcatgttaatgaatgagtcccacaagatctgatagtttcaaaaacaggagcttctctgtacagcctctctttgcctgctgccatccatgtaagacatgactttgctcctccttgccttctgccatgattgtgaggcctccccagccatgtggaactgttaagtccattaaacctctttttctctccagtctcaggtatgtctttatcagcagtgtgaaaatggactaatccagtaatttggtaccagaattggggtactgctgaaaagataaccccagaatgtggaagtgactttggaactgggtaacaggcagaggttagaacagtttggagggctcaaaagaagacaggaaaattaaggaaagtttggaacttcccagagatttgctgaatggctttgcccaaaatgctgatagtgacaggaaccataaggcccagcctgagggggcctaaaaggaaaaataggaattgttgggaactgaggcaaagggacctttttattttttggcaaaaacacggtgggattcttcccctcgccctaggaacttgggaactttaaacttggaaaaaataatttagggttatcgggagaaaaaattttctaccacaatgcctttgaggaggacattgg

SEQ ID NO: 821 - DNA, 1593 bp, Homo sapiens
  misc_feature (1)...(1593): n = A,T,C or G
gtatgcgcgccttttgaccgctccattaccagaagggaagactgtccattctggccagctcataggtcatccctacagtcatgctccagggctatgaagaatccagttttaatggtctcaaacgatgggctttcttcacgtggagagactattccacagtttaatgggtggtcatgggtagcttttcagtccgggccccagaagtagccgaacaggccaaaaagaaaaaaaaccaccccacaacaaccccaaaacccagagacgaggggaagggggattgaaaaaatgggaagaaagaggggagcaaaccacctacatcatgtaatgttatccttttcaaatcaaacgcctttagaaatccctaatcccaggcccccactgcccataatcgctagacaccctcgagtgacgacctaaagcaggtttgatttgaaaagaaacaacacatctatatcccagctccacccttcagtcttaagagacagtgaaaccagccctaagaacactatctcttccaagagcaaggccagggtccgcacgaagtcaagtggccaccaactgacgggcaactttgctcactacctcaatctgtcaaactcgtcggattatcaccgggaaatcaaacgtcatgccggcaaagtacgggcgctccactgagggctctgggggcataacaggttaaggctaactcacaggtccaagagacacttctagccactgtctcagtgagcggcggttcggaagaataaaggcgcacctcccacggtaccctcccagtacaccgagcactgagagcgcggcaagtagaaaagcagcgcacgacacccatggcattgccgggcggcaggcccaagtgcacttaagaaaagaacctgggcactggctggtttcaccgcgcggaatcgccaactgcagcccaacgacagggtgaggggtccagaggggctgcgggaccagagaccatcccttcggagacggacgcggcacgcaattccagccagtgccttaaggcaggtttcaccgtccccctccccaccagaacaccaggaggaagtggggacaggggagggggtgtcccccagatccccgctggctccagaaaactctctgcagtccttgcagtcaagtcaacatcagacgagatcaagcgggtgagggaagggaaggatcgacgggtggggagaggaaccgacctgtcgatgaggatcttgtggtcccccatccaggggatgaggtgctgtccctgttcctgagccagggcccgctcgtcgtcccggaacagcttgcaggcatagccgaaaaccaagagctccactcggctgcccccaccgncggcaccgcctggcccggcctcctccttcgcgccgcttttcctctcgggtttggcgcgggccccgctcgcgccgtacatgacaacgtccccggggttcaagctggttccttttttgtgcccgcgaagtccctgattcctgcacttggcctcccctttcatcaaagaccccgattccgtaccaaactaaaacccgcgccatacgggcccacaaatggtggaggggcagattcccggaggagagccgcatttccggcaacggt

SEQ ID NO: 822 - DNA, 1200 bp, Homo sapiens
ttccgcccccgggtgaattagcagttgctttatttatttttgtgcttgttatagcaattttgaaataaaaacagatatcatgacatgtctctcctaaatattttctctctctctctaagaaggtgcacattttcctacataacaatatcacgatcacatttgacaaaattaacaattccggcccaggcaccatgggtcatgcctggaatcccagcactttctgagactgagactataggatcgcttgagcctagggttcaagaccagcctgggcaacatagtgagaccccttatctaaaaaacaccaaaaacacaatgattttgtaatgttgtgtcagacccatccatattgaaatgtgtcccatccccacacacaatgattttgtaaggtcgtgtgagacccatccatattgaaatgtgtcccgtccccacaaaatatctttacatggattcgtttgaacgattaccccatccagggccacgtgagttgtgtaaacctcttgagctacagtggcttcctatttcctccacgttgtgagtgaacatcggggccagttgtcctgtgatggaagcttgaagccatgtgggccggggaagatgaggagtacaggggcccgggaggcgtggctttggtttaggtgatcagggacagccccttaggaggggacatccggctgaatcctaaagtcacagagtgccagccttgtgcggttccagcggagtatgagcctggcagggctgaggtgggagctcacatgactgagcttggcccgaggtgtgcggtgggcgtggaaggatggttagaagttacgtcgtgggtgctgaaccagggaacggacatgagcccacccaggcctgtggctggcagggccgcagctgagtcacttgctggccaggctgcaggcctggctctgagccctttgtggcatcagatcctccatcctcgaggcagcccatggggttccctccagggtctccaggagccgcagccactcagccccatgcaggtctgtcccctgccccatggccatgtgcgcggactggggtgcagctgacaatggttcccattcacgtccagggcccgggcatctgaccctcatcgggccacactgggccattgcgccattaggccatgcctcagagctgcagcccgcacgcctgcactctccccgtgcgcctgagccagcttgctcctgcggt

SEQ ID NO: 823 - DNA, 987 bp, Homo sapiens
caagaaccaatcagcaagataataaatttgaacgcttgatgcactacttgagaaaaaggttgtaataaattgtttaatttgctcaacagtatgtctgaggccggacacagtgactcacacctgtaatcccagcactttgggaggccgatttgagtggatcacctgaagacaggtgtggcatttgagaccagcctagccaacgtggtgaaaccctgtctatactaaaaatataaaaagcatctgtgcgtgggggcaggagcctgtaatcccaactacttgagaggcttaggcaagaaaatggcttgaatctgggaggcagagattgtagtgagccgagatcgcaccactgcactccagcctgggtgacagagcaaaactccgtcttaaaaaagaaaaaaatccagcaatatgtctgagtggccctgcggatactcttggatcgaatcccttcttcctggcttctgtctttgggtcatagcccagtgttgtcagcccagggcagccaccagcttacacagcagctttgtgggtcttggaaaggtgcctgattcctcatgtgctgtggccccacggtgaggccatggatccataaacagggtgcaggtgggactccagcccctacccatgcccttggccacagccagcaggacacatggccctggatcagccagtcggccatgggtgggcgcgtgggcagtttctgaattctttcctattacaaatcccgctgcaacaccatgcttgcattagccttcccgtgcaaagaccggagcgttcctctacagcagacgccaagaattctggccgcagaacatgtgcttcttgaatcgtaatagctgctatcctggtggccctcccgaggggctgtaccaggagcctgagtgcccactccccacacctcctccacagatgcataatacgtggtttttctttttccttccttccttgtcttcaccacgggctggaagacgcgtcgcacttacatta

SEQ ID NO: 824 - DNA, 1019 bp, Homo sapiens
gtacgcggatccttccagcccgagggtgaagacaatgtggcacacatacaccatggaatactatgcagccataaaaaatgatgagttcatgtcctttgtagggacatggatgaaattggaaaccatcattctcagcaaactatcgcaaggacagaaaaacaaccaccgcatgttctcactcatagatgggaattgaacaatgagaacacatggacacaggaaggggaacatcacacaccggggcctgttgtggggtggggggagggggagggatagcattgggagatatacctaatgctagatgatgagttagtgggtgcatcacagcagcatggcacatgtatacatatgtaactaacctgcacgttgtgcacatgtcccctgaaacttaaagtataataattaaaaaaaaagaaaagaaaaaaggcggaggcagcctgggccccgtgccgcacctgtgctgggatgggcgtcgacgcgtccctcctgccctgggaccctctggagcggccggggccccagccctccctgccctccagggaaccgcccgctgcctggcggtgattcccgtggttaaggcaggagaactggcttctgctgctcacgggaaaggggcctaacgcagcgttcagatctccagtcaaaacgcagcagcgccgaggctctgcccgaacaacgcgggaggcgaaagcaactgggaggcgcctggttctccgggcagctgccggcagctgaggaaacggaggcggaagaggcccgggcggggagcgcagctcagggcgggtcgtcccccgcctgcctcacaccccgcccgcacggccttctgttccttctgttccttctgcttccgggtcccagcggggcgcaagcttcaccccgagagggttctgtctgggttgagtaaggtttctaagacgccaagcggaaacagttcaaagatctaatgcaaatgtctctctcttttttttctttttgacagtctctcaccacggggctggaaggatcagcgctggcgttat

SEQ ID NO: 825 - DNA, 1307 bp, Homo sapiens
ggaagacgtgatgtgtgcctgtaatccctgctattcgggaggctgaggcaggagaatcacttgaacctgggaggcggaggctgcagtaagccaagattgtgccatggcactccagcctgggaaacatagtgagactctgtctgaaaaaaaataaaaataaaatagtaaagacagggttttgccatgttgaccaggctggtcttgaactcttgagctcgagcaatctgcccaccctggcctcccaaagtgctggggttacaagtgtgagccaccacacccagccaaccctatttccaaaccaggtcatattctaaggttccggatggacgtgaatttggcgggacactatgtgacccactcaccttctgctgtcccccggagtcaaaactatctcagatgggccctggctagtgtgagggctggtgaaccgagagagccccttcagtggggagcagggggatggggcagacgggacgcaccgttgagggccctggggctgatggctccacgcgggagctgacgtttgcctgtggcctgggggtctcagcctgcctgggctctcatttccctccctccgtcatctatcccagtgaactactggaaccgccgtgagtgcatcggatgactcctggcgtggggaggaaggcggaagatgggggagaccctcataggggcacccccgggctgaggaggggcgttcagggaacctcggcctggggcacgtggcctgttctccgtgactcactctgggctgacccctgcctgcagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgactttttccaaggccgaccataacgacgggctacccctttgacggcccccggcgggacccgtggcccacgcctttcttcccccggcaccaccaaaaccgccggggacacccattttgacaatgacaagggcctggaccttcccctccttgggggccgttgggggcaacccttagggcatgaatagggagccccccgcgggccttggaaggtttaggagaaacccatggccccccaatacccaaacctgcgggtgaaatacccacgcgcgggtctctgtagacccgctgggcctttcctaactagggccgaatatgacgtatttcgtgtttcgcccaggaggacctaccagagacgttgtcctatgacgacgggaaacacctctgtttgcacccactccc

SEQ ID NO: 826 - DNA, 1616 bp, Homo sapiens
ttgcgcggcacttctgcccatggcgaaaacccaagaggtcctccccaaggcaaattatagtcaaaatgtcaaaagttaaaggcagagagaattctaaaaacatcaagagggtgggcatggtggctcatgcctgtaatcctaacactttgggaggccaaggcaggtggatcacatgagcccagaagtccaagaccagcctgggcaacatggtgaatcctcatctctaccaaaaaacaaaaaacaaaaaacaaacaaacaaacaaacaaaatatatatatatatagacacacacacacacacaattagccaggcgtggtggcatgtgcctgtaatcccagctactcaggaggctgaggtcagaggatcacctaagcctgggaggtcgaggctgcagtgagctgagatcgcgtcactaaactccagcctgggtgacagagtgaaaccctgtatcaaaagaataaataaataaataaatatataaaaacaaaaacatcaagagaaaagcatcaagtcacatatgagggaatccccactagactaacagcagatttctctgcagaaatcttacaggctagacccagagaacaggatgatatatttaaagtgctgaaagaaaaaaaaaaacttgtcaaccaacaatactatatccagcaaagctatccttcaggaatgagagagaaataaagtcttttgcaggcaagcaaaaactgaggaaattcattaccactagaacagctttataagaaatgattgagggagtcctacatctggaagagaaaagataatcgtcactatcgtgaaaacatgcaaaagtataaaactcactggtagaccaggtacacaaacaagaaagacgaaataataaaaacttggttgggcagggtgattcatgcctgtagtaccagcactctgggaggccgaggaaggcaaattgcttgagcccagtagtttgagagcagcctggacaacatggtgaaatcccatctctacaaaaacaaaattagccaggtgtggcagtgcatgcctgtggccccaactacccaggaggctgagacaggagatttgcttgagcctgagaagttgaggctgcagtgagccatgggcatgccactgtactcagcctgggcaacacagtgagaccctgtctcaaaaaaaaagaaaagaaaagaataaaaacctgttactacagaaatacaccaaaccaaaataacaaacaataagcaaagaagaaaggcacaaaggatatataaaacaaccagaaaccagtcaatgaaatgacaggaataagtccttgcatattaataataaccttgaattaaaacaggttaaattctcccactaaaaagatatagactggctgaaaggattttttttaatgacaaaactatatgctaccaacgagaaattcactacacccattaaagacacatatagactgaaagtgaaaggatagaaaaagaaattccatgcaaccaaaacccaaagccagcgggattacctgtatttatatcagataaaacagacctttgaaaaccaaaattggtaaaaagaagaaaggtctttatgtttttataaaaggatcatttcccccgaaggttttataaattttcctgccc

SEQ ID NO: 827 - DNA, 981 bp, Homo sapiens
gcctggccgtcgacatttaggtgacactatagaaggatccgcggaattcactgtctggctgattattagtgaggggggacatcttttcttttgcttaactgttttttgatattccttttctgtgaattacctgctcataatatctgctcatttttctatcgctctttctttctgtttgttattcatttatggaagccacttagaggttgcatgtaccaaactgttgactattaagcatgaggcaaacgtcgctcctcaatctgaccttctcttttcacttgtgtgtggtggtggtgtttacaggaagaggtctacagttcatcgcaaggctctagagggaatcaggaagtgccaacctgaggtatgccattttggcagcagaattcttttgagcagaaagcattggagttcctaaaattctttatctgcctaaaaccagagcctcccccaaacaactccattgtcctaagtgtctccccaggaacaactgtaatcttctcttcttggaggggagaagcccccccacatcccggcagacattgtcacaaaggaccatgtctcccatctgccctcctgagggcccatttatctctcaataaagtcctttgcgtttccgtaagtgcgcctctgccctccctacccccgttaggacgagatgtgagctccagaatctcactgctcctctggtatttgcttatttctgggacaccctcatgcacgttaagtttaaaattccaaatgcatgcttttttcctgttgattttttgtctttttttgagacagtttcactcttgttcccccagcctggagggcagtggcgcatctcagcttaccggaaccctccaccttcccagattcaagtgattctcctgccctaacctcccaagtaactgggattaacagcattgggcaccattgcctggcttattttggaatttttagaaaaacacggttttctccttgtgggcaagcttggcttca

SEQ ID NO: 828 - DNA, 1522 bp, Homo sapiens
agggggggaaaactgggcaccaccctgtgagttcatgatagaaatgcgcctgatgctccaagcgcctgtaaacagaccctgggaagggagggatcgctggaggctgtggtcagggctgggcccccaggcagggcagagtccaggctgaccggggcaggtcatgctgccagacagccgtggattgcatcatgggcccggctgccacggtggcctggagatccccagggcgtcctgggtgatgcaaccagggcgaggccggcctcagcctgccttgaggggtgcaggagccccagagccgggctcatgcatccctgctccctccctccctcttccctcacatcccaggtcctccccagccgggagaccacctttcctctgcgcgtcctttggtttctctttgtgcttgggaaacgagtgttgtgacaactaaaagctgctgtgtcacctctcccagaggccagcccaccgctccgctgccttgtttagtgcattattatttaaacaaatgggcctggctgtgttccagggaaggttgattgattcatgcaacaggctgcagggatcctcctgtggccccaggacctagcttggctgagaccgattggattagttttgatctttctttcctttctttccttcttttcttttgttttctctttcttttcttctctttcttttctttctctctctctttcttttctttctttttaaatgagtgatttttttcttttcctttttttttggagtctcgctgtgtcgcccaggctggaatgcagtggcgtgatctcggctcactgcaagctccgcctcctgggttcacgccattctctcgcctcagcctcccatgtagctggggctacagaggcccgccaccacgcccagataattttgtttttgtacttttagtagagacagggtttcaccgtgttagccaggatggtctccatctcctgacctcgtgatccacccacctcggcctcccaaagtgctgggactacaggcgtgagccactgcgcccggcctgggatttattcttttgtttgagccaaaagctcttagctgacactcaagctggagtgcagtaacacaatctcagctcacttggaacctacacctgctggggctcgaagcaatttccctgcccttaacttccgtgagtagctggggattacagggtggctcaccacaatccaacttaccttagcggtagggtcttgtcttgtttttgagaagggaatatccactcttaggtgccccaagctggaattgcacgatgatatgaatctacggttcattgtcgaacctatcagcctgccgaggttataaaaggtatatttctggcttcaggctcaacggaatagctggggtttatagggcgcttcaccagacttgcctgaactgaaggaatcttctatttttattacttagaaaatatttaaagagggagaattaattttgagacgccaagctctgaataggtaattatactcacaaaacgacagctgttctctcgttacacccg

SEQ ID NO: 829 - DNA, 1437 bp, Homo sapiens
  misc_feature (1)...(1437): n = A,T,C or G
tgcgccttgattcgcgcgtttccttgcggcgcatatattgaagactgtctctgatgcgcatcttctcacttgaaatcagcatgtgtcttaaaatggacagagtagaagttcaactagcaacattgtgtgcttcctactggcacatacgtgaatggtggaggctcacgcctctcaacccagcactttgggaggcccaggctggaggatcacttgagcccaggagttcaagaccagcctgggcaacatggtgagaccctgtccctaaaaaaatttaaattagccaggagtggtggtgtgcacctgtagtcccagctactcaggaggctgaggcgggaggatcacttgagcatggagattgaggctgcagtgagctgtgatccagcctggacaacagagcaagaccctgcctctaaaaaaccaagttaatggtgggtgtgttgtggacggcacccaggttggaaggaaagcagttaagtattgctacgaagctcagctgcacagcatgtcacagaacccatccaggctggggctggagagtgctttgtgaaccagaattggcaatgatgcttgggtgggctgggccctgcacttccatctcccaccgggttaggtgccccagaacaggtctggggtgcgccaggggctctgaatcccctcatccaaggctgccaggggaccgggctttcctgccatctcagggactctgaggagccatcggacagtcggagggagaagagagcaagtgaggaagtcacctctggtataactgacatgagacttagatagttggggtcaaggtggatgtaggggcactttagctgggtggtcagtgagggcttcctggaggaggtggcatttgagctaggacttgcatgatggggtgagcacttgggcagagggaacagctagtgcaaggcctcaggttggggaaacaaaaagaggccaaagttcagggtccacagctccagtagacagagcaaagattcaaactcaggccacaggtccccagggtcagggcacaccccctgcacctcaccaagttatcgacaggaggatggtggggaggggaggccagcgtgacagtgggcagggggcactctggaggcaggggctgggctcgctctgctgcccaggctggagtgcagtggcagcctcatggctcactgcagccccgacctcctgggctcaagcactcctcctgccttggcctcctgagtagctgggactgtacaggcctgtgccactgcacctggctaattttttatttttattttgctagagatggggtctccctctgttgcccaggctggtcttaaacccctgggctcaagtgttcttcctgcctcaacctcccaaagtgctgggatgacaggcgtgagccaccgcaaccagctaagacnccctcatattcaccacggggctgaaaggtcgcgcact

SEQ ID NO: 830 - DNA, 1733 bp, Homo sapiens
tgggaaacggataaacgcccagtagaattcaaataaaatatgaacttcaagaaaggaaaaaaggatgtgactctgcaccctcagctgaacatgagaaattatcctgtagaaacaacagggataaaaaaagtcaccttcctatcatatattataattcatttccagacatgaaagtaagactgagatttcagctgctgaattatacatcttgattcttgcatacagaggactcaaaacatttcccccaaaggcctaaataatgatgttcagccttatttttccttctacacacctcacacacaaacaaggatgggccatcctttctggaactctatccccaggacatgtggtgaatgtcacagataaagaaccaggctgaatagccaaaggcgtccaaaagcgcaggcttgtgacttgattgtgcagccgttgggaaggacagagccaggatggccgacagcaccgttccctctgggcagcaccaccagcagggaccactgtcaccatcttcactggagacagagatcgaggctctgcatggcgactccaaggagcacagaatggaaaaaggagaagtcactttacagtggagaaacctggcaaccaggctcagccaggaatcaaggtcaacgtcagccatgatgtccgatgcataacaggggccctcaatatgccgtgagagacagccaccttacctctgtacaccccaggctaatcaggagcaaagcactggacaaatcccaacaaagcgaccatgcacggaacacctggccagtcctcctcacaactgtcaaggtcaataaagcaaggaaagcctgggaaacggtcacagccaagagcaacccaaggagacacgatgactgaatgtcacctgggatcccgggtgggagcctgggagagtaaaaggccgttggagcaacgaataaagtgtgactgaagcgtggacatgggttaagagtgatgcatccgtgcgaactcattaactgtgacgaatgtaccgtggtaatgaaagaggttagtgacagggaaacgggacaggagctgggaggactctgtacagtcttcacaccttctcagaaaacctaaagccatgctaaactggaaaagtttattttaaaacataggaaacggtgggtgttgaggttgcagaatcagagatgaagagctgtaaccctaaaactttatttcccagctgaaattggatgttttacaaaagatgacgctggggctggtacggctggccttttcccaccctggccaaagtgctttcaccccatgacaacgtctgtgtgcactgagctctagggtctttttggtgttttaaattattggttctatgtgcccaaaataaaacatgtgtgggcgttataagcgtaaagtatcaaattcccaatgggtgggaaaacaaacttcttctttgtgatttcgaccacacagtatcttgattaaccctccaaggcgggccaggccacctggtctctaaagagcatttttaaaattgtactctacaaggcagggtgggaaattgccctgatacctctggggctctgcaagggccacgcaagattggaaatctttgtcccaccaaagacatgttttgtcttcgcaattatttaaaaaaaaaggcttgcccttcctttataaaaaatgtgaaatttgctgtggtttttgtcaaaaattgaacttatattttttttccattcttttaagatttgggtcgacctttaaatcct

SEQ ID NO: 831 - DNA, 1070 bp, Homo sapiens
tgacgcgcaccttacaccccgttaacgacagcgcggatccttccgagcccgtggtgaagactacgaggaggaatgacaagatgatgccaatccggggttggacaggcagttgctgggcagatttccttgcagaagtattttctgggcaaagttgtgttttttgcagtctttcgtggtagtttttatcaggcatacaaggctgcgaaccctcccttcataatcttccctggctgtatttgtcaggtgatttttttttacactaataactctattttgattctgaaaactttcctatttcccctttttaaaaatattttttaattttttttttgagatggtgtctcgctctgtcgcccaggctggagtgcagtggcatgatctccgctcactgcaacctccgcctcccgggttcaagcgattctcctaccacagcctcctgagtagctgggattacaggtgtgtgccatcacgcccagctaatttttgtatttttagtagaaatggggtttcaccatattgttcaggctggtctcaaactcctgaccttgtgatctgctcacctcagcctcccaaagtgctgggattacaggcgtgatccaccatgcccggcctcttaaatttttaaaaaataaataaagatggagtctccctgtgtttcccaggctggtcttaaactcctgggctcaagggagcctgctgccttggcctcccaaaatgttgggattacaggtgtgagtcactgcacccaggcaattgtttttttttgagacaggggactccgttgtccaggctggagtgcagtggcgtaatcatagctcactgcggcctccacctctcaggctcaagcaatcctcccaccaccatctcacaagtagctaggaccacaggtgtgcacccccagacccagctaatttttaaggtttttttggcagaggcaggggtctcactatgttgctcaggctggtcgtgaactcctgacctcaaaagatcctcttgcctcagccttccaacgcactgggattacaggtgtgtcttcccctcgatcggaaggaacgcgcacggtggtcaat

SEQ ID NO: 832 - DNA, 1507 bp, Homo sapiens
tccagccccgtggtgaagaccttctctccttggttggcttctgggtctgtttgaccgtctgtcatctgttacacgtgtagtcatggaggtgtggcagggacaggtgggcagcactgggcctccctgtcctgggcccccagccctccgacagcagccactggactccccttccccgtctccacgcctcctgcggtcaccgcacaccccttcttcccaggccgtcagctccccgtgggcatgtgtccctgccggcacccatgctgcaactgccggacaggccctccctgcggcagtggtgcacagcaggggagcagcccagccccgcctcaccatgctgagcaccgcatgttgccttgagcgccggctgcttgctcctggcgcctttcctgacgtgcagatgcccgggactccactgcaggcttcggccccccagtggaaacacaatttgtgtgtagctgagggtccggccacctggagttggggctcgtaaggtccttacaccagaaatgaggatttgctgcttgtctgctgtaggcaggtcacagtgacacttttgtccccacaggaaggacactccctggcgttcacttaaacgcctgctgtgccgaggtcaagttccattgtcagttctgccaatttaccaaaacccagaaattgaattacggtttttcctccttatggcgcttggggtccagacgctgcctgcccgcgaaggccagtgtgggtgaggcaggtgggcaagctggggcaggtgggtgggtggggacaattatacaaacaggtgctggacgcgtgacatcatacgaggtctcaaattggctgctaggattgcacgagacttatagcctctccttgcgatcttgaccctatctagacgtgcttcaatgtggatataaacaatccgggaccatacaccttggctgctgaggcaatgagcttagaaacatgatgaatccccactattgcagctagggaggcctcttcatgctcgactacgacttgatcgactgattagaccgaacttttattacagctgactcgagcctagccaacaatctggtcatgtcctccatgacaccaccttggtcagtcgttagccagaatacgtagcaacatttcgagaccttgtcgcactatcgacacaatatccttaaaatgctggacaaccgccgagtggcagtcctgacctgtgtaccaatcgtatgtctacatgaagaactcttctcacgctgtagactctcatcagaagtgtaaaggataacatttaccaaaaacacggactagatactgactacttacctattacgacgtgatttagacagtgccacgtgataacattaggagaatgtactgtgatactgcagtgatgagtaagaagacgtaaagaatgtattaaatactgtatgcttctgacatgtacccatcatctaacacttagacagaagtcgcaagttagcatcgaacgctgtcatatgttacggaccactctagacaattcgtagcgacg

SEQ ID NO: 833 - DNA, 1568 bp, Homo sapiens
ccgtaccttcagccccgggtgaagaactgttgagcaaattaaacaatttatgagaagcaagaaaagcagaaagcagaaaagacccacaataactgtatcttgtatttatgtttgccacgtgcacatccacacgttgcatcacatcttctgagccccctgatccagccttgcctgctatccatctcccttaccctgcaatttcctttagaaaagccacctttgtccctgtcagcccagggtttagtgatgctgccccatgcctggagcattaaacctgggctgggcccatcagctcatttccagcccctggctggagactcaggtagcgttgtctgtggaccatgaagatgggcaaatgacaggcgggcactattgtcggagctctgtgggacacacgcttggggctcctagctgtgacatgaaggttgtaggaaagccagaggtgcccagccctggtctgtagccatccgggtgcagacactctgacgggcagctcccaggtggccctgcccacggttgctcctgtggggacccaggaccctcgtgtcaggcagtgaggagggggtgctgtgcccctggttgtatcgctcagggtgaattccattcaaggctctttgggtgtaagtgacaggaagcccagtgcagagaggcctgagcacaaaacactgtgtttggcttatgtcacccatttcagagatgggccctccctggaccctatgccagccccagcctggttggtcttctcctcagcccagcgtcttcgaagtcctggttccaagtcctcatgcactggtacctggcttccctgctgccacgaacaccaccaatggaggtcctcagcccctcgttgttgacttttaaatgttaattaattaattaattaattatttttgagatggagtctcactctgtcgcccaggctggagtgcagtggtgcaatctcagctcactgcagtctccgcctccttggttcaagcgattctcctgcctcagcctcccgagtagctgggattacaggaatgcgccaccacgcccagctaattttgtatttttagtagagacggagtttctccacgttggtcaggctggtctcgaactcctgacctcaggtgatccacccgccttggcctcccaaagtgttgggattacaggcgtgagccactgcgccccgccccacgtatctttttaaaagataaatgttatcgtgtgcatttacggtgtacgttgtggtggtgtagggtacgtatacgtagtaaattggtggccacagcagaacgggtgagttttgcatcatctcccaggcacctgtcttcctcccacagccagcgcaaccatgacccatgcattagcagacgcctggagcataattattctctgcagccctcaggtgcacacgagcccttttgaaggggctcaccctgtcgcccactgttttattctctgtctttatatatttgatccccacctttttatttatttatttttgtgagacaggttcttgcttcttgcccaggctggagtgcagtggtatcttcaccacggggctgaaggacgcgctgcacaggtag

SEQ ID NO: 834 - DNA, 1789 bp, Homo sapiens
gtgagcccaccccttggcgcggcaccttccattcaaaggggaagacgggcagccccctgcctggagccccgctccgtgtcgggcccggcctggcgtggagcctccgtcctgccgcggcttcctgctcacactggcggtgcggggcgtcctctgctggccctcggggaaccgcgggccgagctcaggcccaggggcgggcggcttccccgcggggagggacgaggaggccgggatctgggcgggagcggggactcctcctccgcccgctcgccggaggcgctcccggagtggactgatattcaggtctgggcgccagggacgagaagtgctcctttgtctcagagctgcagacagagctgcacccagcagggctggagccggggctggaggggagggcccgccccggagcgccccccgtatgcacgtgaacaaggccgggattcaggctgctgggctgcggagccgggctttcaggagccctcggcggggacaaaagagcgcactgtccccccgggggtccttggcggggctgcttgtccttgtgggcctgagttttttgtctttctgtgttttgagtacgacatacagcgagcagcccagggtctccacaggcgtccgcctccctcccgcccctggttcctgggcacggatgggacgcggctctccgtgccttatttttgcacggtggcaccgtgggccgtgcgattgcagcttcgcacgctatctggagtgtctgtgccggagccgcccgtctattcacctggttaagcccaggctcggcctgcagcctgcttgtggccagaacttcccggactcgcggcgagagtgtctcgggatctgggtcctgggtggcagttgtgtggtggcagattttgacaagctgctctaaagtttctgctccatttctcctctcggcagcacagcctgtggctgtcatcaccgcgcccacggcacagtggcagctcccttgatcttctgtaggaggtggggtggggcggggcaggtggggggtactgctgaggtcgtgggatgctgggccagatggtgccaggtggcagccgccctccatgtcctggcttctgccggtggcctctgggttcctggccctcaggaccttgtcatcgccctggctggggccagggtgtcccctctcaccctgcagctgctcccagagcttcaggcgagcacccccagccaaaaccaagacaggcaggagggttagaccatggcctgatttcgccatgagagacgtctgactgtcccttgctccgcggtccccttctgacagccatcttcatggctccggggatgttgtttgccttggacgtgggctttgccacccaactaagtgccgggcctcagtctccctgtctgcgcaatggggccagtgaggacaggctgccgtgcgatcagcggaggtgcttccgatggttcagggacaggaagggggaaggctggagaggatctggggggggacgggaagggggaaggctggagaggatcggcgtggggggaccggaagggggaaggctggagaggatctggggggagatgggaagggggaaggctggagaggatctgggggagggaccggaagggggaaggctggagaggatctggggggtgacgggaagggggaaggctggagaggatggggagggaccggaagggggaaggctggagaggatctgcggggggaagggaagggggaaggctggagaggatctgcggggggaagggaagggggaaggctggagaggatccggcggggacgggaacggggaatgct

SEQ ID NO: 835 - DNA, 2225 bp, Homo sapiens
  misc_feature (1)...(2225): n = A,T,C or G
gttggccagcgcggatccttccgcccattgtgaagacgaggtagtagctttaagagaagttaatgggtttggagtggttccgtccctgaattgtgccttgatgaactcttagccaaaaactggctcagatccgagcttctccctttgtgccctgcctttaaaccaaagctgcatctctcacagaaactcttgcctttcagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggtaacccctgtcctccagcagctctctctggggaaaggcaaggggcggccagcaggactctccctcctccctgagtccttgcctatgtcagtactcgcctgtgtccagggggcgccagccacaaagccaaaccgcaccccctctagcaaggaagtcgccctagatgtggcttcttacaatccatgagcgctcagaggagcaggtcctgtactggggagaccctcctgcagagcccaggagtggagcagtccacttgaagcagcccaagtgtcacacacgtgcctgatgcccaccaggcacactgggctgtgcaatgaccagtagaccgggaactgtcaccaggtccccaggctgccgtggctggagcaggtccccaggctgcaacggccagggccaaatgacgccaacctgtcaccgggcatcacacctgggcagcagcacagacgtgggcgtcccagtcccgggctaggtgataatgacttcaagtcagacaccctccgctgcccaggcacccacaccctggggggaccagagagcagcatctgggaacagctgtcccttaaactgatggcttcctaaatgtcaatcatgggagtaacgcgcaactgttccattctagtggcagaggcctcagctaatttgagatggattagaatctaagaggtggcacctttagagttaaaatgtaaatcaagctgggcgccgtggctcatacctgtaatcccagcactttgggaggccagggcaggaatttgagaccagtctggacaacatggcaggaccttgtctctactaaaaataggtggcacgcgtctgtaatcccagctactcaggaggctaaggtgagaggattgcttgagcccaggaggtggaggctgctgtgagccatgacggcaccactgcacatcagcctgggtgacagagagagaccctgtttctgaaaatgtaataatgataaaatgtacatcagtgtaggaggctgagcatcgctgcggggagggggtgttggctccagcacacagacgcctcatgcacaggccgagggcacctacagccaaggccgtggttctgggaaggctccaccgttctgctgagtctttcctttctttgtttcttttttcctttgtgtttaaggtaattttatatgaaaatctttttgagttagattgcaatttgtaaacatttcagatgagtataacacagcatgtttatgatgccaagttttattgaaggatactggaggggtgggcgcggcggctcacgcctataatcccagcactttgggaggccaaggcgggtggatcacctgaggtcaggagttcgagaccaccctgaccaatatggtgaaaccccgtccctactgaaaatacaaaaattagccgggcatggtggcacacgcctgcaatcccagctactcaggaggctgaggcaggagaattgcttgaatctgggaggcagaagttgcagtgagctgagaacgtgccattgcactccagcctgggtgacagagtgaaactcttgtctggaaaaaaaaaaaaagatactggaagcagatgcagtgggcacttctcagttctagagttggggttcggaggtggggatgctgttcactggccttggctcagcatcttcacacggttgtaagctctgctctctctctctctgcattaggggagtctctcaggaaaaagaagcccagatctcttcagcaatcgtttcttccgtgcagagcaaaatcactcaggtcagtgggcacgcccccctcccgctcccagcctttcatcaaggggcctcgtggtttctctggtattcaccccgggctaaaggtncgcgaaccctctc

SEQ ID NO: 836 - DNA, 1994 bp, Homo sapiens
  misc_feature (1)...(1994): n = A,T,C or G
ccccccagaggagggatacgaggtcctttcgcacccgggtgataaactgcccagcctattctttagtatttaacagaatgcaggacaagtcacatatcaatgattcgttactttacacacagggagtcttctgttatacaactggttgtgaacacccagaacaaagctcttacagcctttagatggccaaagaaattctcaaagcctgggcatgtctgaaaagacttcaaccacatcttttaaaaaacatagactctcagtcgggtgcggtggctcacacctgcaatcccagcactttgggaggccgatgcgggcggatcacgaggtcaggagtttgagaatagcctgaccaacatggggaaaccctgtctctactgaaaatacaaaaattagccaggcttggtggtgcgcagctgtaatcccagctactcgggaggctgaggcaggacaatcgcttgaacccgggaggcggaggttgccgtgagccgagattgtgccactgcaccccagcctaggtgacagagcaagactccatctgaaacaaaacaaaacaaaaataacatacactctctccccgtttcagaggactgggtggaggctatgtccgcctcccctggaagccctcaaggacccacagaagtctcgagcctgccagtgtgcagcgggggacacagatccgccctctgcaccgggagcatcatgtgaagtctaagaaagccctgcaggaccagccgtctcacacttgtcgtggaaaatcccatcagcacacctctgactcccacgtgggaatcaccaggccatcaccatcaaaccgccctcccgcaggcaaaaacggcaaacgcagccctcccatgctcaagggaggtctcatcgctctgccatagtcctcacaaatctccaaatacaaccaagatgtgtctccctcacagccctcgtccaagccactgtctctccctggcaaatcccagccctgcaccctcactggccccacgtccacccattctcagaacggcagtcagatggacctgcagaacctccgtctcatcaggccccactctgcccaaaaccctcccgtggctcccctgagcccgcacagtaaacacagaaatccctgacaccccagcgtctcctcagactctccagagcacccagcacatccctgaagcacccagggcctccccagagcattcagcacccagggcttcctccgagcacccagcacccagggcctccccagagcacccagcaccttcctagagtacccagcacctccctagagcacccagcacctccccacagcacccagcaccgccccagagcacctagcaccaccgcacagtacccagcacctccccagagcactgttccagagtacccagtaccttcctagagtacccagcaccttcctagagtacccagcatcaggcagaacacccagcatgacccagagcacccaggagcacctcagagtacccagcacctccccagagcactcagaacctccccacagcacccagcatcatccccagagcacccagcacctccccagagcatccagcaccaccccagagtacccatcacctccccagagcactgcctcagagtacccagcatcttcccagagcacccagaaccgccccagagtacccagcacctccccaaagcacccagcaccaacccagagcacccaccacttccccagagaactcagtacctctccagagcacccagcaccttctcacagnaccccacaccaccacagagcacccaccactgccccagagccccagcacacagaccttcccaaagcaaccagtacctccccgaagacctacaacctccccaaacaccccagacacagcacctccccaaagcacccacacctccaaaagcaccgagatttccgagcacccacaccactggccgaagggccgtgtgccacctccttagattctggaggttgggtttccttccccgaaaaaaccgccctctgg

SEQ ID NO: 837 - DNA, 1371 bp, Homo sapiens
atcgccaagctcgatccttccgccctatgttgaagacagcccaggctgatgctgagagtgtgcccagaaccaggatttacatccatccaagggatgcacctgaagtttggttccagtgaattgtttttttccaaggaacaatttgtataaccatatggagacatttttgttttctgatacactgcagacttggaaaaggaaggtcaccggtcacacatcctatggctgtgttgacgtgaaatatctagaatacctacatccatagagacacaaagataagtggctgccagggcctgcggggtgacagtgaccaggtttctttctttctttttttttttttgagacggagtctcgctctgtcgcccaggctggagtgcagtggcgcgatctcggctcactgcaagctccgcctcccgggttcacgccattctcctgcctcagcctcccgagtagctgggactacaggcacccaccaccatgcctggctaattttttgtatttttagtagagacgaggtttcactgtgttagccaggatggtctagatctcctgacctcgtgatctgcccgcctcggtctcccaaagtgctgggattacaggcgtgagccaccgcgcctggccgacagttaccagctttcttttccggcgcattttgaactagatcgaggtggtgatcgtgaaacacactgaatgcgctcggtgccactgagttggatgcttaaaatgggtaattttatattatgtgaatctcacctaaaaaaacagaaggattttgaggaggggtgggggaatctgactgtgggctctgagatgggagacctcactcactgctggggggtacagagaatgtgcacaagaaagggaggctggggggagctcacacgtgggcctggcagagctggggttcccggcagtggcccttgcccacctgctgtgccgcccctgcagggacctgggatgtggtccagccttggggaagggggcagtggcggatcccagccttctgaggtgggggcggggggactcctgctccgggatcgggccaggctgtgtctgggcggccacacccagcgcacctgctcctcacacctgtgggcatcccgggccggctccccctgtctttcccactgtgggccgtgaggcctgggccacttccctttgcccttctcacaccgctgccctcctggtggattgggccgtggcaccagcgtgcatccagccttcccaccgctggcctgtgggtatcctgcccttcctgcaggagccagcctggcctcagcaccccgtggagggtgcaggcgtcccgggctgcagctctgagcttcgcctatggctgctatattcaccacggggctggaaggagcgcgtcat

SEQ ID NO: 838 - DNA, 1676 bp, Homo sapiens
accttcaagagtgttctcttaacactctaatttttaattactctccatgggcaaggaggtagtatctacatacttctagttaattttagttaaataagggatttaaaagcatttgattttgcaactgagacaaaatatgaaggcaaagtgcaagcttattataaaatgaaaataatattataaaacaaaaccttccaggtgttggattgtctagcaagttctaccgtgggtgctggcccctggcattggttcccctccacagggccaagggcatagctgggtgcagagaccggcagtgccgtggtctctggagtctgaggacataagttaaacaagctagtcaagccccagatgcttgggaggcagaggcaggaggattccttgagcccaggagatcgaatctagcctgatcaacatattctctatgacaaaagaacaagaagaagaagaagctggtggtttctcaccataaccttttcttgtggaattctgcctcagctcttctgggaacagtgagtgcgtgttttatttagtaggattgcatttttctaaactggctgcaaacctgcctcctccatccaagctctgccagcaataatcatttccagggatccaagtggctttaaaatgcaagttagaaatgggaggggtggtgatctcctcagtaatatgaattattggagtataaaagataactaaattttaaccaaaatattgaaagtgttaatgctgttgttatcagatagaataaactgttacaaacgcagcctccactcagaatggatcggacttgtcacttgggcctgaacagacctaattgatcatttttcatgactgctgccagcccacagtagaataccgcagttgttaatatttctaattgggtaggatgctacatggaatgtattttgttttatatattaaattactaaaattctatataaaatacagaaagttaagattagaaagccttcttacagcacaacgaatatttatttaatggctatactgttcctgtggttgaagtcccatgtatttagtatgtctaagttatgggcgactctggatctccaaaggcaaattagtcatggaagaatctttagttttggaaaatcactatgttgcttctcaaaaagtatactagttacgacaaggtagtatttagtgtcttttacatcaacattgaggctggcacggtggctcacgcctataatcccggctcttaaggaggctgatgcaggtggatcacctgaggtcaggagtttaaggccagcctggccaacatggtaaaaccccatctctactaaaaatacaaaaatcagccaggcgtgttggtgtgcgcctataatcccagctactcgggaggctgaggcaggagaattgcttgaacccgggaggtggagattgcagtgagccaagatcgtgtcactgctctccagcctgggcaatagagcaagactccgtctaaaaaaaaaaaaaaaaaaagattaaagtaaaatacttttattgtctgttttcatttgtattttgatattgtatctggttctctatgttaatggaatgaagaagtactcatgtagttcatttacaacctgaaattaaattttaataagtatcagcttgaaactaagtttatttttaaaacttttgctaagatagtctcttgtgttcattta

SEQ ID NO: 839 - DNA, 2478 bp, Homo sapiens
ggtgcgcgacctttcgcccctggtgaatactggggcggtgatgttaacttatcccagttaacacctattctttcactgcctcaagaatgaatccctgaggatattaatgaacatgttaccaatctagaaacaaataatcctgaatgagtaattctgttacccgaatcaatgagaaataaataatccaacgcattcactttccacctccattaatcattctagtttttaacttcgttttaccaaaagaaggaatatcactcccgttttctcctgtggtcatagtggtgctatcatgagtgccagagatgtgttctgcagactggaccacggtgcatgcagcctgtgcgtacacgtgtagccctacaccagcagtccaggcagctccccactcacctctctgtttggaaggctcctcctcctccgtcggctctgacgggtcgtaatagtcgctaccgtaagtgaaccccacggcattgtagctcccatcctctgctagtgcttcactcaatcgcttgtattcttcctcttgaataaaaatgagaattttatcaacaaaaatagaaaattactgagaaaaactttatatatttctaaagttgtagctatcagtaaagcatacaacatacttttttcaacctacttttgaggtaaaatagttttaaaaattcacactttatatctatcattatgtacttttgtcagtacatgtttacccacagacagctgaatacacgtcttttgtggaaaatttcttcctgctgagaaaattttgggattaagaactgtattaaagactgttacggcaaagacaagaacatcaattttatttatacgatactgttaaagaagaacagttaaagagtttggtttttgtttttttcaaatcccagtctgccctcaaaagctgggaaaattctttgtggctctatatataaactatcctgaggtcctctcagaacgcaaagactcctgtttttccaatccactgggtactgtcaagataatatcagaaagagtgagtataaaaaaatgaatgggagtaaatttttaaatacttaaaaattttaaaaagtttgttgctgaagtaagtttgtcttgagcagtaccttgccttgcctcctcctcaagcaagtccgtatgcaaggctaaatacctctcttcatcacacagggcctctattcgcgcctcctcttcagacagctgataatctctgttccacgtggaatactcagcatcgtactcagaaaggtcatgcaggtgaccacgtccatcatatctgtaatgtgaacaagctggtcaataaaaggaaattaacgtctagactggtgtgcgtgtgtgatgttttatatatgtatatatatatacacacacatacttaccgattaaaataaacaaaaatattaaaacaagtataaaaactcttcccagatttatatttaatttggatagtcatatctcacctacttttaaactcaagttatcttaacaaactctaaattcctttccacagtaagataacatttataactaaaggcaaacaatccattaatagcaaaaatggtacccacttcactggcagttcttaccattatggtttggtcaaccattcaatgccacttgcaaaaaattattatttttttctgaaaagttaaatatcatagcttacattcacacaaaccaaatacataaatacctatccgtaagaaccaaacggtcgaaatttcctcgcttctttctgctagtcccgaactctcaggagagatcttcaccaaagaaacttgcgtccattggaggtaaaatcttggctaggctcgccccctagccacttggctgaggaaataagtgctgggttacgtgatagagagacacacatacattggaacagtgacatatacatgcagtttaaggaggttcactgggaacagagcaaaactattagaagatatggtatcaatatttccttctgaactttataccctcaaggaaataacatacatgaagacacttccatgtttctcttgcatggaccaaacagtagtttggccaaataagtaatgggagcactttctgctatgcttttaacataaaggattcaatgaggatgctgtcaacgtgtaactgtcagataataaatgaatgagttagtgaactttacttaaaacactcaggtttagggtttcaaaaacaaatgtagagaaacaaacaaaagtctgcttatttttttaatgctgacttttgtaatgggaaccaaaaatattaatgtagaccaaaaaagacatttacaggaaaaaggcccaaaattccaaggtagtcaagttactgcatttcattaaatttcaaaattaattggattttgatgtaaacctccttaacttacaaatgtagattattattaaaaatattatacatgtacatgtgcggcgtttgctccccaccagttttggaagacctaactcaagtcttcaccacggggctgaa

SEQ ID NO: 840 - DNA, 2138 bp, Homo sapiens
tgaacaatgcaccagcctcgatcctagacaggcccgtggtgaacacattccttgatctttcccaatttattcatatgatactgggactggtgatacttgaaaatggatggctgaggtcaaatgggaggtacttgagaaagatatcaaagatctaaccattcagtctttcagggatggactaaaaaccggctagggaaatctcatatgtcaaaataaagatcacaagatcttaaatttggaaaggagaactttatttctgagaagagttgcaacccacagcctgggaagcagaccctctggctgagacagaaagtaggcactttgaaggaagaagggtgggagaggagttttatgctaaacaggttggctaaacatacatatttaataggttataggaggagctatgaatatttgtgaaaggggcttgctaggttgtgtggtaagcaaacattcatgttacatggtcccaagttcacttcagggtggagacttcacattaaaatgtaatacaattagtctgtgtaggtcaaaaggtgaaacttaggattgtttgagtgtggaaggtcaaggctgcagtgagctgtgattgtgccactgcagtatagtctgggcgacaaagcaagaccctatcaagaccttgtctcaaaaaaataggtgaataaataagattaaagaactgtaaaaacctaagaataaacatgcaaatgtgtgttttgtaaaattgttttcaactgacacataataattgtacatatttatgggtacagtgtgatatttccattgcatgtatacaatgtgtagtgatcaaatcagataattagcttatctattgcctcatttatcatttatttgtgctgagaacattcaaaatctgctcgtttagctatttgaaacatactataaattgttaattatagtcaccctgcagtgctatggaacactagactcattcctcctaactagctgtacttttgtatttgttttttatttatttttatttatttatttatttatttatttatttatttatttatttatttgagacagagtcttgctctgtcatcaggctggagtgcagtggcaccatctcggctcactgcaacctctacctcccaggttcaagcgattctcctgtctcagcctcccaagtagctgggactacaggtgtgcgccaccatgcccagctaatttttgtatatttatgtatttttagtacagatggggtttcaccacgttggccaggatggtctcattctcttgacctcgtgatctgcccgcctcggcctcccaaagtgctgggattacaggcgtgagccactgtgcctggccgactacttttgtattttttaatcaacctttggctatgcccccttctcctgacacttctcagccactactagccactattttactctctacttttataagatcaactttttaagcctccacatatgagtgagaacatacagtatttatctttctgtgcctgacttatttctcttaataacctccaaggttgtccatgttgctggtatgacataactttattccttttttttttttttaagacggagtttcactcttgttgcccaggctgtagtgcaatgatgcgatgtcggctcatggcaacctccacctcctggcaacctcagcctcccaggttcaagcaattctcctgcctcagcctccctagtagctgagattacaggcatgagccaccatgcctggctaattttgtatttttggtagacatggggtttctccatgttggtcaggctggtcttgaactcctgacctcaggtgatccacatgcctcggcctcccaaagtgctgggattacaggcatgagccaccgtgcccagcccagaactttattccttttttgtggctaaatagtattccattatgtgtatatacactgcatgttctttatccattcacttgttgatggagaattttatgctggagaatgttccatgtactgatgaaaagaaaatgtaatcttcagctattagatgaaagattctataaatgtctgttaggtccatttgatataaagaacagtttaaacctaatgtttccttgttgttttctgtgtaaatccctctgtcttcacgcggggcagaagggcgtgccaa

SEQ ID NO: 841 - DNA, 1608 bp, Homo sapiens
gctctaataaatttgcggccgctaatacgactcactatagggagaggatccgcggaattcctaacttccgagggaacacctatcaaacgtcaggaagccattaggagattattattggctgtacagaaacctaaagaggtagcagtcttacactgctggggtcatcggaaaggaaagggaaatagaagggaaccaccacgcagatattgaagccaaaagagccgcaaggcgggaccttccattagaaatgcttgtagaaggacccctagtatggggtaatcccctccgggaaaccaagccctagtactcagcaggagaaatacaatggagaacctcaggaggacataatttcctcccctcaggatggctagccaccaaagaagggaaaatacttttgcctgcagctaaccaatggaaattacttaaaacccttcaccccaccttccacttaggcattgatagcacccatcagatggccaaatcattatttactggaccaggccttttcaaaactatcaagcagatagtcagggcctgtgaattgtgccaatgaagtaatcccctacattacaggccatacattttaatccctgtatctttaacctccttgttaagtttgtctcttccagaactgaagctgtaaaactacaaatcgttcttcaaatagagcctcagatgcagtccatgactaagatccaccacagacccctggatcggcctgctagcccatgctccaaatgtgatgacattgaagacacccctcctgaggaaatctcaactgcacaacccctactatgccccagttcagcaggaagcagttcaagtggtcgtcggccaacctccccaacagcacttgggttttcctgttgagaggggggactgagagataggaccagctgaatttcctaggccgactaagaacccctaagcttagctgggaaggtgaccgcatccacctttaaacacggggcttgcaacttagctcacacccaccccgtcaggtagtaaagagagctcactaaaatgctaattaggctaaaataggaagtaaagaaatagccaatcatctatcacctgagagcacagggggagggacaatgatcgggatacaaacccaggcattcgagccggcaacggcaacggcaactccctttgggtcccctcccattttatgggagctctgttttcactctatgaaatcttccaactgcacactcttctgctctgtgtttgttacagctcgagctgagcttttgcttgccatccaccactgctgcttgctgccatcgcaggcccgccgctgacttccacccctctggatccggcagggtgtcggctgtgctcctgatctggcgaggcgcccattgccgcccccgatcgggctaaaggctcggcatcattcccgcacggctaagtgcccggttcttcctaatcgagctgaacactagtcactgggttccacggttctcttccgtgacccacggcttctaagagagctgtaacactcaccccatggcccaagattccattccttggaatccgtgaggccaagaaccccaggtcagagaagtcttcaccacggggctggaaggatccgaggctggccaa

SEQ ID NO: 842 - DNA, 3641 bp, Homo sapiens
tgaagacggaggccgaggcaggcggatcacgaggtcaggagatcaagaccatcctggctaacatggtgaaaccccatctctactaaaaatagaaaaatttagccaggcatggcagcgggcgcctgtactcccagctactcaggaggctgaggcaggagaatcgcttgaacctaggaggcagaggttgcagtgagccgagatcgtgccactgcactccagcctgggcgacagagcgagactccatctcaaaaagaaaagaaaagaaaaatgacaagaattggccatttaaaattgcaggtgactgccctggcatcagcgagtgtgcccttgccatgaagtccccagtcagtgcggttctcacagcatggttcaggggctcaccccagccccacgccatgcagtgcacatctgcacaggtctgctctgacggcacggcgtcccccaccgtagaccctgcatatgatgtggctccatgctagtcatccccttcccagcagccgatgctcaggtgggtagcagggcctgcaaagatttccactctgtaacatgtatcataattctcacctttcctcaatagcttcctttgctccaataagctttgcaatcaaggccaaagaaaatgatctgcttcccctggaaaaaaatcgtgttaagctagatgatgacagtgatgatgatgaagaaagcaaagaaagccaagaaagttctagtagtgctgcaaacactaacccagcagttgccccaccctgtgtaattgttgaggagaagaagcctcaacttacccaggaggagctagaagcaaagcaaggtttgttgatagcttttaaacttcttgaaagaaaggaaatacacaaatataagatttatctgctaagccaaaaaatctcgaggctgccaactagaatctgaagcctttggaaatcgacctatttgggagttgtgtaacatgtctgaggttttgaaacgttctcttttagaggaatgagctctgctcttcactgagcctcaaatgcagtgccgctggcagtttgttttcgaagaaactgagttggccgtcttagctctaatgcgccacagtggaatgcattaatggcagctcactttgcacttggctggcagccccagggtaaaaggctcagcctgtcttcccagctcaggaaccaaactaggagatgccctcttgtgaggctgcctacccacagaaccattgggcccttgaaggtggtgtgtccccagctggttttccggctgcggctcatcttcatgggccgcagtgtggccaccacacccaccccaacactgctggcagcatggggacagcatgtagtcttcccatcccgactccagaataaattctgctctgcattaaagcagtcaaataatggttgctgcattgtggttgttatctattctaactgattttcttaaattgcttttcctgtatacacacattcagatcaagcaacatttgaaagaggccaattttcaggccaggcgcggtagctcatgcctgtaatcccagcactttgggaggctaaggtgggtggatcacctgaggtcagaagttagaaaccagcctggccaacatggtgagaccccatctctactgaaaaaacaaaattagccgggcgtggtggcacacgcctgtaatcccagctacttgggaggctgaggcaggagaatcgcttgaacccgggaggcagaggttgcagtgagctgagatcacgccattgcactacagcctgggcaacaagagcaaaaactccgtctcaaagaaaaaaaaaaaaagccatttttcaaccacaatccaccatcaagaacttccattgtgctgtggtgttctccctaaacaaacttgtactcatgcctgtacatctgaatctgtccttcctgtgtgtaaactaaccaactgtcggatcatttggaataaaacacttatagagtattcattgcctggtgtgaatattttggatatatgctgagagccactctgaggttttcattattccagctttcgttagtgtagagtctcaccaaccttctaactctgaaagtaaaatgtccaaaaaagggcacgttataaactaattctctcaaaatttgatttgtccaatgtatgtacctattcagaaactttaactaactgcattgtatgacacttttgcaacctgtgaaaattaagatcagataaaatactgtttgctctaaacttctcttttttctttgtttattccttaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggtatagtaaaatcccacattggtatctgcggggctgtgtgatacatagaggcagggaggatgtgtctccctccagctgccctagtctctggcctgagtgagggatatgagctcccagctcttcctcccgacatggttgagtggcttttactctatagcagtgaatctaagagtttgccagcagtctcccccgtcagtgcacagtcacgccagcagcaaacactgcccgcgatttcaggggagcctctgcttcacggctgcccttatggggctggcaggagggcttggggagtgcctcccatgggtcctgctggggaaatgtggtggacacacttcactgaagccccgcctccgcagcagcaccagtattgcgctcacacgtggggcagaaatccttttgccacggtctgtatcaatgtcagcactttaattaaagagaaaaaggaagagggagttaagagaacagactccaggagtacatggctccttcctcagtggtgtgagcaggaatagggccttacatgggggtcatcacgtggctgccttacaagtctccctgccaaggagggggtgctcagaacagtgcctcagaccagaggccttcagtagacactggctcctgagtgccaaggggattgctcccttgtgtgtccgagaccagaggccttcagtagacactggctcctgtgccaaggggattgctcccatgcgtgtccgagaccagaggccttcagtagacactggctcctgtgccaaggggattgctcccatgcgtgtccgagaccagaggccttcagtagacactggctcctgtgccaaggggattgctcccatgcgtgtccgagaccagaggccttcagtagacactggctcctgtgccaaggggattgctcccatgcgtgtccgagaccagaggccttcaggaaacacatgccttccgcagcagcagcacagcaattaatcataatcagcaaaaactctacttttttttttgtcacatcaatttagaatcttttaagttcaattttagattctttatagtagttatgtctctgaattttattttgtatttaaactacaagaatatgcagaaattctttggggagtttaggagcattttggagacataactcttaaagtaagaaaaataatagagtaggacacatcctttgaggattaaaggagggttgtctttgtatcaataaactgtga

SEQ ID NO: 843 - DNA, 3007 bp, Homo sapiens
  misc_feature (1)...(3007): n = A,T,C or G
atgacgcccgcgcggatccttccgcggaaatatgaggacccactttcaccataactaatccgctctcaccataactaacccactcccaccataactaacccactccatcataactaaccactccatcgtaactaaccgactcccaccataacccactctcaccataactaatccactctcaccataactaacccactcccactataactaactcactggcatcataactaacccactcccaccataactaacccactccatcataactaacccactccatcagtagctaacccactccatcataactaacccactcccatcataactaacccactctcaccataactaacccactctcataactaacccacttccatcataactaacccactcccaccataactaatccactgtcactataactaattcactgccatcataactaactcactgccatcataactaacccactcccaccgtaactaacccactcctagcataactcacccactcccatcataactaactcactctcaccataactaacccactcccaccataacaaactcactctcaccataactaacccactcccataatagctaacccactctcatcataattaacccactcctaccataactaacccactaccatcataactaacccgctcccaccataactaacccactcccaccataactaacctactccatcataagtaacccactcccacaagaacgacatcaattcctttgtgagggtgcagccccaggacctaatcacctcttaaaggctccacctcttaacaccaagaggatggcaagtacattttcacatgagtttcagaggggacaaacattcaaaccgtagcatggagatttcctgcgaggagatgtttccctgcgcagtccaggtgttaatcccagccggtccctctccaggggcagtcaggggacacacccccggtgtcagcagtgtttctgtggtgcctgttccctcctgaggcctggggcaacaggaccatgagaggggtctggggcaactgacacagctccgtggggtcccccggattgctagagcctcgaggtctggagtcctcgtccctcgaccctcctggactcagaggcagcgtctggtgcaggttgatgcatgggctttagagtctgggaaacctgggattgagccccaggtgtccctggtgtcatgcagatgcatctgtgcccctggagggtgagtatgaaatgggacaaggcaacaggagacctagcccagtggggggcacttaataggcgggaatacatggcaggtgtcctcaggagagatgcagggaccagcaccagcctaccagtgtggggcgcagatggaccctctgctgccacatggcacatgacaactccaaccctcctggtgtctgacccagacccctgccagggatggagggtgggcatggcctgggcactgcatagggggagggtggcagcagtcacagcgcaggaggggaggctgggcagggctggagccccagggctctagtgtccaagggtaggagatgggcagcctgggagatggggaggtgaggaggggcagtcgagagagctgaggctctgagcccccagggcatgctccactggacttcgctcacaaagttcaaattcaaacataaggttattaaggatttcaagatccttgcagcccgactgcagggcctttgggcgtgcagggatccgctgaccatcagatgcatatgtgccagactcgagtgaaagacacacccaagtcatgacgtggtgattcccattctatagagcaggaaacacgcacgcgtgattcccattctacagagcaggaaacagacgggcgtgattctcattctacagagcagtaaacggacacatgtgattcccattctacagagcaggaaatggacacacgtgattcccattctacagagcaggaaatggacacacgtgattcccattctacagagcaggaaacggacacgcgtgattcccattctgcagaacaggaaacggacacgcgtgattcccattctgcagagcaggaaacggacacacgtgattcgcattctacagagcaggaaacggacacgccatgattcccattctacagagcaggtgacggacacgccatgattcccattctacagagcaggaaacgggcattctgtgattcccattctacagagcaggagaaagacatgccatgattcccattctacagagcaggaaacagacacgtgtgatttccattctgcagagcaggaaacggacgcgcgtgattaccattctacagagcaggaaacagacacgggtgattcccattctgcagcgcaggaaacagatgtgcgtgaattaccattctacagagcaggaaacggacacgcgtgattcccattctgcagagcaggaaatggacacgcgtgatccccattctacagagcaggaaacggacacacgtgattcccattctgcagagcaggaaacggacacgcgtgattcccattctgcagagcaggaaacggacatgcgtgattcccattctacagagcaggaaacagacacgccgtgattcccaatccgcagagcagaaaacggacacatgtgattcacattctactgagcaggaaacggacacacgtgattcccattctacagagcaggaaacggacacacgtgattcccattctacagagcaggaaacagacacacgtgattcccattctacagagcaggaaacagacacgcatgattttcattctacagagcaggaaacggacacacgtgattcacattctacagagcaggaaacggacacatgtgattcccattctacagagcaggaaacggacacacgtgattcccattctacagagcaggaaacagacacgcatgattttcattctacagagcaggaaacggacacgcgtgattcccattctacgtcttcantctgatgctggaaggagcgcgtcaagttttctaat

SEQ ID NO: 844 - DNA, 2428 bp, Homo sapiens
  misc_feature (1)...(2428): n = A,T,C or G
ctttccttgcgggccatatattgaagacacagcagtaagtattatggacatgtcaattcacaatttcccataactgtttccaagtttttttttaattttaaaaaacaaacatgccctacaacgaacatccatgtatagacatcttggtaaaacacgtttctaggagtagaaggtcattttcatttaaaactcagtccatattactgggttctatcgacttacactcaaaaacagtattcctactgcccacagcctctgtctcattgttactttttttaaactttatcaatttgagaggcaaaaaataaaaacttgttaatgaggctacattgaaaaaatatatttactagccatcgatttttctttttggaaccatattttcatgtcctttgtctatttctctaggtcagtgactgtctttttgtattgatttataaaagctctttctatagtgaggatgttaacctttatttttatgtattagcagttactgccatttctgtatttgtcttttaactttattcaggccatgcccccattagacctaccaatctttccctatgatttacagcttcagttcttaagacacttctttccagctccaagattattttaaaaggaaaattacctttatatttttctacttttctagttttatgttttacatttaaatactggatttatatggaattatggttgtcaaatatgtgatatcttattatttttcaaaatggagagcctgtttttccaacattaattagtgttatactaaagaagtttcatcatcaacatctgagagaatgttgctgctttctcggcatctgagaaagccactcatctgttaatatgtaaactatactagaaggtcttctcattttgtgacatgctgggattcctggaacaatcctacttgctcatcatctattactattttcttttttcttttttttttttttgagacggagtctcgctctgtcacccaggctggagtacagtggcgcagtctcggttcactgcaagctccgcctcccgggttcacgccattctcctgcctcagcctctccgagtagctgggactacaggcgcccgccaccacgcccgggtaattttttttgtatttttagtagagacgaggtttcaccatgttgaccccagactgatctcgaactcctggcctcaagcgatccacccgccttggcctcccaaagtgttcggattacaggtatgagccaccacgtccagccaagaaatcctattaaagctaaggaatgaccacagatccttcggccataactggctgaagtgaggagccaggaggcagccccgactctgaagagctgtggaaaggctgtgagacggcgtcccggggggctgctgggggttcccaccttgcctgaaaatgttcgtttctggggctggcatgtcaaatggctcagaggagctgaggctacagcgggtggccagagcactcgggactcagggcaggagcccaccctgcggcactcggggactcgacagggtctcacacaaactcatcttctctgctcttctaattctcccctccttgcccgtcagttattatttctgaggcctcctgccagatgtgagaggatttcagactgactcccaaaacaagaaagctgattcagccttcagcatcatttgaaaagtctgagcttagaatgttgttttccacagaaaaataagcgaagtgacttcaagcagaaaatcagttttcaataatggccctggactcttagaaacgtcaatataattaaagtgaaaggctcattctgtactttgggaaaaaaagatctacaaaagacacgtggggccacttggagcaacgtggctgcggcctgcagaggaagtgatggacaccatcggtggacaatctgcatgcagtgctgtgtttcccaggagaaggcccttcatgggaaatgcagctgcagtattcagggcagagcagtcaccacatatgcaacgactctcagagagggcgagcacgcgtgggtcaacgtgcgcacatatagatgagcgagcacgcgcatgcaatcgcctggggtgctgggggcatcttcccattctttccaattttttgaaggtttgaaacttttcaaaaagtaaaattcccggagttactaccttttttattctttccaacttttatttctttcatcacccaggcagtgagcatagtagctaacagggaggtttttgatcttcaccctcctccctccctccctccaccctcaatgaagccctcgagtctgctgttctattctctgtgtccatgtgtgctcaatgtttagctcccacttataagcgagaacatgtggtgtctgattttctgttcctgtgttcattcatttttttaaagagagagattaggntgtcttcccatctggcgaaaggaacgcacggtcaa

SEQ ID NO: 845 - DNA, 2420 bp, Homo sapiens
gtgcacgtcctttcaccccgtggtgaagactggtgtgacaagtaatgttttcctaaatacccaagtgccacagattgggaatgttttactttttaatacataaaaggtcattagagtaattgacggtaggtgacttcacccttgctacattcagacgcgctgtgtcaccagataggagggtctggggtcacagctggcaggacaaatgcccagctcagctgtccacagtcaggagagggcaaacagctgggggcagttctctgtggagcatcagaaaccctgatgccaatcagcagatgcccgggaatgtgttggctcacatagtgaagaaatctaggttattctagctggtttcaggtatggctgtgttctggcctctagagacatctccaggacgttctctctctctctcactccatctctctctctctgtctctcccctgctctctttctctctcctggtctctctctctctctctctcttcccggctctctcctgctctcttttttcctatttctcccctgctctcacctctctccttctctctttcccctgctctctcctctctcctctctctttctctggctctctctctctctccgccgtgctctctcctgctctctctctctctggctctcagctcttccctcctgtgctgcttccatctcaggccccacatgctgtcccctgggagccccggaatcccctctggctgtgaccccatcaatgctgcagcacctcccagctcacttgtgcttaagaaagagcacagtccttccccagtagcttctgcagtggtcctgatcttgctccgatgggccctgatgaggtcatgtgacccataccccacagagtgctgtcctagggaggatgtctgtttactatgtgggccccatcacgtgatttacgtgtacaaaaaggcgagggccccacctggcccaaagggacagaatgtggggaggggcagcccacagggagagccaagagcaccaggggaggcaggggaggggctggggaggagcctcgtgtccgggtggtgagtccttcacagcagagccgtccatcctggtgttcaggggctgccgtctctattcactccccggtggaacctttctgggcttgtcgagtccgcatcagcccccaggagtgtgtctgctgcacacttgaccggcatccgtcatgcacatgcagcagaagaagggctgaaagccctggtctgtttcacacctgagtgaaaaattaagccttttcatccgtgaggactttagtcctagagtaacgacccgggccgctggactcccgagggggcttccgtctgctccatcactcaggaccccaatcccagagctgagacggggcaggccctgatttttcctgcagtgcgtctaccgcaatttattgcccaggattaatgctgaggctgttttcctgcttgtgactgagagcgtgcagacagaccaagacggagaggttttcccgacatcgaccagggcggctctgctcccagcatcgcgaacggtggcacctgcgtctggaagagaagctctgcaggctgggattcagggaagggggcgctggagcttcctgggagaggcgggcaggactccccaacctgggaacagtcagaggcaagagctcaactccaggtcgggcaggccggcgcctggattccacactcacaaccgtgcggctcaggcctcagtttacccacctgtaaaatgcagataactgtcgtattgacacgatcgccttgtgagggcaaatgaggcagtcctgtgaagatggcgtggacgcatcacggctgtcgatcatgagtaatattgatataatacaaccacgtagggttgggtactgttgttaatgccactgaggatgtttttattgattattttgaagccccgctgtgaatctacccttttacctgatcctaaatctctcctgctgctgcaaagctaccctgagacacacccaggaggtggattctgggttctggagccccgtcacccggccaggtcaagggacggagctgaaggtcaggcacccctgcgtcccctccctacgctcccgcccctcagcccacgtcccacagtccagaccccgcacctccccctcccctttcctttttcctcccatgagacccatctctcctgcccctccctggcctccaccccgtgctcagggttcaacactgtcctccgaatccctccacgtttccctccttcctccctgggccccccatcatccccagcagacaccctttagccggcaccccaccttctggtcctggctgcccgcgtcccggaggaccccggttcctggacccccacgatacatgtcctcccgcttttttccttttattggccccttccaggaaccccctttcccagtgtcttttttggcttccgctttttcccaacag

SEQ ID NO: 846 - DNA, 2278 bp, Homo sapiens
  misc_feature (1)...(2278): n = A,T,C or G
gtgcgcggatcctttcggccgcgtggtgaaatagagggttaatgaatacatagaaatggaaaaataattgattatttgtgaaagaggtagtttgcttgggtggaggaatcttgatagttatgcccaggtggtttacaattcaaagatgaaaatcagttatctaggaattgactaccttatgtagtgtcatgctgtcaggaatccacagaaatagttggagagaaatcttagcgataccaattaaatacatacatacctgaaagagcagcggaggggaaaaggaacatggattgagcacctgctaagtgtggaggattatggtagagatgttcacatgggctatctcacctaagccccacttggccctgggagtggatgtgatgacttcacaaccagtgaggaaacagagaacagcagaatcccggagctaacaagcggcagggcaggagtttaactacagttaacccttgaacaacacaggtttgaattgcgtaggtccgcttgtatgaggatttttttcagccaaacactgatcagattgagggatgtgagacccgcatatatggagggtcagcttctttatatatgtgggttcaaatggaccaaatgcagaattcgagcacgtgtggatattggtgtctgcaagggtcctagaaccagtcccctgcgtataccaagggaataccgtgcagtctgaccctatacacactccttctgctgcaccccacctccccccaccaccccacctcatttggaattttgtaaagtgagtttcacttgcgttgtgggtagaagagaaagctgaagatggcttctaggagtaacaacagaaggtaaagaagcagggacagccagtcacatgcttccatcttgctgcctgctgttagcaggtgccttcctccctgcattgttctgaattttttaattttctttttatgcagaaaaaaatgaggccgaaaatttagaggaaaatgaagagcccttcgttgcccccttaggattgagcgtcccgtctgacgtggagttggtatgtgtcctgcatgagcactagttgtcgtcattattatttatcataattcactcctgcttgtgggaaagctcaataatgattatagctgctttttaggcatataatgctttaaaatggtttgtgagttaatggagaaaaagatcacaccctatttattttccccaaaggaaaagggaagaattatagcaaaagagctagactggagcatcagggacttgaggagttgggtgtgattcagcggccatgtagttgaatccccagattttactagcttagaaaaactaaatcaggatcagtggcgagtgggctgctccccacacatagatgtaaaagcactcaagatcaagacagcgttgatttcagtaacgttgctttgttctggctttttaaagtgtgatttttggggtcacttcacgttacattttcttagcagttttctgtgttgtgataggtccctgtggcatctccaggcccaggccacccttccactgatgaaggggaattccaccctggttttcctcatctgagggctttgcaactggttactgtctgttcagcattgacctttcctgctatttcagttatatcacattaaattaagttataacaggtgttaaagcccaaaccaggatttttcctttttttctgaatattcattgagggatttccccattccagtcactgtgctaagctgttttttacatattatcttatttaatgctaacaaccctataagcgaactactgtttactatccctcttgtgccagtgaagaaactgagacttaggaaagtcaagaatttggctaataaatagcaactgggaacgttggtcttaactatgatgccatcttcagtcaccgtgctttatgggatttttatatgtttactgggaaggttgaaaatctttttgttgtgtgtgtatacttgggaaggactcttaagtgttcgtgcctagcaggaagttttttcttggacattttcgtaactggattgcaagtggcatcgatgcaggcattctcaattcttgtttgtgtcccacatcctgaatcactcactgcatggtagatgccgggaaagctccgcacagagagagcatctctcacctcccactgcgatcactcgctgccactctaattgagttcagcgtgaatttgatggttcttacccttcattaatctgatgaaggggcatataaaaattagcccttttaattactgcccttncccaaaaaaccccggggcccctct

SEQ ID NO: 847 - DNA, 2899 bp, Homo sapiens
  misc_feature (1)...(2899): n = A,T,C or G
atgacgccagcgctgatccttccagccccgtggtgaagaccctactacacaatgagatttaaaaaatacagtcaacatataaatatgcatatgttacaatggcctaagaaaaggaaaactgtttttctaatttaaatccagtggggaagccttttgtttaaggaagccgacagagccccggaagggggctaacacctcctccccttccctggaaattccattaatgtgaatttaagctccagaggaggcatgggaaacaggagaaaggtatctacaggtcagaaaacccacacaaatgcacggtttcctaagagctttggaaaaggcttgagctcagacccatcgggggaccaggaaggaggtggcatgacatgaagaggggaaattagcaaggaaccccaggggcagtggggccagccctctcctcacggggttaggggagaaaaaaaatcaaatacctgctttgcccagagccctaagtaagtatcagattgagtcaaaattcaaaggcaaaaatacaaatacagaagtaccagcagtaaatataggaaaatattttcaaactcttgtgggtgggaagccttccaaaataagctttaaaattctgaagccataaggaatagagggacatatatcactctatacttaaattctgcacagagagtcgtacaatcacttagaaaacaaagtgcggggagaaaatacctgcaagacacattggggaccaagagttaaggctcattagacgtcaagagtccttacgaatctgaacaaaaggccagtcactccacagtaattcaagaataaatcaacattttttccctccccacccaccttctgtgacaatacagtacctaaattatgatgaaataatgctctaatctgcacaaattcgataaagcttaactttagtggttcagagctctggagtcggtcccttggctagaaccccaggcctgaccctcacacatgtaacttagggcagttactcttaactttctaaactttaacatctggcaacaactgtatttgcttcatagagttatttttgtatttttatttttttgagacaggatctggctctgttgtctaggctggagtgcagcagtaccgtattagctcactacaacctccacctccagggctcaaaccatcctcccgccttggcctcctgagtagctgagactacaggcatgtaccaccacgcctggctaatttttttcattttttgtagaggcggagtttcaccatgttgcccaggctggtcttgaactcctgggctcaagcgattctcccacctcggcctcccaaagtgctgggatcacagacatgagccgctgcacctggcctgtaaaattattttgagtattaactgagagatatgcctagagaagcacttagtacactgtctggtacacagtaagtgcttcataaaggctggttctatgttattattcatcaacagaataagcgttgcacacaacagcaactatcgaatccttccccactttccataaaatgtgttcgagcaagcacatttcccttggaactgcgccctaacaggtctgggactacaggcacgtgccaccacactggcctattatttttacttgtttgtagagacaggatctcactatgttgcccaggctagtcttgaactcctggcctcaagtgatcctccaaccttagtctcccaaagagctgggattacaggtgtgagccactgtacccagcctggggtgctgtaatttctaactacttcttactcttcatccaaaagcctcaaggatcctgtcatcattaggttctaaaccaacagttagtttaaaaaccaagaacctcctgaagctacctgctgtctttcccaatcactccaatcttctcttgtcagtgagtcaaaccatgtcctgcccccttaagcagcaatagtctacttaaccacaattcaacaattctgaggcctagtcactaaaacaacttataatgcagacacttctgtcttctacattttctccactaacatggacaccacggtgtataatttacacaatgaattactgccaaaaaacacataataattatgagaatgaaatactgacactgccataaaataaatgaaagacgcaaatgagagactcaatcaagcactcagtttccacaaagtcaaaacaacattcaagaggcctttctataatatcattagaagaaactctaatgataagacagcaagttgctacacactaagacttactttgctctccaatgagtgacaagtatgtttgatctggcagactatcaagagcttagtgatgcttattttggctgagaacacaaagccattaaatattttaataggaattaaggcaacacaattccattgtacctctatatttaaatttgaataaaaaattaaaaaatttttaacactaaaaacaagtaaaattccatatagtcaacttcatataaactttttagcattaaatagagatggagcacttagcatttaataaaaatggagcaactgtgattntttaaagcttcatgttaatgtgtctctcatgcataataaacatatttcagaacaaataggaatacaatatatataatacatggaaaatatattaatacaagtctcaggatatcaaatctttgggtaatttcagctttaactacagcanaatgatcaatactaggaatggagaaacaaacatatgtagtaatatagtttggatcaagtttggatctgtgtccccagccaaatcttctgtagaattggcatttccaaatgttggaagcaattgcctggttgggaagtgaatgaaatcatggggtggaaccttcatgaatagtttnggaccattttctttggggctgtgtcccggggataaccatggaatgg

SEQ ID NO: 848 - DNA, 2017 bp, Homo sapiens
ccatcactaacccagcctaagagcaataaacccatctgccctggcctggagaatgtgtgggttactatgcacctgtcgccatggcaccagcacctgtgacttcaggtcggatgagcgtctggagaagagcgagcagcgtcaaatggtcggggcccagggtgcctgcggaggtcagcctctgcccagttctctgcagggaaatctgtggggccgtcctgggccccacggagctcacagtcgccctggggagagggaggaggggcccaggaggtcttctcatctgggacagtcctggaagaggccctttagggactcgcatggtaagtttagtccagaaacggggcacccagcagccaggctgagccaggacctgagaaaagagacagctgtccctagaagtcctgccctgcggctgctccatccaccagccaagtggagcatcctggacccactcacagggagctctgctcttcatgactttaatgcaacctgtcaccgtcatggtgggtgatcactaatagagcatagcaaggcagggagactatagggcggggaatttctgcagaagacattggaaccaggaatgtacacagataccatgaatgtgaattgtagcttcaaagggaaggcacaggcagcccagcaacagcagcggccgatgggagcttgcggcgagcccatctctcctccaagtggtgagagaccccagaggagaggcccagggtgtcagccccccggaacagagagaaagatgcctgcgtggacgggtccccagaggtgtggacagcagggtccccacagtgaccgcggcaggacaagctcgggttcaatctcctcaaggaaagctttaagctcatcctcaccttctgagcaggtgcaagccggtcccagggatgctttgttccgttccctgctctccaggggaggcgggtggggaagggaggaagacagaggcctctccctcctccctacacagcctcagaccttccagccagaagcagcgctggactggcgtccaatgatgatgatgacaaagctaataattattagcattatgaattaatagacagggaggcagtgaagtacaggtgctggggggctacagcacaaagtccaggagagtccatcctggccccgcccctgagcccgggtgaccttgggccaatcccccaaggtcagcccttccaatgggttccatcacctctaaattgcacctcccaggagagcacaaaatgagaaaaagcgcttaaaaccctgagcatggatggctcctgagatagccagtgggtcgggggctccatccagcctgggatgctccatgtagtccatatggcatcctgtgaaattctgagtctgttgccaatagttcaaagttgggatgtttcaggtaaaacctggatttccacctcatcctggagaaccagaagtcccggcagccctgggtgcacccggccacagtctgctgtcagagtcaaggctgggggctgctccccagtgacccagctcccacaagctggactggcagccacatccacccagccccattggtgctgtgaccctgatgtgacctgggcctctgccaccgaggccctgagcccccctcccccagcgagaggcctacggcctctggaataagctcagtggggagcggcctgctgtggggacgcctctcaccacaggttccccctgagttttaaacaaaatgcacatgtgcacacacgcacacactgaaacacacatctgcacaaacctgcacacagctacacacccacacggatgtacaccacacacatgccatgcacacacatagacacacgtgcactcacactcacacatcccagacatgtgcgcacacttatgcacacatgctcaatgcacctgcacagagcaatgtacacacatatacatacactcatatccacacaccccatgtacatgtgtgcacatgcatgcttaagtacacccaaacatagcacatgtgtacacatatacacacatctctacatcccacgtcttc

SEQ ID NO: 849 - DNA, 3366 bp, Homo sapiens
  misc_feature (1)...(3366): n = A,T,C or G
ctttcagcccggcgtgaatgactttggtcaataaagaaagcctaaactgggccagtatcatattttcctttaagggtcattactatgaagtgatcattaattattgatgtgtgtatggaatattctgtgttaacactgaatatccacagcccctgtgaatacacgtcgcggacatgcatacagtgggcctttaacatggaatttaaattatttggggattaatgaataattgtagacatctatcctttttaagtgtgaaggatgttattagttcaaaaattaaattagagaattaagccatttatattttatgaaggatgaagccctgaattcttaaccatccatttttaatgagaataattgccagatttatttgcaaataatttcctagtgttaatctctttgttgatatgaaaggtattttagatgtgtggctttcagcctttggtctaacaagatccatttgtgggcaggaaatgctaagagcatgaggttcgttgaagtgactccttagcagcacatgaagggatgggggagggctttgatgctgggaagaaactcacctggagtgtcccatctgctctggccagaccacacctaggtggtcttcagcttgggatactgcttttaagtgggaatggcagtgagccaggaactgtgcaggggctggggagcagggctcaggtgcagaagaaaagacatggcgtactcttgtggcttttgttggatgtccagaagggctgttttgtaagagggagcctccaagctgtgaaacctagtccccgctaagaagaaagaaagagcagtgattctggttattgagaaccatggaatgtataccctctccctagaaaagtgcttgtttgtaaaattcacatgcacagaggattcacaaaccccctgaattccatcatagagctgaacttaaatatatagaaaaatgttgacttggtgcacaaagaagtcacctcccatgggtctgtaccatggtggagtggcctgcctcagctggcgagctttctcccctgcaaaatcctgtcaagatttggagatgaggagtccgaacagcctgggctcttccagcttaaagtctcgtatctcttaaaattgacagtaaaaccagagtcatttctatgttttaatgaaatcacgtggccggtggacaagaggacaaatgggtgacgtgaatatgtgtgttttcccgtagccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaagtaggtcccactgcgtctgttccgtccagactttgggcctgtgttgtgggggcggcaggctgggtggttctgggaaaagtgtgaagatacacattcttacagatgcatggttgaaagccagactcgaatttctagaatgtgtctgaaatcctgcagctaaggcgtgatcgttacccctgctggtgcacctttattaaatctttggttaatattttatagataaatgaaatataactaaatattgatgctgtcagaacataatcatctgggtgggaaatttttgccctcattttgcccacttaacatttcatagagaaaacagttatatatcctctcttggattattcaagtaccacagtgttcagggctgtatagctcaattatacatggccacaaaagtgaaaattttacttggattatctattttaagctattatttttataacagtgtctctattttggagttcttactgccaaagccagttagctgtattttgaataaagatggtattttgacaagtctattcatatatatgtatatatatacacacacacacacatcttccattgaatttttttttttttaattggcgacagagtctcgctcttgtcgcccaggctggagtgcaatggcgtgagcgcgatcttggcttactgcaacctccgcctcccgggttcaagcaattctcatgcctcagcctcccgagtagctgggatcgtgggcacgtgccaccacgcccggctaatttttgtatttttagtagagacaaggtttcaccatgttggccaggctggtctcaaactcctgacctcaggtgatccacccgcctcggcctcccagagtgctgggattacaggcgtgagccactgtgcccggcccttccactgaattctgttctcttcagccaaaataagtttcaaatcagttgtgtaaatcttaatgcagatctcatcttcagttttgttgtagttgtttatttctgttgctattattttgcttttcataaatcagtacaatttttgcccttttttaaaaaaaggaaaaaaaaggcagagagaaagaaagcatacagagccccagaccagctggtgctcgatgctggcaaggagtcaccaaatgggcaaaggtcgcaatcctttttatctggccttcttctggacaacttgggtgactctagggagaaatttctaaaagtgttttttcgacagataaccaagataacttggctgcttctaagtttttgcataattaatttgtactttttttctcaccaaacaccaaaatcttgaaatgtgattttgatttcagaatcaggagtcagctctgacaatgaagatgatgatgatgaagaagatgggaattaccttcatccctctctctttgcctccaagaagtgtaaccgccttgaagagctgatgaaggtttttatctcattgttgaactatatttttatgccaccacaaaacttctgctaatgtaattttggaaaatttgaagcatgtcattcttgtgtgttacagntgtatcttattttatcatcattgaggtgtatttgcattttttgttttagctgggtgacaaagcatctgcttctttggtttcttacctgtctagcttataaaattcgtgagcatttgctcaagataattntaccattttattacaattttactcctttgagatatttagagttccaagtagagtgttgggtaagactttgaaaattgttttgttgtgcgggtgtggtggcttaacacaatgtaatctaacactttgggaaggctgaggccagtggatcacctgacattcggaattcaaaaacccactgggccacattgccgaaaaccctttacctactaaaaatcaaaaatttacccagcctgggtggtacccctgtaattcaccttcctcgggaggcttaggcaccaaaaa

SEQ ID NO: 850 - DNA, 4196 bp, Homo sapiens
  misc_feature (1)...(4196): n = A,T,C or G
aaattttaaaagaatgccggtgttcttcctaaaggttgggaaaattcccataaagtctctggttcggggcttttctcttggaaggttttgattaatatccaatttcctaccagttataggttggttcagatttttatttcttcatggttctgtcttggtaggttggatgtttctggaaatttatctattttttttccaggttatccaatttgttggcatataattgttcatgctagtttcttatgatcctttttatttctgtagcatcagttgtaacatgtcctcttttattcctgacttttgttatttgaatattttttctttttttagtctaataaatgtttttgattttattgatcttttcaaaaaacagcttagtcttttttttctattgtttttctattctctattttattttggcactgatctttattatttcttttttatgttaactttggattcaatttgctttttgtctagttctgtgaggtgtaaagttaggttgtcgattcgaggtattttttttctctttttaaggttggcatttaccatggtaagcatccctctagtactgcttttgcttagtactgtatgtttttacctaatgtataactttggtatgttgtgtttttattttcatttgcctcaaggtattttctagttcctttgtgtttcttcttttacccattgattattcaagaatgtggtttattttccacatatttgtaggattttccaattttccttttgctgttaacttctagtttcatcccgttgttggaaaagatactaagcatcatttcagtcttcttaaatttattatgatttattttgtggcctaacatatgatctttcctggagaatgttccatgtgtgcttaggaagaatgtgtgttctgctgttgctggagagtgtcctgtgtgtgtccgtcaggcccaattgatctatgctgttgctcaagtcttctctcaccctgtttttctgtctggctgatctatccattattggaaatggggtattcagacctcctgctgcatttctgtgcgtttctcccttcagttccgtcagtttgttttacatattagtgtgctttgtcaataggtccatatgtgtttatcattgctatatcttcccagtaaatttatcttttcatcattgtatgaagtcctttttgtctcctgtgacagtttttgacttgtctattttgtctgacatgagtgtggccacctctgctctcttttgtttaccatttgcatggagtatctttttccatcctctcattttgaacctgtgtatgtccttatatctaaagtgatatggaggtagagagtggaaagacggaaaacagagactgggaagggtgagtggggataggggaaggatgaagaaaagttggttgaagggtacaaaaaacagtaagatagaaaaaataaattcaatatttgatagcagagtagggtgaacatagttaacaaaagtatattgtacttgggtggtgaacaccctataccctgacttgatcactatgcattatatatgtataacaacatttcacatgtgccctatgaatttgtacaaataaaaaaatataaagtgtcttgtagatagcatatagctgcatcttattatccattcagtcactccatgtcttttgattggggagtttcacccatttatgtttaagttaatgactgatgggacggacttactgttgctattttgttgttttgtgtttgtcttataattatttgttcctcttttcctctcttgctgcctttctttgtgtttctttgtttttgttttttgttttttgtattgagctgctttgatttctttctcattttcttttctgcatcttctacaagtattttcttttggaagggtctgatcttatttgctactcaaaaaatcttacttttgtctggatgcagacttagaagtagaagctcaccgctggagggtctgcatttcctggcagtctgttcctgatgtttttctttggcctctttcattctcatggccagcgtgtagcctactctgcagcctctgctttatttttcgtagtgcactgttttcttcagagcaagatgccagcatttgtgttgcaggacacgtggagtaacaagacactgagtcttgggtgctttggtcctcagtttcttacattctttgtttaagggctttcaacatatttccagacatcatcttctttagagacatagaaaagtctgcggattctgctagctcttctgggccccaggcagcgaggcgccatagtatcagtcagtccaggaatatccttctctcctactttttttttttttttttttaacaataaccaagttgaggacgctgagattggcatccacaatatgcaacggcgaacaggttttcactgtctttctccagttctccttggtctatggcaggaatgccgcttactcggtagcaggtggacatggccatgggtcgggtcaccctgcttcatgggaaggcttgtttgtctttcccaccactgatccagaccacagaacccttccatgcttcacgagagcatcagcagcaacttctgtggccacaggcatctcatacaaactacgaagtttgcgttcatcgtccacttcaatgagcttttggcagctagcggctgggaagatgttcagcttcatcttgaagcagctcttctgttggtattttctttgtggttactatggggactgcataaaacatctcataacaatcgaccttaagctggtaacaactccaactgcatgcaaaacctctatcctttctacaaccccccgctttatgtcctcagtgtcacagattacaccttcttacacttggtatcaattcgcagaactttgtagctgcctcagaaaggcttctgggccttgctgttgtgagttggtgtttctgccgggagggagttctgggcttcctgttccgcttttgtgctctcctctctagaggtctaaacactcagccagcataatgtgacaaccccggactctctgtgcttccatcctgccctggagcaacctcctgagaaagtgcccagaaagagtgacctggcgggcctgagacggtggtcctgggaaaggcctgctggtgagggtgcccttggctggtgtcttggaatctggctgcagcagttccctgtggagacacacaacctccctcaatagcgaggagctcctgtgtctaaactcctgtggaaaccacgtggtatcctgagcccgtttccttctggggtcctggaatgtctgtgcgcgccaagcagaggtgcccccgtgaccagccccctagtcgctgggcgctgagtctccgtgggcttccctggtgggcgacgtctcactgtgccgtcacgtcactttgctggaggaactaagcacagccattgtggctccacagggagaggacagggatgcttgtgcctggtgccctggacttggccacccaggccctggctgtgctcacccttcccggcccctgcagccccggatggcagtggcttcctgctgatgcctaactcagggtcaccgccccaccatttcttctgcagctcctccagcccctctgtggcgagttccatgattaagtggcccccatggcactccctgggtggctctggcttcctggctgccctggcccactcataggacccttttctaccaagcatggcctcctgggagcctcacaccccaggacacagaagggactggggcccagcaggtgggttgctgaccctggagacagagtgtccactttgctcatggccagaagtcatttcattatctctaagaagcagacgggctgctcctcctgtgtctataatttcatttaccttcacacacacacagaatntcaatgtgacttnctacctncaactcagcaaggaggacacggatgcttaaattggaaacggctgctgcaaacgcaacctgagtgtgaggtcaagggctgtgcanacggacaggcagacagacagattgagagatggacaacaaatggatagattgacaggccgacacacgatgggcaggacggacacccggaccggccgatttggcgaccgatgacggacggacccccttgcccaggcggacggacggaccgttgattgggagaccccgaaacccacaggccggacacagtcgggcgaacttggtggattttcccccgtcgcccttaag

SEQ ID NO: 851 - DNA, 2010 bp, Homo sapiens
ttcgccagtgcggatccttccgccccgggggaagacgccactgcactccagccagcgcaatgggagtgagaccctatctcaaataaaaataaaaaagaaaaagaaaaaaagcagcaaatctcggtagtgggcatttccctgggtttggtctggtgctgtcacagcattaaagtgacagcaacttggtagctgaattatgtgcactaagccacagcaaggaagtggacgcccgctctgagacagggacacgggctggctgtaggattaatataatgattgctaataaaacatattctgtaccaggcacgggagctcatgtctgcaatcccagtacttttggaggttgaggcaggttgatcactcgaggccaggagcttgagagcagccagccaggcatggtggtgacagcctgtggccccagcaactcaggaggctgaggtgggaggatggcttgagcccaggaggtagaagctgcagtgagctgtgattacgccactgcactccagcctgggaaacagggtgagaccctgtctcaaaaaaaaaaaacgcccccaaaagaaaacaaaaccaaacccatattctggatttatagactaactgggggcttgtaattaagaatacaaaattaaccagtaattacacacgtattcacctctattgagttcctagtgaatcacagtttaacactccgcagactttggtttgcaggtttaattccgtctgtctgggcacggcagctcagggctcagcactgcactgagtctaaccctttgcttctcttgtgtgacctgttagtgctcggtgagaatgtcagcaggtcacgcgagtctggcgtctgagtgtgctggctggccatcaggacgctgctacttccagatacaatcactacttgctcacacgaggtctctcttaaagcaaaggttaatgtgaaggcaaagcaaggcctcttctgttgagacggaattaatttctaaccatgcccttcacatataccaaaggtgatggtgaatttctgatgtgaaattacttgtttaagggatggattctaacattttaattttcatcagattgtatgagagcagacatgaatgctcagtgtaggattactaaggaacaaaatgtaatttataaacagagccaggtgtacatgaaacattgctggtatctatccgctttatagttcctttgctaatttttctgttttaagaaaaaaatcacatcttgtcaacggagggaaccgtggtactaggccaaccgcagcacggtcttcttgcccagggtgctgtggggaggacctgctgtggctctctgcctagtgtgtgccttgtggctaggcagtgtgggtgatggctgggaccatccgtcccaggagcaggagggtcccagtgtgtgggtgaccctggcaatgtaaggctcgtcctctggaaggctctgggaccctgagtgtcctgacccccatgcacttagcagtgccgtgttatgaagctcaaggctacgatgtgcaatgctccatccttctctgtgtagctccagacgcagacacggtccacccacacagccaggaggctgcacgaactccacatggggacacaaaacaagctccttgtgcttggaaagagtggaaatgcacggctgccccacgcaaggcactgggtggtgacatcagtgggtgagaaccagaggaggcgctcgtgagatggcacccccacggccgagagggtagtgctcactggcggcaccaatggaggtggccgtccacagctactggaagccgggtgagcggacagatggtggacctatttgcctgaagtgaaaggtggaacctctactgagtgccaggcactgagtgaggggtgagcccgtggcaccctgggctgtcagaggccctgccaggcaccacggctggggcttctacttgatgaacatgaatgctaacctccctccatctcctgctccaaccaagacaggctctccttagtggtcaagaggtaagcgatggagtcttcacca

SEQ ID NO: 852 - DNA, 4375 bp, Homo sapiens
  misc_feature (1)...(4375): n = A,T,C or G
tgacgcgcttcttccgcccctggtgaaaatggtgggagcagacaacatttctgaaggttgcaatttttgttttttagcaaaaattcctttctaaaatgtatgagcccgagcaacacattcatttttgtgatacggagtgaaatcaggcatgaatttttcacgtttcttttctcattcattgggcgttaggtgtaccactcctcggcttgtcaaaatgttttaatttgtggatttgttttttaaaagtgtacgattggcagggaagtggaggagggtttccctcctgagaacacccaccacgtagacaggaggccccagtgccagctcgggacttgggggtgggaagtatttaactgggatggggaatcccctgcatgacaggttcctgtttcctggctcacctggaggctcctgcagttggccagatgagaccctgacgtggaaacaaatctctcgggcacaggcacacttcagggtgagtgcagccttcacaggggatggggcctcactgggctctgaaggccagggccacctcctcctcctcctccttcccagggactccaggaatcccctccccattcccatcccccaaacctctatcctccatcccaggctttaaagaggtgcattcacctgttgaagatggtggtccaggcaggaaaagagcaggggctgctgctgacttgttccccaggagcacaggagaggaggcttcgagacccacatgtgtcctgtggctgctccacccacaccggggtctgaccccagcggatcagcagagagagcggcccagagcaggaggcccagcccagggcagctggggtctgcagggctcccctccagaggccgcacctcagaccttggcagcagcccccagctctgtggatcctccaggagattttcccaagctccagccccaaccctttaattcacactgggaagagcctcaaagaacccggcagggacggagctcccccgaccctctgggcaaagatcaacttggttaaaagggcctccagctgaaacccatctcctggggaaatgtattaaaacagaaactctgctaggaagattgttttgctcagacgttcttctcctcctgggtttctgcttttacaatcttgacctgaactaaatttaatgcagaaaccttcactggttgctgggagagcagagtggaggtttaagtgagaaaactaatttcaaagaactgtaggggaaggaaaacttttcctctactctctcaccttcagtggctgggggcctgtgagtttatcggatgaaagttattaacaggaagaaattggctgggtaccgtagctcacatcctataatcccagcactttgggaggccaaggcaggtggatcacctgaggtctgtagttcgagaccagcctggccaacatggtgaaaccccatctctactaaaaatataaaaatgagctgggcgtggtggcacgtgcctgtaatcccagctactcgggaggctgatgcaggagaatcatttcaacccaggaggcagcggttgcagtgagccgagatcacaccattgcactccaacctgggtgacagagcgagactccgtctcaaaaaaaaaaagcatttgtacccagaatagccaaaacactcatgaaaaagaacaaagttggaagactcacaattcacagttggaaaacttactggacagcgcagggacccggaccgtgcagaactgaccgatgggacagaactgaaagccgaggcaattcaggggagaaaaaagtgctgattccgacaagcggtgctgggaaggcacgtggccacgtgtaaagaacgaagctgcatccttccctcacaccatgtgcaaaagtgaactcagactggctcagaggccgacatgtaagagtggaagctacggaccaccgttagaagctaaacctttgcaaacgtggtggccgtggtgtcttcaacaggaccacagaagcacgagcaacgagagaaaaaatgacagattggacttgatcacaacatacaacttttgtgcatcaaaggacacatcaaagtgaaaagctcacagaatggaaggaaaacggcaaatcgcgtatctggtaagggattcgtatctagcatatgtaaggaactcttacaattcagtaataaaaagaaaataacgcgattaaaaaatggtcaaaagatctgaatagacattcctccacataacatatacaggtgccaatcagcacaggaaaagaggctcaacaccattagccatcagggaagggcaatgcaaaccacagtgaggcgtcaccacacacccgttaggacggctgtaatcaagcagacagcacaggtgttggcaagagtcaggggtgttggagaaattggaacgctcttacactgcaggtgggatgtaaaatggtacagcgctttggaaaacagcctggcttttcctcaaaaggctgaacatgcaacctggcaatcctacttctcagcatctacctaagatcccgtttatgtgaaatgtcctgaataggtacattcgtaagcactagtggttgcctagggctggggggattggggagaaatgaggagtgactgctgatggctgcaaggttctttttgaagtgctaaaaatattctaaaacaggctggtgatggttgcacaattctgtgaatacactgaaaaccttttttttttttttttttttttgagacagagtttccctcttgtcacccaggctgcagtgcaatggcgcgatcttggctcactacaacctccacctcctgggttggagcaattctcctgcctcagccccctgagtagctgggattacaggtgcccgccaccacgccaagctaatttttgttttttgctttttttgtttttttgagatggcgtctccatctgttgcccaggctggagtgcagtggcacaatctcgactcactgcaacctccgcctcctgggttcaagcgattcccctgcctcagcctcctgagtagctgggattacaggccatgccacccccggctaatttttgtatttttagtagagacagggtttcgccatgttggtcaggctggtctcgaactcctgactgcatgatctgtctgcctcggcctcccaaagtgctgggattacaggtgtgagccacctctcccagcctaatttttgtatttttagtagagacggggtttcaccatgttggccaggctggtctgaaactcctgacctcaggtgatctgctcaccttagcctcccaaagtgctgggattacaggtgtgagctaccacaccaggcccctgaaaaacatttagttgtacactttaaatggttgaattgtatagtatgtagattatatcaataaagctgttgttaatttttttttttctgagacaagttctcactacgtcacccaggctggagtgcagtggtgcgatcttggctcactgcaacctccacctcccaggttcaagcaattctcctgcctcagcctcctgagtagctgggactacagacatgcaccaccacgccccactaatttttgtattttttggtagagttgggggtttcactgtgttggccaggctggtctcgaactcttggcctcaagtgatccactcacctcggtctctcaaaatgatgggattacaggcttgagccaccaaactcgacctaaacttttttttttctttctttttttgagacggagtctcactctgttgcccaggctggatggngaaaccccgactttactaaaaatacaaaaattaaccatctgtggtggcggttgcctgtgatcccatctacttacgaggctgaagcatgaaaatcactcaaacctgtgatagggaaattgcggtgatccgacatcacaccactgaactccaccctgggcaacaaaacaaaactccatcaaaaaacaaaacacaaaacataaaaacctgatttccttcaaccataaacgaattgacttcaaaaattacaactggcaaaaaacaaaaaaggtggaaaattgtatatttcccaaaactcacactaaggccaagctcactgtaaaaacatggaaaaatcccattttctgaaaccaaactaacccaatacctatttgctaacaacaaacacttacttattaacaaaacttgtggccattggctccttttagttaacaattctggaaataaaaaacctccactaatagtcaacgcccccactggccctcacaacctgtaaattcccacttcctttaaaaaaggccccatttgggaaaacaatgttttaacactcaaaaatattccaaaacaccacctctggccccctttaacacataaaaccccaactttcataaatcctaaattaaaattttaaatttttagataacccgcaccccactcct

SEQ ID NO: 853 - DNA, 2062 bp, Homo sapiens
  misc_feature (1)...(2062): n = A,T,C or G
ttgtggacccttttgaccgctctatcaccccaggggaagacctgcagaggatctgggggcactgcagggtgttccctgacacagtgtcttcctgggggttccaggggcactttgcgcatgcgtgagtttgcctccttgttggcagcagatcccgtgggacgcttgccctggctgtggacgcagggcaggtgtcagacgcatgcagggcggcgtttctgtcacgcagtgggtgggagcctcctgggcacccgcctctgggattcgggccctcctgggcacccgcctctgggattcgggccctcctgggcaccgtctgagtgggacaggacggcagggacaggacggggtgtggagcctggcttcccctgtggaccctgcagtaataagcaagtcccctcctcatgttggccccaagggctccacgcgatctggcccacctccttctccaccccgccccctgactctgtcacacccgctcctctgcgctgtgtgttttccctgccaaagggcctttgcacttgctgtccccaccaccgtgagcatgtgagcaccgccccacgcatcacctggacagctccttccgtgtcccccaggatgttccctgagcacccatttcatcagccctccagcccatccctcacccccacacagcacagtggtcacaggcggagacccggaagccaacagcctgggctgagctgaggatacatgtccgaactccctgtgcctccgtgttctcatctgtaaactgggagtaataagaacacccacttcataaggttaaccctcagttgcctgtgagcacctgctttgtgccaggcaccctccagcagggaccacccccagccttgcagtgcctgagggacatgggcacgaatgacgtgggcatggttgggtagtgctggataactgttggctgttaggatcgaatagagcagttattactgttcaggacataatgaccgcctgagacgcgtgtatgtgttcaggtgtttgctatttatcttcctcacgatcccgtcttcccctgtgggcagtgggatggggtcccgcggtctcagtctctccccagttgctcagacagacggattcaggggatctggcagtgtccctgcggaagaggctggagcaagggggtcactccaaccgagggtcagcccccagaggaggccggtgcaggggaaccccgcatggctgagtgggtcagacgtggttgctgggaccacaccacagctccatcactgaccgtgtgctgtgtgaccgtggacaggttatccacactctctgagccttagttttctcatctgtaaaatggggctgatgacacctgctctccctgcccccaggccccatgcaggttgggtcacagatgagtatgggggtcgggccctcattcatctgcaggggccaggcccaggcgccaccaccatggcacagcaaggccacacatgcacccgccagccagggtgccctgggcgggaggggccgttacaaccaatcagtgcaacccaaagcccggggacggggcctgcactccataaactccccaaaaaccataaattccctaaaaaccgtcaaagggaattctgtgctgtgtgcattacgccctcttaaggctggaaacagatacgcattgtgtcagacaacaagcatggctgaacggtgaatccagagtgggcctgggcagctgcctgcatctgcgtcagagtcaggggctgtgggtgcccactttctgcctgtgccccccaaggcagggctctgcctctggcctctgtgtccccatctttggtaatggcccagcccatgggaggacaagagagcggcgcctctcctaggcagctccagaaatcaacatcaaccagggggtggctgccgtgggttgggtctccctggagctnctggcagcccccttccggcttctcccttctcccggagncccttccccctccccatggcccttttggaaagttcaccctgctgctgctggaacaacccggccgccacaacctttgttgccctggagacaggggtttccctggcgaccgcagaggaaggaccagct

SEQ ID NO: 854 - DNA, 3425 bp, Homo sapiens
aagaactccagaatttttacctccaagaaatcggcttcctgaaaccttcactggctctgaactcaaaagattctgaacaaggcataacaggtaaagaagcagacttattaatctgagggcctaactatataaggcatttgtttagctttctttttgtctttggggtaggaaggtaactgataagaagttaggagattctgagtaggcagagaaggatagaaagatagaatgtaaacccagtgagttcaatacatcaaaatacaattttttttctcataaattagctgcttaagtttttcatttgctttttgtaagaagtcatttagaaaggcaatttttggttcatttaaccttttagaagcctctgcatgtcaatcaaaatacatccttttgtttctgaggtgttttttgtcctttcttaatattttattttattcctttcagacctagtcctgcaaatatcctttcttttctaatgtcttgcaagtgaacaattttatctaggttaaaacttcctcactttgaccactgttaactcttagattacctttggtaggttcacccatttctctggaaaagtgcagactctgggttcataggttcttatacatgaaattggctggagttccaggtggaggagtttcagactccttggatccaaatgaaggcatcattccctgtattctcataccctttcctaccataagcctcctactggactcagtcctgctcccataggccttgtactggatccagtcccagtttctgttgtaacttctggacccagctcagatcaaaaatgctcaaataaactttaagaatttgacacaagttgtagagtttgtatccaagcagggcctacaagtggcggcctccaaatgtgcagtgagaagccctgagcacaaatggctcagtgtgtgaagcaggcccacgggcactggttaccaacctgttctgaattctcataagcaacaatttacatgtagtgcatttattacctatagacaggtggtaggagacgaagactaggactcactgtgagccaatccccccaaagctcagaaagttgcccaggtggatgaaatctctactgcgtattcctcacttacaccacagataagagatcccgaagagcagcccacccagattacataccacatgtcacatgaatcactgggctaaagtgttgaaggaccttctatttctaggggagaactggaacagagcctgggctacttcagccagtccctccctatctcaggatgttgcatcccagctcgttatgcagttactcttgaaaactacaaaggaaaaggagggagaagtgggtaggcccaaggctatacagagaactgtcctgcacaatgaagcacctgcatctgtttagtcactgttcccagaggtcatcattgagggaataggggggccttcagatcccatttctgacaccagaactgttaaaagagaaactttacacaaaacaaattcgagtttattcgagcaagaaaacaattcatgaatcaggcagcatgcagaagcagaagaggttcagagagttccactcagcagcatgagcagcaagcttttatagacccaacacggaagcagaaaaattacttgattgggttttggtttgcttgcataggagctggtgttacagagttgatctcaagctaatggcctccttatttgctttagcaccccacacctgaacccaagggaaagcttgaagggagcccagcaccgaaacaaactagtaaatgcctgggggcaaacaacagtgtttttatcaagtaaccatgacacatacatcttcctcagcagtggcagagcagtcttgtagagttagataggaagatgatggcctggccacgcatgctcagctgctggcccggctcattctacaggtattaaccagtatttggcccacagtgtgctaagcaccattctaggtgctgaggatgctaaggtgaccccaacaatgtccctgatctcttaaagctaattctggtgggatgctgaacacaggatgtaacctaaggtggtgatgagaggtacacagacaaatcggaaggcacaagttagccaccagtgaggggaaactccagacaacgtagacacataaggccaggtggagaaatggatgactgagttaaacttgggtaaggagcctggcaaatgaagacagaagcatgacccagtcaggggaaaccacaacaaaagacgtttggtgggaactgcctgtttcttaatttccaaaaatcagttaaaggttcatatacattatctcatttcaacatcactggtagaaagattccatttttatggagaggggatctgaggcccagaaaggagacgatctgtcatcgttttccactcaagggcaaacatggggatatcccatcccatcccaaagcctaagattttgcactccaggccctttgtctgacctgaaattactgagctaaaagggaccgaaagatcctaatggaaccaccgatgggaaaactgcggcccaggaggaaacacaccaagcaaaattgcaccgtatccaggtggccagtctccagactggggtctccctgccccgccagaccatctcccggcgacaagggtctcaggtttccgaaatctcgccacccgcgagtgatttgcagcgcaggggcctctgctgcctcggaaaccttcaaaggtgggcgggtcggggaccaagtccccctagggatggagaaggaaacggggccaaggaaaaggacatcgccaccctgggcagagcacgcacggccccagcgactcggacatggtgaggggcgcggaggctcggggtggacccgaggcctccacacatgtggcaggctgcagcaacccgccacccacgaggactcgcccaaggcccagagcgcgccgggcccctccctccgactccgtcgccgcccgactggccgcagcggaagccggcgcgcgatcccacgctgcgctttcgccacgtcctgacggctgcccgataaaacggacattaaaattgcactttccactgaatacagcagcgcctattgtggcggcacacctgaatgcgaaaattaaagccaaaatatttccttagcggctaaaagagctctcagcctaggcgaatctgcccgtccgctcgccggaaatgcgggctctcctgccggaagctgcccctccaccattttgtggccccgctatggcggcggggttgaagttgggtaccggaagcggggtcttttactgaaagggtatgccaagtggaggtatacaggaacgttgcgcgtgtccaaagagagactctacctggaacctcggagactctggtatgtaccggcaccagacggggtcctcgccaatacctaatagtagaatcccccctaaagtaggagcgccggcccagccgtatctggcggtgg

SEQ ID NO: 855 - DNA, 3501 bp, Homo sapiens
tgacgcggctccttccagccccgtggtgaatacttaatccctgcgtcttggaaggccaaggtaggaggatcgcttgagcccaggaggtcaaggctgcagtgagtcatgatcgtaccactgcactccagcctgggagacagagctagactctgtctcaaaaaataaaaataaaaaactcaaagatagtccatacaggaacaagtgcacacacatgcaaacatacagacatgcatatgcacatatatgcacacacacacacatgcacacatacagaaaaatggtagcacacttttttatatagcatgattcttccaagttgggaccttacagaaccctcattatttttaatggcttcagcctgtgctactgtataggggcctcataatttatttaagctattcgctatcaacagacatttatcttagtcttttgttacaaatcacactgtaatgaatatctttgttcagacatccttgcccacattacagcattatttttaatgtctgtttgatatgcgatgagaatgatgtacaataactcatataatgcatcctctattttaaacgtctagattgtctccaatgttttccaccattacaaacaatgctgttacaatataaatcttcacacacacctctgattgcttttcttggatgaatttctggaaggaagtgctgggtgaaaacattttcactttaactttaaggttgcttccagcccttttataagggctgagtctgggctgttcgcatggtggggtaggggggcgcccaagaatgggcaggagaagagtcctgcgaaaagaggggaaaagaggggaacgccaagcctcctctccggggttggagaggggaggggagggcaggtgcctgggaccctcctggttgtcctctcacagcctagctaggccccgtttggggtcatttccctcacttttcagggtgatgctggactccaggattcctagagctttggctgttgtcaaggaagaaatgtccgcagaggcttctctaaagagagtccccatacgcctgggaggtgcagtgacgcatctgaccccgctgaggagggagaaccaacttgtgtcactaaaggcctgaggtgagttggacccaagactcgcagctcaggcccttgtgagtctcctccagctcaggtgcatgggaagcagcaccgccttcacgattccaccaacggctttcatctccacctgcccccgtgaaacacaccggatatcagctcccccaggcacagcagctgaatcccagggtctatgacgtgctgcggaggcggggagggggacaggaggccaccagatccctgacgtcacctgcccatccaggacaggaaaggacatcatcgtgcaaggagcctccgtggggtgtgctggagttggcccgtgagcttgcagagccggtcattagagctccgggaatgcacgagccgggcgttcaatgctgccattatcagaattgcatcagataaacttaccatgaagtaaattctattaaagcaacaggaatagttgcaagccctcagctcccggttattttactactgttgcagttagctgttgagtctgtggtagcaacgccatgtggtagagaccaccagcatctcccccagctccacgctcagtggcgtcagattgcagtgggaggtcagccccgggcagtgtttacaccacagaaattggcaaatgccacacatgcaggctgctttctttagtttacctgaagagctggctgttacacgcctgcccatgtccaccgagcctccatcgtccattggggtgggggctctgcgaggtcacctctgcccctctccccggggttctttccctccggaggatcacttggcctccctctgccactcttggggcacagaatgactctcacttgagcctggggggctcagccaggccctctctgcctgcacactcagcctccagctcgttctgggtctccctccctccctggccctccccaggggtgagtccaggtcctcgctgctctgacgccccttgagcctcatggaatatcccctccctcctgcctcctgccgggctcacaccaggcagccaatgcagccccccctcatgtgtcttccaggggcctctcactctgcaataccatgcccccccacgcacacctccacacttggagaatctcctgggtcccagctgcctgcgctgttggtagaagtgtggctgctggggggtggcactcagaggagcaggaagcaaactggaggccaccagtcctctgtcgttctgcagcgggcaggtgtgtgcaagtcaaccccagagtccgaggaagctgagaggctgaagaaagaggccgacatgttcagttccttaaaaagaaacatctaatagtgacttacaaacagaagccagctctgtgtctcagacgacagcgagatgagatggtagatccctgccccatcactcccagacccagggctcatggaccatagggaggggtgactcagaagggacaactgagggatggtaaccttaagactgtttgatccagtggcaggatttagagtaagtgcctgctgtcacacaagaaacaatcaataaactgggaatgttagaggccttctcggaacaggggttaatcagaagccaacatggcggactcatgtccaacatggagttgctttggcctccacagtcctccagtctcactgcctccccctatgacccccaaggtagggtccaagaggggtttgcagagaccatgtcccagggtcacaggccacagaagacagtccccagctgagacaccacagcccaaaaacacacacgcctaccttatggtcctgcatccccgggagagaccaggggcccactgacctgcccgccctgcagcagacacacccctttgaggcttctgatcccaggactgggaagtgaggagagggcacccgctgaaaccctttgacaatgacagtaggtgaggcagaacaggacagagcaggacagaaaggatcctgtaaaaaggccgtgcacacaagggggcccgtgcacagaggctgcacacgggctgcaaggagaggctgtacaatggaagctgcacagagaggctgcacacaaagacttctcacagaagctgcacacagaggctgcatacagaggctttacacagaagctgcacacagctgcctgtgcctggggaaagccagtgaagcctccactgtgagggtgagtggaatagtcccttccccatggaagtcattcctacaaagagtgcctgctccctgcacgcagactggaccatcggagggggctgtggggcttttcctggtctaagtgctgagctctccgtggtctccttgccagagctgggtgctttaaacacaattctgctggttcaaatcacgttttaaaatatttaaaacacagattgcaaagtggtggcctagcaggaaggtgtgttttctttgggctgctatgtcttccccacggggctggaaggatccgcgcggcgcaat

SEQ ID NO: 856 - DNA, 4986 bp, Homo sapiens
tacggtcttcacccgtggtgaagacgaggtttgggaacctccatctagatttcacaggatgtatggaaatgcctggatgcccaggcagaagtttgtggcaggggcagggccctcatcgagaacctttgctagggcagtgtggaggggaaatgtgaggtcggagcccccacagagagtccctactggggtactgcctagtgcagctgtgagaagagggccaccatcctccagaccccagaatggtagatccaccaacagcttgcaccgtgctcctggaaaagccacactcaacaccagcctgtgaaagcagccgggagggaggttgtaccctgcagagccacaggcgcggagctgcccaagaccatgggaacacacctcttgcatcagcgtgacctggatgcgagacatggagtcaaaggtcattttggagctttatgatttgactgccttgctagattttggacttgtacagggcctgtgcagcccctctgttttggccaatttctctcatatggacggttgtatttacccaatgcctgtacccccattatatttagaaaacaactaacttgcttttgattttataggctggtaggcagaaggaacttgccttgtctcagatgagatgttggactgtggactttgagttaatgctgaaatgagttaagactttgggggactgctgggaaagcatgactggttttgaaatgtgaggatgtgagacttgggaggggtgagaggggatgatatggtttggccatgtccccacccaaatctcatcttgaattataactaccactattcccacatgttgtgggaggaacctggtgggaggtgactgaattatgggggcgggtctttcccgcattattcttataatagtgaatgagtcttatgagatctgatagtctcaaaaacaggagtctctctgcacaaactctttgccagctgccatccatgtaagacatgacttgctcctccttgccttctgtcatgattgtgaggcctccccagccatgtggaactgtaagtccattaaacctcttcttctcctcctcagtctcgggtatgtctttatcagcagtgtgaaaacagactaatataaaccatgaggctatccatatcacaacacagaatggtttccaatgatctgttaatgggttcttatatgccaagacttacaataaaatcacttaacatgcagtccatcacaaccacactgtattttgttgtaacctcccgacgacctagtatcttaaaaaaaaaaaaaagtcccccaacaagagaagacttgttttgacatcaccaaattggattagggaaacctgaatgatttctgtagtgatgcaagattactcatttgtcaaactgggaaactaccaaaatgaatccgttttgggcatttaaccagctatttggaattttagcccactgtgcttaaaagtcacctctttctggcaaataaaactttcctctagaaaaaaaaaagcctgtctctaaacataacttaccattttcatcagtgaccctcaaagtaaaaagctttcaatttttaatgctgtactgaggttttgaagacttcttacataaaaataggttccagagagttgtgggtaaagagagcaagtggctgaagtgagacctgggccccaccatggaaagaagcaggtggaaatgccaatgacctgccgtggggatcctgacagtgaggagaacggggcttgtggacctggggccctgcctgacacatatgctgtgatactcaagaacgtctctccctgtagttccctcactgggggaaggaaatccaatctaggacatttttagaatctcacaaaagacagcagaggataggtcttcccaagaaggctgttggaagggaagaaaaaggtgctaagagaaggtgagagagcatcaaggagaatccacccacaccaagaacacacaggcttgcacaccagggaagaaggagcaccagacggcatgagaccctgcacacgcccccaggaaaagcagcggagggaagtagcatggcatgtgaatggcatctcaggctacaggagcatgtgacccgaggaacctttgagctctctgagccacagatgaatctgggaagacaggaattcaacaaagcacaaaaataaggtaacataaccaaatgcaacagagggggaggctgtgaggcagggtccagcaggcgctctccctgttcttgtacagccatcagcagaatggtgtttactgttttttttttttttttggacagagtctcgctgtgttgcccaggctggagtacagtggcacaaccattgctccctgcagcatggaactcctcgatgccctcccctctgccaacccccacacctcactctccccagcagctgggaccacaggtgtgcgccattatggtcacttaattttcttaattttttttgtagagacagtctcactatgttgcccagcctggtcttgacctcctgagctcaagagatccacccaccttggcctcccaaagtgctgggactacaggtgtgagccaccatggctggcctggtttttacatttttaaatggttgaaaaaatacaaacaaacagaataatattttatgacatcaaaattgtatgaaattaaaaccctaggctgggcacggtggcttgcgcctgtaatcccagcactttgaggggccgaggcaggtggatcacgaggtcaggagttcccagcctggccaagatggtgaaaccctgtctctactaaaaatacaaaaattagccaagcgtggtgtcggacgcctgtaatcccagctactcgagaggctgaggcagagaattgcttgaacccaggaggtggaggttgcagtaagctgagatcgtgccactgcactccagcttaggcaacagagtgagactctatctccaaaaaaaaaaaaaaaaaaaaaaagaaaaaaaagaaaaaaaaagaaatgaaaagcctcgtatccatcaattaagctttagtgaagccctgccacactcatgggtctacaaccatctgcagctgcctccacaccccagggacagagcaggggctgcatagaggctgggcagctgcagggctgaagacatgcacctttatatagaaaggctgtggggccctgctgtaaagcttagaaaaccagccaaggatccaaacaataccactgcaaaaccaatggaatttaaactacaaggaataaatagacatggctgaaaaaagtcgctgacagggaagatggacacagtcctgctgagtgccaaagagaaacacagggagcacaggctcgaagaaaggtgacccgaaccaagagactgtgtccttcaagcagaggcaccaatgcgtgggacaggaaaggtgctcgaggcacaacagaaaagaacttcccagaaatgagaactgaatctctgactgaaaggtatacaatatagtccatgaaaaatgggcaattaagttaataaaagttaagggtaaagcaagacttcctcagatgtgttgggtcagaaagagcatccacctcccagggcaggtagggaagacagggctggcctcgccctttccacagcaacgttcaattccacttctgaatcctaggcaagcgactcggtgcatcgttccctgcaaattgctatttatgttaaaaggcagctgagaaagattttcaagcgtgaaaaaactcagagagcagcataggagcaatgaaagcaaaccaaccaatgaacaaacccaaataggtagtcatgacccatccagctaccccgggccaccctgcagtggaaaggacagtgtcagattctagttcccagagatctgagaggcccacagcattacccaagagttttatacccagacaagccgtcctgttcacataaaggtcaaaggcaggcatttttcgacaggcagaattcatgaactacagcccttgtaaaaacgtacttgtttatgaaattcaaatgatcaagaaaagatgaatcgaataaataactcaaaaggagaagctgtagggaaaaaaggaatccagtcacccataaaactaaaagtaagcaattgggggttgggcgcagtggttcatgcctgtaatcccagcactttgggaaggccaaggcaggtgattcccgaggtcaggagattgagcccatcctggttagtacagtgaacccctgtttactaaaaatccaaaaaattaatcgggcatggtggcgggcgcctgtactcccagctgctcgggaggctgaggcagaagaatggcgtgaacccaggaggcagagcttgcagtgagccgagattgcgccactgcactccagcctgggagacagagcaagactccatccaaaaaaaaaaaaaaaaaaaaaaaaaaaagcaactggggaataatagaatgcaaatactatttataaactctcataatataaaaataatatttctatactttaaaggaaccaaagtcataaatatagtatattgactgtcctactcactcttaaatatatttctatatcagcatattcaaatcattttaaatggttacaaaactaagaagcactcatatcctagcggtggcaatgcatattgacacaatgtttcagaaggcaactgctcagtcactggtaatcctttaaacaaatgcacatattttttgcccaagcggtttattttttaaaatttttttctggcatatagaattataccccataagtgtttaaaagtaataaataatggccagggcccagtggttcaggccggtaatcccagcactttggaaggccaaggtgggtggatcacttaagcccagaagtttaccatcagcttgggcaacatagcaagcccctctaaaaattaatctaaaaagtcagccaggtgtggtggcacatgccggtggtcccagctggtcagaaggctaaggtggaagaatagcttgaggttgcagtgagccaagatcacgctactggactccagcctaggtgagtacttccccg

SEQ ID NO: 857 - DNA, 3476 bp, Homo sapiens
cgtgtaggataaaacgagagggcacgttcaggtggtttagaaacaaaaaagaatctgggtttccaggtacgtaaagtacctaaaagcacggaactgaaggctgataagtcggtgaacccttagccgggatgcctttactacccaagttagtctcggtgcatacaatgttggtctacaaagcaaaactccgtgtcaaaaaagcacttgttatttccatatatccatatatatatatataattctttgaagaaattagctccctaaatagttggggttggagaaggagactgtgtatttggaagacttttcttagtagtcttgtttagcattcagaagggactcaggccacactgggtttctattataggttgaaagttggggctcctcactgccctttttacccgcaataaattgcatagcaaatccgtaaaagcgatgactcatctcctaatcctgccccttaaagggggaaaccagatgcttgcagttccccaagtggtagtgttgatcatgccaaggtgaggaccgtcgttccatcccttgcaaagtgaatcaaagtgaattgtagccaaacacagataagaccagagggtgtctgcactgagcagtccaggaaggaggggagctgcagtggctgtcaccgggctgggacacgaggaggaattgcaggtgaaatcagatccagtttcaacttgaggaaaattcagccccgggagctgctggtagagcccagaccttgatgctgagtcatctgcacagagaattccgtgacagaaaggccgtgggtagagacgtgaatggaggaagtggagtagatgaaatggttaaatgttggagaaaagaggctatttatgaatatgaccactgtcattcagataaaatttctggactgttatcattgaaaaaagtctcattatgtttctatttgaaagcaaaccattatgcttttttgaggaaaaaaaaaaactgtgagtcacgttatgcttgcaagtgtttaattcagaccatttcatctttaagaaggcccctggtcacattatacggatgatttgcttattaaatggaactcctgtttcttgcaccatgttgtggggtcaatatgagaagcctaattaacagaataaaaagcattaaagcttctttagctaaagtcaaacttagagaattgtctaatggtatgtagcccctcgttctaagatgggcgttttccccagataacttgaaaatctactggtaacagccacttccctttaaagaattctattactaatagccatgacaaaatggtattgtatttcaaagttaagaatttgcaggccttaaaaactaacttatttttcctgattattgagtttattgtagaattctacgtgtaagcattccccagccgctatagctttgaataagcagagcttttttcagagttctggtagcgcccagcccagcaccttttattctgaatgtgaagtgtgtgcctccgtgtcacagagtcacagcctccccagggacgctgcgcgcggagccctgtcagagcagcgcgtcagtgacagcggcagccgagccaggaagttatcaggcagcctcgaccaccaccagatttgactccgcgagctcttttgagggaaaacctggtaaaacgtcaaggtgtctaactgacctcgcctttatcatctgttctgtaaatcttaggaaaggtctgggaaaaaaatcaaaacgattctgtccgttaaagggcagccactcctggccctccaggatgccggggtctgagtgatcccgagctgatctgcagaagcacagcctgtggcatttgcggtttattgtcatgaaaatgattcaacgtagaactttttcaaatggcaaaatcaaaccgctcttctttatattgtttttgaatgagttgtcatggaaacaaaatggaaataaatggtgttttttttccagatttgtgctcattgcaggtcttcccaaaatagtagctttactgaatgaacaaagaactaaaatgaaggtcccaaactcatcgctaaggggcctccactaaagagcatcacccctggaggggcgcgggtctcagggtccttggccgcgtgtggattatgtcaccacaggagagggacgagtcctttccaggcacatgaggaggaggaatcagtgttaatgggtggctttgcatctgtgaaatcgcataaacttaagttagctgaagctgtcgtgagactggcatttccaaattggattgaaggtttcaggcttcatgccagcgcaccacagcctgttcctgagtatctgtgctgagaggctgtaagattagtgtgaacaggagaaatttccaggtaggcctctagcttcattaccgttgggtttcttactgccggtattcagacaggtagacatgactcgctggagtttgattgccttttcttacctcatgttggtagaaacatcaatgagctgaaatgtatagggagataaaatgggcagaggcaggaggaaggaagaggaagcgccagcctgaggtggtcatgaactgcatactcagaccgtggctcatggggaattggttgccattgaccacgtgaagcagctccagcctccacgccagttgcatgttggttaaaagtttgtccttggtgcgataagtgtgtggaacgggagagagaccatctctgcctctgagattggattcgggtttcagttcgttgtcggtaaagtagtgaagtgtggcaggggttctctgaagcctcagggtctacacaggcaccaccctgaggagcagcctctgcagacggggcctgatctctgccagggcagtaggaagcatgacacgtcccgccagccaggccacagagctgaacactgcctcctcccctgtccaggtcccgctcccggtcccctcggaggagagcccactcccctgagagacggagggaagagaggagtgtgcccactgcctaccgcgtgagccgcagccctggggccagcaggaagcggacccgctccaggtaggccactgggtgtgcacgcaggtgctggatgtgggccaggtttccctgggtggaaagggcgtctgaaggtcgggtatctgtgagcagagctgtggatgaccagaaggaggtgctgagtcccccaccacccccccacccccagtggcatggccatcactgttgacacttgatcacactgagctcctgtgtctggtgggcgggggtcacttacccaccggggctctgcacggcctggctttcgtgtccagcttttcaatgtgctggtacctcggctgggtccacatgcagctgctggcccctctacctgctggtgggacagaacgggaaggcacataccgaaggaaaatgcaggcttccgtcctaaacccttctggtcttaagggcagccactggggtggccttggctgtcgggtgaaggtaactacggcccaagctgtaactcccagaaaaggcaccaaagtctcgatg

SEQ ID NO: 858 - DNA, 4966 bp, Homo sapiens
aaatgggttgtagacaaatgacaggcgccccgtcctgggggaatcaggaaggggtcctgcagcccctggtgtggcccttttcccatgcacagtccgggccccccacggcttctgcaggacccacctcagctccgggtccaggctgggccagcgctctgtctcctcaacggtgaaacgggttgctcaacccacttgcaggttgttgaagttcaggccttatcctcgggcacagtcggttctggaagccacagtctgctgcctgcaaatgtgctcctcaaatcgccttcccacccgcagcccctcagcccaccgtggtaccaagtggccaaagtctacggccatgccccccgaacgcctacgagctcatctgatctcggaagctaagcagggtcggacccggttagaacttggatgggagaccaaatggcgccagcgctgggctttcttcctcaaaccccacgaccacgacagcgcgataaacagggaccctgttggaggccacgtgggtcacaggcctgcaccggacacagcacttcggcgaaggcaatggggatcctgattggccgcccagggccctcccagagccagacgcggaaggggagggagctctcccgggagcctcacgcgggacactgagcacagcccctccgcgcacacgcggttatcgataaacgcagacgtgacacgttcgtgggttctgtttccctggagggcagctgggactggtgtgaattctcccgtctcaccccacaaatcctaacgggcacccgcgagctttctcgtctcgactttcacacgtaaattgtgttttctttttaaaatgactcgtagcgcgagctcctggcgtccgtgccaggttggaatagagacgctgtcccggggggagagagggggacggttgagaattctctggaacccccagcggcgcagacacccacccgcggctggacgcgcggagcccgccctgggcctccctccccggcttcaggtccccgcctcggccctgcccacctggggctgcgctccctgcaagtctgcggcccccacgcggccctcggccccggcgcgggtcttctgcggacgcctccagccagctccgggtccctgcgcggaggacgctgattcgtgtcgttaagcgggtgaagcgggtgtagacagaggtgcgtcctgccctccccacccgctgcccccgcagcagccaccgagcctcgaccggcggcttccgaatgcacgaagtccacgctcctgcccgggaccctgagtcggggcctggtccacgcgctgccgccgcctctagggccctgacccctcccgggcacagcgggcccgtccccggaggcgatgccggcccgggtctgccctgcggttccccctcccgcgctgcttcctgcccgcagtaggggccgctcctcaccgcgcaggccccgctcagaggagccccagagctggagaggcccccgcggctggagaggccccgccgccccccagatgcccccggggccctgcccggttcttcccttcccagccccgacgcctctggcttcacctcttcccttcatttcacggatccgcttatttcaggggagctccaggagggcagggattttgtccgtttctttcacttttggatctgcagagcccaggacagcacctggcccgtagtaggtgccgcaagaaacgcttcttgaaggaaggaaggaacgaacccacgagtattgcaggaggattaaatgaaagatcaattcatcccacctcacggtaataggcaccctgtttcctcccagccccgagattggagagtttgttttcatcctcctgttgtctgaacacagcacagagcaatcctgagacacaaagcaacgtgcctttcaaaatttttaataaacatggaatcttgctatgctggccaggctggtcttgaactgctagcctcaagcgatcctccctccttggcctctcaaaatgttgggattataggcgtgaaccactgtaaccagcctcaagacaggctttctaagacacaagattccgcgtgtcaactgtatccacggaaaccattccttagtttattgtcaccgccattcctaactctgatgtgaaaatccctgcgttcatcaacataacccagttagggtcgcactcatcacggggcccccattgcctctggcgcaccccacgactgacatctgcggggccttcgcgctaggcttcgagtttcagcttccgcaccaggcctgcctttctgcaggggccagggtgggggtcgtgtgctgattgggccctctgaaccgccaccgctgcagaggggctgttccttccgtcacatcccttgtgcccgaatccaccctgtgtcttctcttttctcagcaggacattttaaaagcccagaccccctccttacagagcaaatgtccaggcttcggaggtcactgtcacatcccaagaacccccttcaccaggtgccactcttgagactggactgaagccccctggagaggtgagcttggtgggctctgtaggtttagggaactttgaggttcactgcccttaggagggaagccctctccggttctccgcagtccccaccgttccctatcgtcacccctgggcacctgcactcccacggttctgcctgggccttgggggcatttgagccctgggcccatcctgagttggtttggaggctgggctgtgtggagctgtggaaggccctgggcatgcggccagctcactgctgggagcctggttttctcactgtccagctgtgtggctcgggggcccccgtctctatgtctcagtgatgacaacactggccgtgtgggtcctggtgggccttgagtgggttcctctgctcagacatgaggtgcttagacctcgccctagctctgccctgtgaccttggcaggtcacccggggtcactttcccatcggagtgggggtggggactggaaccagccactcccaggtccctcctctgaggttgctcttggcactggtcctggggacagggctgcaggggactctggcctctctctcccctctcagttccacttgcctttgtcctgctgcctgagatgagggcatggacagccgggtacaagacgggacaggcaacctcgcagtggtggtaaccctgtgcatgaaccctgggcctggcacgtggacctcctgtgaccgtccccacaggcccgtgaggctgagcttggcactgcccaagaccacacagtccatgcgcagtggagctggggtccaggctgcccaccagggcagtgactgcaatggtggcagcaggggacagtcaccatggtgagctcaagccaggcgctgcactgaccttgagggagggctccatgcttccccttcccacagctgcagtgagggctaggagagcagggtcggctgcaggcttgagtcctggggtgcctctgggctgacgggccctgcctgacctgctcctccagtgccccagccctgccccacccacgtcccctcctctcactgccccctggcccactccgctgcggtctcagtgccttcccaggctgggcatcatctgatgggaggaaaatgagggccccagactctgtgtcatcctggcaggacccctcccctcccatggctttgagcccatgagatggccttggacaaagcggcaatgggcccttcctgagacacagtgcggccatctactgggaaactgcccagtgtgactctgatgactgtgatgtgaatcccacagcaaagttgagcagtgcgcaacctgggctactgcacctggcagccctggctcctcctcctctgcctcttcctgctccttcattctcccccagagctctaattgtcactgagattttatgtttcgtttaacaaatgactgtctccccgcttgaacagaacctccatggggggagggaagagtgtctgttgtataaatagttgtatttcagtgcataaaacagtgcctgcctcaaagggaggactcagtcaatatctgttgaatgaatgaatgattgcctgggtcaacgaatgaatggctgaatgaatgatttctcctttccctcggcactgtctggagtccccaggacaggcatgggcagcagtcgctggtctgtggcctgtcccactggacttggggttctcatgcttggtctgggcggagatcacccaccaggctcccaggtcgatcctctgctcatgggaagctgcgtccggcccagctgccaggagctcactgcagggtggagggaagagcagggacgatctgcgagcgcctgaacaccacacaagagccgaggagccgctgcttaaaatgcaggcgttgagaggagtttcgcctccttttttgacttgaatatgagatttccgagcagccatgacgagttgggttggtggaagtggggagtccgttcctcagtcagatggagggggtccccttggatctcctctcggggcttgaaccctgatacttcaaggtctcttcccacctgcccttggtggatctggaaagctcctgggaacagggtgggtcttccttgttttaaaggttgtaagttgagagcacctcacataactgcctggggcggctctgacgggcctcagtctgcttgggatgtcacacaagaagcccctggggactgggccgctcaagtcctcctgggtcaaaccagatcactgggcctgtgggttccgcagtgagtccagcatcgtttcctgtgcagtgacccaagccgggtccccgtgggctttgactaggggacaggggaacttgggttggggggcctgcttgaatcatggcttccttgtcacctggactggggaccccaagggggatttctggggaccccattcccttctgccctggggtttctttttcaaaccacaacccccttgaaggcaaaaattgggagctgcattcccattcacggggtcccccagcccggaaaaatccccctggcccggaatcccc

SEQ ID NO: 859 - DNA, 5918 bp, Homo sapiens
gtacgcggatccttgcagccccgcggtgaagacgagcgcaaatcaatggaaagatatgccatgttcatggattggaagacttggtagcattaaaatgtccatactacccaatgtgatccacagattcaatgcaatccctataaatgtcccagtgggacttcttgcagaaatagaaaaattagaaagcatcctaaaattcatatggaatcttgaagaaccctgaataactaaaacaatctggtgaaagaaaaccgaagatgtgttacaaagctacagtaatcaaaacagtatgcataaagacaggcatacagaccaatggaacagaatagagaacccagaaataagccctcacaggtatggtcaaatgaacactgtggtgttcttcaaaaaatccctatgacccagcaatcccacttctgggtatttatccagaagaactgatcacagggtctcacagagatatctgcataccctcgttcactgcaaccttgctcaccgtaaccaagaggtggaagcagcctaaatgtcctttgaagggggagtggctagagaaagcgtgggattgtacacagcagaatcctcttcagccttcgggaggaagaaaatcctgccaggtgctacgccgtggatgaatcctgaggttattatgttaaggcaataagccagtcacaaaaagatgcacacaagatgattccactcatgtgagattcctagaacagtcaaactcttagagacagaaagaatggctgttgctgttgccagggacagtgcggagggggaagacgagttgcttaatggatagattccattttgcaagatgaaaaagttctagagatctcgtgtggttaacactgctatatatacacttagaaaaaaaggtgaagatgataaattttatgttatgtgtcctttattacaacaataacaaaaaaaaaagcaacctccagagaagaaagtcaggcaggaaagagggagccgaatcccatggcctgggaagatgtcctggtggagaggccctgccccaaccctggaatctcagctctatgggccctggaatcccccatgaccacctgagccctgggggggcggctccatcactgtcacccaaggtctttaggatgcactcggccactcagaccctacaagggagcccagcccggaccttccaccggcaaacccagttcccctgctgcctccagccctggcctcacaggaccccaaagggcccctcccgtgtggatcaagaggccagcatctgaggctggtcatgtcatcaatcactgctgcagagacaggaggtgctgacgagggccatgtgcaaagacagaagagctgacgagggccactggggcccagccttcccttctcattagaggcctaatgagccgcacaccttcagattccatttcagtgaattatcaacacctaatctgagggaataatgggcaagaccacctgccacacagtgattagataaacacgctgagagacaggatggaaagaactctgcaccagtgcagtccccagagctgggatggcatcagaaatggtgagaacggcagtggaaatcctgcccctgccccacaggtgctgggtgtggcgtggaaagtgggggacaggagggtgagcatcctaaacaccttgtcccttccctgctcaaagcctctaaggtttccctacatattcagaacaaaacctgggtctaagcctgggacacagaggtatgcacaggccctgcaagttcggccactctgacgtcctgaattgatgtcccacgcccccctccagcaggtgtccctgctgtgcctggaacacatcaagttcccctgacctcagggcctttgcacccccattcccactgctaggaaggccctgctccgagtgctcacacggctccctcacttcatcgggcgtctgtccaaatgtcacatccacatccccgctctgagcgagaggtcactttacagagaggaacggaggatggagggcgggcacctggctcctcgcctcagcctctcctcctcgctggcttcaggccacagcccggtctgagctgtcagcatccccccaccacatgccagcccccagatcctgggtctcagtgagtcacagatgctgtccttgctttagatgtaggggtcacttgtggggaaagactgattttaatcatgaggatcatgttgggagaggctcacagtgtgctgcatgtggacaccaggatgaaggaggaggaggaggaggggcagacccggggcccgtctcgtgttcactcctgtcaggggctcccgggcagcgtgtggatgaagcagtaggatgaagggcagacctgggacccgtctcatgttcactcctgtcaggggctcctgggcagcgtgtggacgccaagatgaaggaggaggaggagcagaccccaggcccctctcgcgttcactcctgtcaggggctccccagccggagtgggggcagtgggtgctggggctgaccggtcatgaaacacagctgttgtcataaattaaatcctgtaaacttacaatggaataaattatgtgaaaacgaagggaataaactctcacagtgtccctgtgatgacttcactacattctaccatggtctccgccctcagggttccttgcatctgtggtgtctacgtggtggaaacggtggtgccaggctgcacgtctctccccagctccgtccagagacctccaatgacagcttgaaccagccacggcgagaatacttaaacagtggcagtcatcaaacagtgcaaatgagggcctcatttattcttttgttgagttcctattcttaagaaagtgcagattcagattaaacgtgttgtgtcagtagccaacacactgtgagtggcacaaaaaaatgaggaaatgttcttccagtacaggaaaaccatgaaccagttccttttttttcttttctttttttccttttttttttttttggagagagagtctcgctctgttgcccaggctcaagtgtgccgcggtgcaatctcagctcattgcagcctcaacctcctgggctcaagcaatcctcctgcctcagcctcctgagtaggtgggactacaggcacacgtcaccacacccagctaatttttttaatatgttttgtagagacagatgagatttttcagggtgactcacactcctggcatcatgcagttctcccactacagcctcctgaagtgctgggattactagcgtgagccagtgcacctggcctgaaaatgattttctgattaagtgaggaagctgcccagtttgctgataaacacgtggggctccagtgtccacttctgtctgacctgcgccaatgcctgtgacatcctctcacttaggtcagtgtcatgaaaatacagcccacacgcacgtcagaactgcacgcatttgtcagtcctgcgagtctcttgctgaatctgacagtgacgacgtttactcattgtctatttttgccaaatcttgcttgatttgcagccatagtgtgtcagcctgggttccatcaggagagagaaaccccacagtgatttgaacagggcaggttttatttaaaggtttgttcaatttaacagaggactgccgtaatgaggagttgaggattaaggagtacagagaactgcaaagaacatgagagaagctcatacaggcgccagcactgaagaagccaccagcccagcaccaccctacaagggggcccagccctgaccttctagcccagcccactggagctggcttagccgcaccttttctcctgccaggcctcctcggcaccctctgctcactgtgctcaacactgcactggctgacatgggagagatgctgctgggcccagatgcatttccaccgagcagacaacgcagggcagctttggaacccagaggcaataaatcaatagccagcacccagaagtcaactatgaatagaatagttcagtaagaatcagtgagaacatcctgcaacaactggttgcaatatggaatccacaataaagggcatggtatattccactattcaaaatctgggtgctgctgagcctttgtatcagtaagaatgaaaatctgtgcacaggtgcgtgagtatacacacacaccaagagatcccattgttccgcctctgccagcacaccactggttatggggggaggtttccacacatgtctgccatcttccttctcccctctcctccagccccttcttttctccccgtgatttctttgcagaaggacggggctgtgccatttgtcctgtgagtcccgtgtccagatggtgctgatcacatccccaggcgtccttggagatgctgctcccttccctgcatttcatgtaagttctggggttagaaccagcagcttgatttgatgacatttccctgtagtttgctaggaaggtgtgtcattcatcagggacacagagcacccaggaccctcactcccagggtcgatgaaacaatctggttctgtgtgaagagcccattgttggtcccccatcctcgggcctgggcacgtcccacagagcagagaggacggggcctcccctgggctctgacgtccaaggagagaggacggggcctcccctgggctctgacatccgaggagagaggacggggcctcccctgggttcaggcatccgaggagagaggatggggcctcccctgggctctgacgtccaggaggggctcccaccccgagatgcctctgatcccttccagagggaggggtgagtagatgcggaataacggcctgggctctgtttccactttgagttcctgacgaagggtctctgcaccccctaagctctaacttaactggtccctcctaactttcccttgaggaacagtaagtcagtgacccaagcacattctgtttctagtggtgagtggagggtcctgcaaggtgctgatgagtccctcagcgaggcaggtgtgggctggatttgcaggggcaagagcttttccctcacaatccatggaggctgagtccacggtggccatccagccccttgcccctgcagggagccaggccccgaggctgattcctgctgacccctgactagaagactctcagcctgtggtctccacctgatccttctggaggaaaccctggagctctggtttccagttcaagcaccccgtcctcaccccacatgcatcctttcccacatctgtcccacgggggattttgatgcctctcctttctaatgccaccagcctcagtgaccaatcgtccacccccatgggtgcagggtacactggatccctggtgtcacaggagcttctcatcatcccccaatgcctccctttccggcagcagatacggggtctgcacggccctgcagaggggttgagtgagtgtagtcatgtatttggcaaccctgaagggagaatgtcattgtcctaaggctgggagacaggctgggtgtgcaggtgtgcatgcggcatgtgtgtgtacaggtgttcatatagctgtgatgtgggcgtgtgtgtgcaggtgtgtgtgcaggtgtgtgtgcaggtgtgtgcaggtgtgtgtgcaggtgtgcacatgcatgtgtgtggagctgagtggatgttagtgtgcgtgtgtatctgtgtatccatgtgggtgtgtggatgttgtgtgcgtctagtatgcatgaatgtgcagacgtgttttcatgtgcatatgtgtgtatgtgtgcatggatgtgtttttggttgtgtgtatatgtgtgtacatgtgttctgtgcaggtgtgtatttgagaatgtgcgtacacacaggtatatgggatgtatggatatgagtgtgcatgtgtgcatatgtgtgtacgtgtgtgttatgagtatttgagcatgcatgtggtcttcaccacgggctcgcaaggatccgcgctgattcacaacggggctggaaggtcgcgcgtcaat

SEQ ID NO: 860 - DNA, 4990 bp, Homo sapiens
  misc_feature (1)...(4990): n = A,T,C or G
gtgcgcgtcctttcaccccgggtgaatatcagcaggagaactggtgaatcagcaatgcatcatttataaaatggaatattacacagctatgaaaagaatgaagaacttccccagcccagaggcacccagggagataggactcgatacaaggtgggaacctggatgggatcctgggacaaaacgaggacattagggaaacaaagggaatctgaagtatggactttcagtaataataatgtatcaatattgattaattcattataacaagtgtaccatcctaatgtaaggtgttgccaggcgcggtggctcacgcctataatcccagcactttgggaggtcgaggcggatggatcacaaggtcaggagttcaagaccagccaggctaacatagtgaaccctgtcgctactaaaaatacaaaaattagccgggcatggtggtggttgcctgtagccctagctacttgggaggctgaggcagaagaatcgcttgaacccaggaggcagaggttgcagtcagccaagatggcaccgccatactccagcctgggtgacacaatgagactttaaaaaaaaaaaaatggtgctaatacagtgatatagtggaaactgggtgccggtatatgagaactgtgtaccgtcttcacaatttttctgtaaatctaaaactgttcttaaaaaaggttattattctttgggaggcgaaggtgggcagatcacttgaggtcaggaatttgagaccagcctggccaacacggtgaaaccccatctctagaaaaatataaaaattagccaggcgtggtggcgcgtgcctgtagtcccagctactcaggaggctaaggcaagagaatcgcttgaactcaggaggcagagattgcagtgagccgagatcgcaccactgtactccagcctgggcgacagagtgagactccatctcaaaaaaaaaaaaagtttattattaaaaaaatagggaagttctttatgttcagataaggaaatgactctaagacatacagtaactgcaaaagcaagatgaagctggcacagaatggaaatgataacacactttccgtgtataaagatgtgtattggggctggagggggagaatatatttgcatatttgcttgtatttatacaaaggaacttggaaggattcacaagaaattcctgtgtagccacgtgagtgaatcacttattcaagccaagtaaaaccccaaatgttggccctgaggtggaagttttcagcattcttagcgactcctcccacccagtgacctgcctggcctcgtcagcgccccgttcccaagccctttccctgcctagcccccttctcactcacagcccccagtgcctgtctggttccgtgaagctggtggagtgacctggccctctcagcttgcattagggctcagatagctgaacgatccagacacgggtcacacccagggacacacagggcagtgatccaagccacgcaccaggaaacatcaaagcaaatggcttctgacaaaagccagccttactaaacacaggtgaaggagacaatctttggagaacaattttattagcacagtttaagaaccttagaaatgatacagtaaaactactataaatctgtcctaaagaaggaaagaatatttttgttgttgttgttgttgagacagagtctcactctattgctcaggctggagtgcaatggcgccgtctcggctcactgcaacctcttcctcctggttcaagtgattctcccgcctcagcttcccgaatagctggaattataggtgtgcaccaccatgcccagctaatttttgtattttttggtagagatggggtttcactatgttgcccaggctggtctcgaactcctggcctcgaactcctggcctcaagtgatccacccaccttggccttccaaagtgctgggattacaggcgcgagccaccatgcccggccccagaaggtaatgctttttaaagggaaaaaactctagtttcccagcagcatccttgccgacagtgaaaggcaggaagctgtctagatgtccatggcaggagagttaggcccagggagggtggggttgcatctcacatgggtgaggggtccagccaaagtcacccttggaaatttcttcaatcaccaataaagtaagacattcggggtttaacataacagtccctagcggtgataaaactttttttttttttttttttgagactggagtttcattctgtcgcacaggctggagtgcaatggcgtgatctcggctcactgcaacttctgcctcctgggttcaagcaattctcctgcctcagcctcccgagtagctgggactacaggtgcccgccatcatgcccggctaatttttgcaatttagtagacagagttttaccatgttgcccaggctggtcttgaactcctggcttcaagcgatcctcctgcgttggcctcccaaagtgccgggattataggcgtgagccactgtgtgcctggccggtggtgaggaattactacagtgtcatacacacagtcatgtgtcttgtatacactatgcaaagtctaattttacagtttttttttttttttgagacagggtctcactttgttgtccaggctggagtgcagtggctcattcatggctcactgcagccttgacctcccaggctgaagctatcctcccacctcagcctcctgagtaggtaggactacaggtgtcaccacgtctggctaatttttgtatttgttgtagagacggagtcttgctctgttgcccaggctggtcttgaactcctggcctcacgtgatcctcctgccttggccgtccaaggtgctgggattaaatcactgtgcctgacccagtattttatttttaaagatggggtcagctaggcgtggtggtgcgcacctgtagtctcagctactcaggaggctgaggcaggagaatctcttgaacccgggaggcagacgttgtagtgagctgagatcatgctactgcactccagcctgggtgacagagtgagactccatctcaaaaaaaacaaaacaaaacaaaacaaaacaaagatggggtctccctttgtcacccaagcggcagcacagtggcgtgatcacagctcactgcagtctcgacctgctgggctgaagtgatcctcctgcctccgtctctcaagtagctgggacctcaactgcgtgcaccacacctggctccagtatttagagtgcatgtgtgctgttgactttaccagggggtctgtgcagagtgtgacaccactgtactcatttccgggggacactggccatcatgaatggccatctctgcagacgagtggttagagggctgggtgggtagtcttcgtagtcttccttgctgcaggcactgatgcntgctcccttctaccagggaagtgccccagcccttccagcaccaacgcaccaaacaaaaacatcactatatcagggcgtggtaggtccctcaggattccccgatgttccagacgctggccaagtgtgtgttgccctctcagacgatcttagctgccgccggcataaacgtccacttgtcggtgcacgggtagaaccacgatcctgctgacgtccggtcccacgtaacgatctccatgcatcaagatgcagatttctggctcatgatccccgaccctttacagtggaaaacgacccagcaaacaaggagggtgtgtaaaacttggaggcgcaaacctgaggcaaagcaaggtcacctctgcacacacagagcccacctcaggagcagtgcccagaagccatggcaagcacgaacagccacggcaaacacgggctacggcaaagacgagccatggcaaacatgagccacggcaaacacgagccacggcaaacatgagccacagcaaacatgaacagccacggcaaacacaggccacagcaaacacgagccacggcaaacacgggccacggcaaacacgaacagccacggcaaacacgggccatggcaaacacgagccacggcaaacacgagccacggcaaacatgaacagccacggcaaacacgggccacggcaaacacgaacagccatgcctgaacgggcccggttgcatctgattgcggaggctaagcagggttgggcctggttagtacttggatgggagaccaactgggagtatcaggtgctcgaggcttttggcaaaaaaaaaaaaaaaaaaaaaaaaaagactacatacgtacaaaaacttttccatgtaaaaaaaccttcaagtcaaaacagcgatgacaaattggggcaaacatttacaaaataactaatacgagaaggctaagtcccctaacatgtagagagttgttatgattgaaaaagaactccatcgccacacacaggaatggacatggttgagttcacaaagcaatgtaaacgcattttgaaacagaagggaaactgtgccatttgactcatcactgaagaaatgcaataaaaatcaagacctttccatctttctgatttagcaaagataaaaatgtttgcagacgctgcaccaggaggatgtgggcagcatctgcccgaggacggtcaccacagcactgacccagcagcaaaggccacctgcgacccggagcagccactggggagccctgcactgaaccgcagtgcgctgctgcgggaggaagccagtgtcttcctggagacggcttcacgtccaggtgcggaggggccgatgagcatttgtgggatggatggctactgcaagccgtgggcggggggaccctgagtgatgtcatctcagaaaccaacgcatcgggagatgcatagagtgctacatgaagttggccactggttgtgagaggaaccaggtatatggtaccgtgggggtgggggtggcagaggagcctggctgtgcagggtgcaggccacacgactttgccctctgcctcatccagggcctgtagcatttctgagtggttgtgggcagctgtggggcctgtgccttgtgtgtgcctgccccacc

SEQ ID NO: 861 - DNA, 6530 bp, Homo sapiens
gaagacaggttggtgggctattttgaaattcctgcttcagccagcacagaggaaggtttgaggggcccctttctgtcttgggcacacccagccctgctcaggagagcttgagaagcaggtctgcggattctgctgcccttggctgctctcggcttgctcctcgtctccgcctaatgtacccagtgtgttcacggaagtgttgtcccatggggtttcatatacagcctgttattcctgtatctctaatgtgtgattttccatgctctgggcatgcatagctttgtttcttaaacagccagctttctacagagaaggcacaaccgtcagaggcattgaagtaattttcagaagagggcttaaattgtgggctttgcacttgggaagtactctagtaggatactagagagaaagctgtctggaaaattactaacattactgataacattttgggagactctcagttggggcaaacctggggccccgtggggtctggaaaagggcggggctagtgtccttggagcacgtcagcttccacagcagccagttacttttcctgaggacagaggagttgcatgtgagggaggaggcgtgatttaaagcatgaagagaatcatgccccacaatgaaaccagagccctgtggcccgcgtttcagaccactgccaaccatggacaccagagacaagacaaaggacattttggccatggacttgaaacgtcagctgtatgagagcgggcgggggatggcgcggtctccctggtacttactgggcaggtgcgtatcgtcaggagctcctcaccctgccctgtgagaactttcgtatgtgtgtctctgccatctcctcctcctcccattcctgacctgttgagccaggggtggattggcaggcctataaggcgcctttcacattgagggtcttaggatttgcagtccagctttgcagggagcggcagtttgtcatttgtaggaggaaatttcacgatcataaagcacggcatgcatcctgagagccaggcagcgacgctgcctgcactgccccaccgctcagagggccacaggagcagggcttcctccttgcctctgagcagtggagccaaggctggaggtgggcgcagctccatgttctcgggggatttcttcactgtgtttcttgggggctcaccgactgcagccgtattcctggagagagaaggaggcctgtcacagcatctgtgacagcccggaaggaaacagcagtccatacagtcccctcaggacaggcacagaggactccaccctggagtcacaggcttggtgaggtgggggacaggcaggggtgggccccgaggtgtgcagagtgtgtgttcaggcttgtcttcctgccgcagcgcagcagccctcccatgcctgggtcctggcacctgcccctccactccccatgcagcttcatcctccagggcgtggtctccagatgacttacctcctagatacagacaagaccccaaacacacacatgggagccctgagcccaccctggggcagggtgacacatgggagcaggtcagtgccctgtgtgtggcttgccaccatcatttgggaactattcttctgtcctaggtgagtgcccaccctgtggcactgagacccaacagctcaggtgacagtgacacctgcagcggaggctggggaagcatcagagcctctgctgtggtggacgccaggtggcccctggcacagagagcgtgttcatcgctggctcctgccgccctcgaggacttgaaggctgacgttgggctgggtgtggctcgtacataggacagggcccacacactggattcacgtttttcctcacaacttagaatagcaaagttacagactttggattcttacgaagacaagaatgaatgtcttggctaaccatgatcttacccaagaggacttaaaatgaatgtgcaggagaaatgagaagaggacttaagatcaaaaagagagtgactaggaggtcagagaggcagccgcccaccccacgcactccctgcttgtaagccggggccgcattgttgtgttaccacacttctgttttagagcctgttacggttttgagttacacagacatgtgtgggcttgtgcatgtttgaatgccctgtggacccggagctctgtgaggcaaaggctgggactgtcttactagccagcgtgctccttgcacctcgatccaaggggccacggggctcccaggaacattcaccgagtaacttcagaaaagtgaagagcagaagttccaaaagcacctggtgcttcctgggagaagtcacctgcacaggtaccttggatccaactgacaggtgagatgaacgagctctccctgcgtgcgcacgtctacgtacgctcgtgtatgctgaggagcaggcattggaacatgacggagctgctgctgctgcagccgcagataccatctcagccggcatggcgcatgggggtggggtggggcagtgagggggggcccgctccgagagacagacaggtcaggccggaagcgactgtccgtgaaggtgacgctcataccgtaaccttagcagcaggctgttgccacacagtcacaaaagtgggaggcagcagcagagcaatgtggccacaggcactcggactccagagagctggcgagaggctttcctggctgaaagcagtgacaagtatctgggtctgggggacaagggaaacttggaaatgacagaaaagcccaaaaatcaagtccccacaacctcccccagcgatgagagccgtcgtagccatgggctgtgcatcatccttacacgcccgcgcctgaagatttatgcgcgctttctgacgaacagcctttgcagcttgggctttgttgctggctggatgactctgagccctttgctttgcttctctaggcctcagttttcccatttgtaccattagggtattaatttaaataacagaagcactctatcgtattctgaatgggacaccagttaattctggaacattttggaggtttcccattgtttcctgtgaaccccagagagagtttgagaaacagatgataaagggaagacaagatcgtaaagtgtgatactgccatcgaaggtctcgagcctcatagttggcgctttaagcaaaataggcggttaaaaacaggtctacacatgctgtgtgtggacccaaaccatgaacacatgctgggccccagcccgtctgttgctgttcccttggtcttggcgtcctgtggtcctcacgtgagctgcacgcagcgagcagagccctgacttccagtctggatttctgtaaagtgatgccgggcttatattatttcaaggacttcatggttacttctccctcctggagttgctctatggctttttaaagcagctgactttttatccatcttctcaaagtattcagcttcattttcacagaaatgataattctcatctctcactcaaattttatgtttgcataaattttcatcagacacataattacagtaagtttaactggaaaaaataagagagactctcatgttaaaagcaaaaaggcccaggcttctgaagagacgcgccttctcccgtggtgtttgtcatggcaccagccaacacagcaagatggagccaccagtccagccagggagcttatgcagtgtttcaaacaaggcggcaccagcacagaaatccacaggccctgcagtgggaagggatgaatgagtccccaaaaacagatccaaataaaaataaggacggagaaaaggaaacaccaagctaacaggaaggggtgttctaagacacaaagagctatttggaaaacatcacataagagcctcactttcacccagtatcagaatcacttccagatgtaaatgccagttgtggaaattcttaggaaagtaaggatgcttcagcagaatgaagaatcatctattttcagccagcagttatattcaattaattttttaaaaaatgaggggaaaaaaaaagcctgtatgtctaaacagcttttacaatcaaataggaaaaaattctgatagtctagtagaaaaaagatctgcagtgcgaataattcagaggcaaaaatgcccatacggtttttaaagactcaccctcactgcctgctcacaggcatcgtgtccgccgaccgtagaacctgaaatccgtagtaaacacccctccagcgctttggttcagctcagctccagcgaatgttaggatgtgaggcttcgtgttacagtagaaaggagcgcactcataggcatacagaacactgtgcaggtctaagacttaggagaagacggagatttctaggctgttggaatgttattttgtatatgcgagtttgggtagcttaataatagagattaaataaaagaaatgcagacaaaacctacaatggagtgccatttttcagctgtcactcaagcagagaaaaggtgacagacgtttattgtcggtgggggtgtagatttgtgccagcgatgtggtacttgtggagggccagcgggcagtctatcagtctaaaacacacgtgcctccaacccaggatgtctgctctcatttactagtatatgggtgaacatagccacatagatactcatcatagtacagttttagtagtagcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgtatcggcacctaaaagggcaggtaagaaggaccagtggccagcacagagaggggaactggaaggacgaggtcgcagacaggagtggctgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccgtaacatctttcccccgtagagacttgcatacccagtactgctgtgtctcgtgggaggctgctgggtcactaagcttttctggctttcatacgctgggtatttaataatcaccttaggatatactcagtcgttctttcttatttacttcctactgatggagattttcctacattttggcagcctgggaagaaaagcatctatttttttccttaaagtccagcagaattttatatatatataaaatatgtgtataaaataatttttctagaagctcattaaatatagatgtgtaaaactaacaatttatttcatttattaattttcctgacaatgaactacttttcatgctctttatttttcattacttgtcttctgctatttagctataaatccttatagaagagtataaataaataaaagtaattatgcaggaggcagtcatagtgaaatgctgcccactgtgatagcctgtgggttttttttaataaaatgccaactcagtttttcttaatattctataaatatctgaagtgaaattaaaccattgcgcatggctactatagatattttcttgcttctatccctgttttttaaatgtgcctttgctgtttatggtatatttttcctgcacatcatgactttgaagttctttacttactttccaaacccatttttaaaaatggttttattgtatgtcaagagaagaaggaagaaagcaaaaatgttacccaggattccaccatccagaaatagccattagtgaacatcattagcaaagtggaaaacactgaggtcatcgtgctaaataaaaaggaaagaaagaagcttgttatctgtggaacacaaagatcatctttatgcacgaatatcaattaaaatgttggatgtgtctctagaaatacttacgttaaagtggaaataaacttaattttacttaaacagaagagcctgcaatctaaaaatgaagtaactgtcgaacttcggatgaaagtttcttttatgcctaaagaattcagttctgaaaaaaggttaggagaacattgagaggttgtcattgtagatattttttaaagctgtgtatttttcctgatttttgttagaattattcaactttttctttgcatttaatatatctcgaacatctttgtattaacagtgcatgtgtatctctctcttctagctgtagcaactacctagtatcctgttgtatagatttattgtgaaacagccctccattaattgataatttgattatttgtgacttcccattatttctacttttccagtgctgtaatgaacattattcttttttttttttttttttttttttgagacagggtctctcgctgtgtcaccgtcttccccttcgggctgaaggagcgcatcacgttgttcat

SEQ ID NO: 862 - DNA, 6436 bp, Homo sapiens
  misc_feature (1)...(6436): n = A,T,C or G
ccctttcgcccgaggtgaatactgccttggggaggacctttctgggttgaatctattgggaaacttcaagcttcctggatctggatgtttatatctatttccagatatgggaacttctcagctattatttcattaaataggttttctatgtcttttctcttctctttttctttggaatacccataatgcacactctgtgtgtgtgtgtgtgtgtgtgtgtgtgtgtgtgtgtgtgtgcgcttaatagtgtcccatgtcttacaggtttttaaatatttttcattcttctttttttttcctctgactaggtaatttcaaatgacctgtcttcatattcagaaattctttcttctgcttgatcaggtctgctggtgaagctctctattgtgtttatattttattcattgaattcatcagttgctggatttctgtccagttggtttttttttctatgatttctatcactttcttgaatttcttgtacatattctgaattgctttcctgattttggtggattgtgtatctgtattttcttgtatactggggagtttccttcaggacattattttgaattccttttctagcaatgaggtgattttcttttcattggggtctgctactagagagttattagatcccttggggtgagtcatatttccttgctttttcatgtttctcatgcccttgcattgatgtctgtgcatctggtggaaaaaccacctcctccaaattttgagagtgccttgcatagagaaagactttcacatgtagttgggttggttttaatgtgctggttaaaaaggatgtggtgactctgtttccagataagtgcagtgatatagtccctactcagcttcttcagctgtgttgaatatcagcagtaactgtaggtgcctcagttgtctaggctgtagaagtttgtggtagcagtggtgccagcatagatggttaatgtccttggtatcaaaggacatttggttttgatacaataaattttgacattaggttttgggatcctcctattcctgttttccccacaataggggacttaggtcagggcatctctcttgatatcagtctgacatggcctataagcagctccagtgatgctgggttccagatgtaggtgcttgcagcagctatggatccagggtcctaggctcagggtctcacaagcctattatggcacctgggttttggggtctaggttcattctttgcggcagggttggatgttggttgcccatagatctgtgactctgagacactccctagcagctcaggcctgggggtctgggttgtagctgtgattctacccctcggggacagggcacagcaccggcccaactctggggaagaagggttgtcctgggggtttgggcctcaggatcagggcatgactgcaatttggtaacctcagccagtagggctcagtggcaacttgggtcccgggggatgaggcaggcaccaggtggtagtgacactagactctgggatggtgaggcttggcagtaccccacactctgggaggccaggtgcagtgatggcaaggaccccagatggtggtataaggttgtcatttgggcccttgaggggtagggaataacacagcaatgcctccacttcccaggtagagggctgtctcagcccctgagactctagagtgctagtccagctccagggaagcaggtactaaagttgtttggcctgtagggtaggtgtctccgctcagccactgctgtttccctggaatgtggggtaccatctcagctcagctctgggatgtgaagctgttcagcttggccagggcactgattcctcaggaagcaatgtgctgtttcacctcaggcctgaggggtgtgactgttctgggcagcccaggcacggtttcctgggatatagggcactgcttcagctcaggcctggggtgcgtgactgctctgggcagcccaggcactgtttcctgggatgtagggcactgcttcagctcctgcccaaaggggtagagggaggggtaggcagagtggcttcacgtccacctggccccaccgggaaggctataacagctgcaccagttctgcttggggatgttgggccattgggctggggtggttccacaggagccacccttattgttccagaccatgacacactccagccatgcttccagttccaagatggcagagcacagtagccacgtgggccacgggggtgggcactgtgttgcttccttctctgggggagcacagccacgtagactccaggcagctccctctgctgagcttagtgcctggggggactacagggaccccggtggtgagggctgtgggcgtccatggtggtggtgagggctgtgggcgtccatggtggtggtgggggctgtgggcgtccatggtggtggtgggggctgtgggcgtccatggtggtggtgggggctgtgggcgtccatggtggtggtgggggctgtgggcgtccatggtggtggtgggggctgtgggcgtccatggtggtggtgggggctgtgggcgtccatggtggtggtgggggctgtgggcgtccatggtggtggtggggcctgtgggcgtccgtggtggtggtggggcctgtgggcgtccatggtggtggtgggggctgctggggtcctcttgctttcctcctcaccccagggagaaacttctcgtgggtcccagctggtcccagttggggcatggggtggtgaaggcccagcatttccttcccgatgtggccatcctgagtttctgtgctcaccagcatttctgtgactcctctgatgcactccaccgctctctctctgttactttcattccagtgctgttgtgtgttcattgttctggctgtctccacgaggggccgagcacaaggggcttctagtcagccatcttgctgacccatgtatatgtgttttgtatggttgaaagaaggccatgatcaaagtgtgatttcacaaataacatggtttaattgccatacaaagagactccttttttcacaatgctcaaagatggggaggatcatgagaacaaatatctcagggaatacactcaacagatgaggtacgttttgtctagggttcagttattaaagtccagttgctctagggtggaagcaggctgctggggacgtagagtctaactgaagtttgaggtgcacctttctatgagaagttattgggagagacagtttgaccagcacagcagagatctggggcgacgcaccaggtccctcaacactagcgagtggtgttgcttgtggacgaggcttcaaagaacagatcagaggctgacagagtagcccagccacagcctgagctgtcaatgtgtctgttgaaattacggatgtatatgtgttttggggtccagtactcacatacgtggtctgataaggtgtgatgtaagatcttcctgggcttgggcttattctccattttctcatcacagcaaagcatgtgccactcatgtagcacacgaagtgtttggaatcatgtcacagctgcatggccaagtggcctgcagggtccatccctccatggatgtcaagccccacagtaaacccaaaaacctatgtatttaagttttttgggattactgcttcatgatgacaaaataagcagcacgagctccggttttcccattttcctgggcgatttcatagctaatgtatttcttcacctagcctttcttctaagtttctttgaaatccggtgttcagagtgaaagcttgtaaacagttatgatgaagcctttttgaaaacagctttgcatttctttcccacctgggccaaggcttggctcagatgtataactggcaatttttactcctcataacagtaccctgggtagatcaattgattgaccttgatgtttaactcagccaggttgtaccggaggctctgttctcactccttcccttactgactgcacaagtttgccatttaaaaatgcagctgtgtctatttcactcctcaccacattgtccccagtcatcatttctctcactaattggcattatattcctgtttgactctgcagcaccgttcatgaactatttaatctctgtcgagtcatgatgatacattcgggagggaaacatttgagccggatgtgccctgtgggactaagaagaaagaatgtgttctatttgtgcaatccatcagcaattgatcatggactgtttttgtcttctactgtcttgaattctcatttcatctttccttgttagactcattagtgaaccagaatacacacattcactctgaattcactcaaaagggacctcacagatgtggctgagggtcttgaggtggggagatgattctggattcttcatgtgtatccaatataattgcgtgggtgcttatgagagggaggcaggagtgtctgtgtcgggagaaagtcatgtgaatatagaagcagaggttggagtgatgtggggtggcctctgggagctggaagaggcaagaaatggactctcccttagaccagtggtcccagcctttttggcaccaggaactggttttgtggaagactgttcttccatgggtgggggtggggatggttttgggatgattcaagtgcattacatttattgtgtactttatttctattattatattgtcgtatataatgaaataattatacaactcaccacaatgcagtgggagccctgagcttgtttccctgcagctagatggtcctatctgggagtgatgggagcagtgacagatcaccaggcattagattctcctaaggagctcacaacctagatccctctcatgcgcacttcacagtagggttcatgttcctgtgatcatctgttttttaaaattcttttgagatggaatctcgctctgtggcccaggctgggagtgcagtggtgccgatctcggctcactgcaagctctgcctcccgggttgatgccattctcctgcttcagcctcccgagtagctgggactacaggcacccgccaccacacccggctaattttttgtatttttagtagagaccgggtttcaccgtgttagccaggatggtctcgatctcctgacctcatgatctgcccgccttggcctcccaaagtgctgggattataggcgtgagccagcatgcccggccagcatgagcttctccatggcagcaaaggctcctgcagatggcggcatccagcacccacattcttagggaaagtcatacccaccccgcaattctaggtgcttccaaactacctgtcaaatgggaaggcaaaattaaggcattttcagatatccaagaatttaaaaaactttgtgttcctatgtaccctttcttgggaaactactggaggatgtgctccagcaaaatacagaagtaaacatacaagcaacaagaacaggaatgaacacaggaaagaaagagaagtcacagaaaagcactggctacaggctcagaacagtgatgttccaggcggggacgggggacagggaaacccagctgtcaatttcaccaaatgcacactgcaaacaaacgacccacatgccagagaagcttgctccgcctgggtctagcagcagcaaatgaggcatcaaaagtcaagacttgcttaaaagatggcaccattacatgagtctacactgcaacaacgctgtaggtcctcagctaggaaggcggcacagctccatctgagaaccacctctcaagggtgatcttaacttgcctgcattcccttccattctttctccacatgcacactgacttctcagagatacaaggtgggctgcactgcaaagatgatgtgcatgttcccaatactcacctgagatctnctttccaattcaggctaatggttcaccaatatatgcagtcatctgtaatactacgcatgtacatgtattagtgtgtcatacagaacatgcaatatgtagcaaatttcccagaccataaccgatgtttgtttatttccattaaattttcaagctggattctaggaggaagccgctgagagcagatttaccctagcagggctggtaagccaggaagcggcccactctgaagcccacagcctgacccgctgccaagagtcgccattccctgcaggcttattcggctgctggatcaatgtcagaataaattgttttcatggcaattccactatttaatgtaaaattctacaatactacctttttttttttgccaaaaaaaaaaaaagccttactaaaagtttcattaccatctgaagatgcagatccctgaaacaggtatttttaggtccttcagactgtgccagcctgcctgatttgagaatcttactctgcctatagttagagtgctgccttattcacagtgaagacctgcaccccaggagaggtccacattctatgcatgtaaatgtcaggcgtcttcaccacggggctgaaggttcgcgcggcaactacattccaa

SEQ ID NO: 863 - DNA, 7369 bp, Homo sapiens
  misc_feature (1)...(7369): n = A,T,C or G
ttaacgacagcgcggatccttccggccccgtggtgaagacaccccagacccctaatgggggcagccccttctttcctccccatcccctgcacctggcagccgcggggcctttgcactgacaggctctttgccactggagaacacgccctctcaaggctctccctgatgccccctagtcaagtgctgacaccaggggtccatggaccaaggttggctgcgaggttggccactgggtgcctgtgaacgtgcctggggggtcacctcttcctttttgctaacctccagcagaaatgtagtatttccttcactgatcctccccaggcatcatccaaaaaaggataccttggtagcacaaccactgggtttttttggtttttttttttttgagacggagtctcactctgttgcccaggctggagtgcagtggtgcaatctctgctcactgcaacctctgcctcctgggttcatgccattctcctgcctcagcctcccgagtagctgggactacaggtgcccaccaccatgcccagctaattttttgtattttagtagagacagggtttcaccatgttggccaggatggtctcgatctcctgacctcgtgatccgcctgcctcagcctcccaaagtgctgggattacaggcatgagccaccgcacncaataccnccgcttgcctttatttatttattttaaagattctggatattagtgagatcctgtgatgtttctttctgtgtctggcttgtcttgctggcatcgtgacccctagtccatccatgtggcaaatgcaggatctcctctgtttttaaggctgaacaatagtccatcacctctctccacgtgatcatatacaccacagtctccttatctgtccggccactgatggatgcccaggtagttccctgctttggccgctgtgggtagtgctgtggtggacgtgtgagtgtggacacctggatgggtggtgagctggattccttcgggtacaggcccaggggaaggactgtcaggccctgtggcagttctatttttaatttccataatggctgaagtgcccatacaccttacactcactctcctctgtaattaacattttatcttatcatggaacgttggtcacagtgaatggaccgtaatgatacattgtcattaagcataatccacacgttattcaggttccctgagtttttctctaatgtccttttttctgtgccagggccccgtctggatctcatgtgacatttatttatttataaaatgtattgttattattattttgatacagagtttcactcttgttgcccaggctggagtgcaatggcatgatctcggctcatgcaacctctgcctcctgggttcaagcgattctcctacctcagccttccgagtagctgggattacaggcacccgccaccatgcccagctaattttttgtatttttagtagagatggggtttcgccatgttggccaggctggtcttgaactcctgaccgcaggtgatccacccgcctcagcctcccaaagtgctgggattacaggcgtgagccaccgcacctggccctaaactggggattttgtttgtgttgagcacgtttttactttctgcaactataaggttgtgtgtttcctgccccagtccttgttttgtgtttttttgtttggtttgctttttttttgtttgtttgtttttgaggcacggtctcgctttgttgctcaggctaaagtgcagcggcatgatcatagctcactgcagccttgacctcctgggttcaagcagtcctcccaccttagcctcctgagtagctgggaccacaggtgcatgccaccatgcctgggtaattttttatttttagtagggacaaggttgcccaggctggtctcgaactcctgacctcaaatgatccgcccgccttggcctcccaaagtgccatgattacaggcgtgagccaccatgcccagccctgtctctagtaaaaatacaaaaaattagttgggcctggtggctcgtgcctgtaatcccacctacttgggaggctgaggcaggagaattgcttgaacccaggagacagaggttgtagtgagccaagattgcaacaccgccccccagcctgggtgaaagagactctgtgtcaaaaaaaagaaaaaaattagctgggtgtggtcatatgcacctgcagtcccagctactcgggaggcggaggcaggaggattgcttgagcccaggatgtcagggccacagtgagctgtgactgcgccactgcactccagcctgggtgacgaagtgagaccctgtctcaaaaaaaaaaaaagaaatagggtctttgtggatgtcatgaggggttgacatgaggtcacactggatcagggtgggccctaaatccgaggagcatcctggagacacgggagaggaggctgcgcgcggacagggcagggtggaggcagaggctggtgattccatcgagggctgccagcaactgcacagctggatagaaccctggacagatgctccctctacctccccagggcaccatccagcctactcctttgcagggactcctggcctccagagtggggagagagctcctgctgctgtctgaagtaccctggtttgtggatatctacagcaggcccagacacggagacatgggggccccactcctcaccctggccacgcacccgcctccacggagaccccgttccccaccctggccacgcgcccacctccacggagaccctgttcctcaccctggccacgcacccgcctccacggagaccccgttccccaccctggccacgcgcccacctccacggagaccccgttcctcaccctggccacgcgcccacctccacggaggccccgctcctcaccctggccacacacccacctccacgacaggttcctcttgttccacttggtgggggctggagcctggcgtctcctgcgagcctgggtcaggacagggaggtctggcagggagcagcgtggggttttcatcagggccagggtggcctcgtctgcagggaaagcatggagctcagagcctagcccagctcactccccaccctaggatcccgagcatccccaagggtgggagccctgactctggcaccagcctccgagccgccccctcctcccacgtcatctttgggggaccagccccaggctctgagctacaccaggccaggacccaggttcattcaagcataagacgggactgtgcctgatcagagggggcatggccgacgggcgcagacctgacgggggccacggcgctcccgctgccccctggagaactgacccaggatgccggtggcctccaggccaccaaactgctgcatggctgtgatggccttagacagctcctcttgcgtctgcagctgccctgttgtggggtcagccgggggcaggtaaccgaacctgcttagccactcctgagggcagagagcagggtgagggggtgcaacagagggcccggtcctacccagtgagaagcctgccacgggccaccactgcttccgggcaggccccctcccagccccctatctgcccacaaggcacctcttgtctcttccctgggcagctgccggaaaagtgtcttaataaacctgatgtccctggccgggtgctgtggctcacgcctgtaatcccagcagtttgggaggccgaggcaggcggatcatgaggtcaggagatggagaccatcctagctaatatggtgaaaccccgtctctactaaaaatacaaaaaattagccgggtgtggtggcaggtgcctgtagtcccagctactcgggaggctgaggcaggagagtggtgggaacccaggaggcggagcttgcagtgagccgagatcgtgccactgcactccagcctgggcgacagagcaagactccatctaaaaaatgaataaataaataaatctgatgtcccttagatggtgtgagcttgtgccgtgcacgacctgtacaaccactcatggcaaccctgccccaccccacgcctcctgagaccgcaaaatgctagggaaccttcaaaaggctcttaaatgtggccagtgtcaaatgcaggctctcagctgacttgtgacagggaagtctagcatccaaggtctgggaccccagctgagaaaggctgtggctcagacaccagtttaaggaattgggccatgctgtacattcatgggggagataagagcccaggcttggccggtgctgtggcttatgcctgagatcccagcactttgggaggctgaggcgggaggatcgtttgagcacaggagttgcagactgtgtctgcaacagagcgagaccctgtctcagaaacaaaagccaggttccagccaggctgcctaggttcaaatcccactcagccacctccccgctgtgtgcctggggcaaggcagtccacccctctgggctccttcctcagagtccttggcaggctggtgatgaggacgtgagccaggacgtggaaaatgttcacaccagcacctggcgcaggggacagctctgctctgaagggcccactggggtgggtgcaaggctacccacaccggagctgagtaggagcaggaatgagggcagccctttaacctgggcataaatcaagccctggccccatgccccagtcatctctgctaccctggaggggccctggggacaggggggcctggatgccatctgtggggacctgggtgccatcgtggggacctggggatggcaggcctgggtgccatctgtgggggctacctccacccctagcttcagtttcttcaaccgccaaatggcgcctgtgcccacttgcaggctgccatgaagctgctgctctgccctgtggatactcgccagcccagggaaccacagcaggggtgaggcgggctccagaaaggtacaagccaggggtgatgtgctgggggctctgccctgcctgcaaacctgtctttttttttttctctggacatttagaaaatgcttgtgaatcgctattatttaccacctctcatgtattcattggccaaatcatatgaaagtgcccatttttgaccatttctgatttaaaataaatactagtagtttcatgtggcttaacctaaaaaaatgcataaatgaaaaaaacataactttttaaagaaatcctaaaaaaaaaaaaaaggaaaaagaaaaaagaaaatgcttgtgactcatttatgccacctgctgggcctccaggttctggtctgcaggagctggtgatggggtggtcctggccaaccctcctgcccaccagcaggcagtgctcagaggaatgaggcaccaccatcctggaagtcccaggggcatcagcaacaggccgtgctggccaggaggggcctcacaagacactacatgggatctgcacaccccgagatcccccttccaggaagcactgagtccttcccggggcccccctctgtgcctttaccccctttccaaaccctactgacccagcccagcccctcagccccttggggaagccaagagtgtgtacagaactgggggcccctccaaagctataggcacgacaggacgtcaaagtggacgttcatgactggggtgggcagcttctctggaggggccttgggggtgacagccttggccttgacaagctggcctcccacttccgccctgacctccagggtgtggggatctttggccccgagcatccggtcccacactaccttgcacctgcagggtttactgagggtgtcccatgatcagtcaccgctgtaggtgctggagatgcccatcagcacattctgcactttttagtcctttgttaagatcacagctcaacagggccactgtgcctcatggttacaatagcctgtcacctcctccaggaagcactctggagtttcctcacatcatctatgatattggatgatgaccccctgccccctcaccagggaagggtccacacaggcaggtgcctttcccacccaggccagctgctgcctgggttgggccagcaggtgctgagaccccttgggaggacaactcaccccccagccttcccgtctataagctgaggtcatggctggtagctgcactgagtggcccatttactctgtggggttcacggtggcggtttggggcaccccccactctggtccccagggagctgggcagcctggccacgaggccacatgcatttcaggaaagtggagccgggcctggcaggcagcactcccagtggctgtggaatgttgcccaatgtttggaagcaggtggtttagttgcaggtgtgagcggccagcctgcttcaactcatagaaccagggccccggcaccagcccgggacaggcagccccgcccatgataaacaggcactgtcgcctgtggccccagaggcactggaatttgagcatagaatggcatcgaatcttggggggtggtgggtctgtggggcagggctggtgggtgcctcctacctaacacgagtttgtgctcagggggctgtgccccaaatctcaggctaggcatcctgggaggggccgtcttgggggctggagtgagagggtgggaaccacttcctagtttgccagggacaccccaacagaacaagccttgcaggtttgggagccaccagccttcgggtggacacaggtagaagtggccacctgccccagggggcctcctgagcccacgaggcgccctcgcccagccctgacctgtcctgtgctcccagtgtgggtggaggcgcggctgtggggaggcctgagcctgcagggaagaggcggcaggcagctcaccaggcagctcaggtccatctgggagggggcggctgattcctggctagggcttggaaatgttgacccaggctaatggggtggtggtggtggcaaggaggccttgttagctaaagggagtaggggttaaccaggcttgaagcccagtcttggggcaaacccccccactgcagccagcagctcaggcaaatgtggctgcccctccccacccctcctctcccgccaggcctctaccctgacccactcccacccacagtgggtagggggatgcctgctgtaggatggccgctggggtgggggcccagactccccgctccaggtgtccccctccctgccccctgcccccagtacctacagaagcctgtgcgatcccacgtcaggacagggagggccgctctgcatccctggcgaatcctgactacgctggcccaccgctccacagcccacgccgaccgccctgcgtcctgccgctctgactgatcgtccacggcagcacccgctgctcctccagaggcacacagcaggactgccggcgggacgggctgcctgacagacacgcagacagggatcgaacccttcacagcacaggccacctggcgg

SEQ ID NO: 864 - DNA, 8397 bp, Homo sapiens
  misc_feature (1)...(8397): n = A,T,C or G
ttgacccgccaatgcgccaccgcggatccttgcggccccgtggtgaagacggcacggtggctcatgcctgtaatcccagctctttggaaggccgaggcgggtggatcacctgaagtcgggagttcgagaccagcctgaccaacatggagaaaccccgtctctactaaaaagtacaaaattagccaggtgtggtggtgcgtgcctgtaatcccagctacttgggaggcagaggcaggagaatcgcttgaacccaggaggcagaggttttgatgagccaagattgcagcattgcactccagcctgcgcaacaacagagaaaatacgtctcaaaaaaaaaaaaattatctttggctacaaagatcaataataaaggcaatgccagtccaaggttagacaggcaattgctgggtagatattttcacaatagttttgtgtaaggtttcaatggcctttgtgcaaggttgtgttttttgcgcttttattttttcatttttttcttttttttcatgaatccatctcagtccatttttgcagtcttttctgatagtttttgttttcaggcatttatgcacgacagcctttctcttcatggccttcctcaggcctatttgccagagtgtttggttttatttgtttttttaaaacagaagtgattctgacaacaactttcacaaaatcaagatctcggcactaggtgtgttcgttcctgcttgggcctcactggtcagctgaaagaaatgtgtgtgtactaagccctgcacatactcatacacagatattttcctacgcaaccacctgtagctatgttcagctgcacgtgagttcacactgacgtctccagccctcctccatcaccacatggaccatgctaacctctccccttgcttatccgtcaccctgggagtctctttgtccctctctcttgctctccctcatcccaactgtggagcccaggaagcagcttcctgagtccctctagggcctcccgctgctctgtgcactcttgcccaggccccccttgctgtggacttgactcgggcctctctgcttccagcctccccaccctactctccccaaagcacattctgagagctctctgaagcacacgcaggcctgaggctgagccctcttttgcgtccctttcttcccaggatactgcttggggaaaggacgtgctcgggacccatctgtcagctgaatggaggccgggtggtgcccggctggcacccagagggcacttcatccgcatgcatgctgagcccctacggggtgccaggctctccgctgtcctggaagctggggccaatctccgaagagaacagagctgccaccctccagaagctggtgggtcctgggtggtggtggccgaaagggacactggttactgcaagcttgtttctgcttttgcacttttttttttttttgagatggagtctcactctgtcacccaggctggagtgcagtggcgtgatctctgctcactgcaagctccatctcccaggttcatgccattctcctgtctcagcctcccgagtagctgggactacaggcgcccgccaccacgcctggctaatttttttctatttttagtagagacggggttccaccctgttagccaggatggtcttgatctcctgacctcatgatccacccacctcagcctcccaaagtgctgggattacaggcgtgagccaccacacccggactccaacttttttcttaatgggggatttcacataaaaatccatactctgagcttctcatcaggcatccccagctcgtgctcctgcagggtgcgaccggtgcacccaccctgactctcaccacctccacctctgcagcatcctcacatacaggcctggcccctggcggcacctgagcttaacacttctcgtgtagggaaaacactgcgctgggactcttgaagaatcgggctgtcttcacatgtaaacactttgaggttcagaaaagcggaggttggatgcagagcaggtcagtgaatcgggaacttggttgccaagaccgcctgttccttgtggaaggaaatcatgacggagttgggcttgatgtcttagggaaagaaaaccctttcccacttcgtttctgcctctgacatggaaaagcacctcgggtgtgggaaaggatgtccctgagtaacaagggcagttagatgccacctttccaacatggttctttcatgtttgttcaacccccccacacagatgtaacttggcaacagcagtaaatactgcatggcctcacaccaattctacaagtcaccagggtgtccacacacacgtaagtgattacacgtgtgcctaagttaaatccccccctcaacagagacgccgaatgcttttgcaatggtgtaggccacagagctagcactaaacacgttggctcacttgtcccgtggtcaccactccctgcccctggtgtccctccctggccccttccctggtcctggtttccaatcttgacactcacctcttcctccatcctttctcatttcactagcctaaaggtgacaacgttggccacgctgattagcaatagggtccctgggtgtggcccccacgtgtgaaaatgcccaatggcaaaacagtctggtccgaacaggcacacctccatggaaaagcgtggccgtatctcctcaagcaggacgtacgcccaccctccaacccatcagtcccacctgtggtatataccagcacaaaaacatgtgaatcgtgcaccaaaagacatgcacatggccgggcacggcggctcacgcctgtcatcccagcactttgagaggccgaggcgggcgaatcacctgaggtcaggagttcaagaccagcctggccaacatggtgaaactctgtttctactaaaaatacaaaaatacaaaaaataccaaaaaaaattatccaggcatagtggcaggcgcctgtaatcccagctacttgggaggcagaggcaggagactcgcttgaacccaggaggtggaggctgaaatgagccaagatcgcgccactgcactccagcctgggcagcaagagcaaaactccatcttaaaaaaaaaaaaaaaagacatgcacacacatgctcacagcagcgctatttacaactgccctaaagtaaaattactcaaatgcccacagactactaaatagacgatggtactatcataatgggccattattcagcagtgagaatgaacaaactagaaataactgttgacccaaaaggaagaaactgaggcaaaattaatacaagtagagagtttatttgggccaaacgtgaggattgtggcccaagagcacacattcaagtttcccgaatatacactctgattagcaaccgttacaagtggatttttaaaggcaaaaggaaacaaggagtgggctgataaaagttatgtcaagaattatctggccaggcgtggtggctcatgcctgtaatcccaacactttgggaggccgaggcgggtggatcacctgagctccggagttcgagacaagcctgggcaacatggcgaaatcctgcctctacaaaaaattagctgggcctggtggcgcatgcctataatcccagctacttgggaggctgaggcaggagaattgcttgaacctgggaggtggaggttgcagtgggccaagatcacaccactgcactccagcctggcgacagagcaagactccatctcaaacaaaaggaaaaaagaattctcattagtctacagaaataacattgattagtgattggctgtaccttgttacaaggtagggtatgggtcacagtgtccagtgtggcgttactaggttaatttacagctacttgtggcaacagcccacagtttgaagagacgagtacacagctcgaagcagggaggagcatgtggctgcccctcattctacggtctctctgggcctgatcattaaaaggacttgcatccctcagcctaaagttctttacttttctcataacattcctcagcctaaagttctttacttttctcataacattcctcagcctaaagttctttacttttttcataatataccatgatttgggaaaatctcacaaacataagtaaaagacaacagatttagaagcatgcatactatataattccatttacataaaatataaaaacaggcaaaaccaacttaccatgataaaagtcagggtaatagttacctttaagaaaaaaatcagcatatcaggtaatcagcatatcgtgtaatcagcatatcaggacatatgaaaagtccataacttttttgttgttgtttgtttgttttggagacggagtctcactctgttgcccaggctggagtgcagnggtgtgatttcagctcaccgcaacctccacctcccaggttcaagcaattctcctgcctcagcctctcgagtagctgggattataggcgtgcgccacctggataattttttgtatttttagtagagacagggttttgccatgttgcccaggctggtcttgaacttctgatctcaggtgatctgcccgcctcagcctcccaaagtgctgggattataggtgtgagccaccgcgccaggcccagtcaannactttcttttttcttttttcttttttttgagacggagtctctcgctctgtcgcccaggctggagtgcaatggcttgatcttagctcactgcaacctccacctcctgggttcaagcgattctcctgcctcagcctgagtagttgggattacaggcgcccaccaccacgcttggctaatttttgtattttttagtagagatgggggtttcaccacgttggccaggctggtctcgaactcctgacctcaggtgatctgcccgcctcggcctcccaaagtgctgggattacaggtgtgagccactgcacccagccaagtcaactcctttctaagcttgaaaattttcgtgaagaagaaatactgtatatgagaaaagaaaaaagaacatactgggaattcctgtatgtttacttaaataatcttctcagacctttttctttattgctatgtaatacatacataataatatacatagcacatataaacagcataattaaataaggaacaccctgtaaatcaccacctcacccaaaactaagaacatctccaatttattttttctgtttgttctgagacagggtctcgctctgtcgtgcaggccggagtgcaatggcaggatcttggctcactgcagcttccacctccctggctgaagcaattctcccatctcagcttcctgagtagctgggactacagcgtgcaccactatgactggctgttttatttttattcttactttttgtagagattgggggcggggggggtggtctcactaagttgcccaggctggtctcgaactcctgcctccagcgatcctcccacctcagcttcttcaagtgctggggttacaggtgtgaccaccgcgcccggcccagtcattttcattgtcatctgtggtcctcccatcccatcctcccaacctccccaaccaggctactcatgcctgagttttgcgcttattattcctttgttttttgttatttctactgaagtgtaaccgattctcagtcaagtgcactaatatgaagggcacagcctgattcatttttgctcacatgcacacctgtgtcaccacagcccctcaagatgtagggcatctcagaccctaggaagctggcaggtgccccgtcgttcctgacgagtgagtcactgtcctgatctcagcctctggacattagcgtgcccatccccggactgcacataaatggagtcagacaggactcaccctgtgtcagctgcgagactccccgctgacactgcatcatctccttgcttctcactaaacagtcttaacgcgtatgtgcgtgtgtatacctagaagctatcttagcacgtatgtgtgtgtatacctagaagcgatcttagtgcatatgtgcgtgtgtatacctagaagctatcttagcacgtatgtgtgtgtatacctagaagcgatcttagtgcgtatgtgcatgtgtatacctagaagctatcttttccagctttgctttttttttttttttttgagacagtctcactctgtcgcccaggatggagtgcagtggtgggatctcggctcactgcaagctctgcctcctgggttcacgccattctcctccctcagcctcccgagtagctgggactacaggcgcctgccaccacgcctggctaatacggggtttcaccatgttagccaggatggtctcgatctcctgacctcgtgatccacccgcctcagcctcccaaagtgttgggattacaggcgtgagccaccgcacccggcctgcttgtttttaagctttataaaaatagcaccatagtatagaaaaaaaaacacctgtgtttcacaggaaaactatgcattttaaatcagagcaggtactccagggctgtcagattctagcttttcgttgtctttgagctgttgtacatcacgttgtaggctgaggcaactgacagacagaaattctttcttatccaccaggttccattgtctttcctcccacctcttaggaaaaaaaaaaaacagattttcctgcatttacatattcattttaatattctgttgtttttttttctttttctttctttttttttttttgattttttttgagacagggtcttgctccgtcacccaggatggagtgcagtggtgcaatcacagcccactgcagccttgaactcccaagactcaagccatcctcccgcttccacctctcaaagtgctgggattacaggcttcttgtgtgaattgcctgctcatgttccagcaggaagccgggatggaggaggagccacccctggggggtccaggttgctgctgtgccctgtgcctggaacagagtaggcgctccgccaatagctgtgaggcccaggcatatgccaggggttgccgtcaaaggcatgcaggtgctaacaggccggggccccgggcgctgaggtctccgacgtggggtggaggacagctcattcgcagcggtaaggggactcaactcctcgccggggctgcccgacagacagccagggtggatttcttcaccgtttcttctcagacacgctggtgttatttctggttcatgcatgctgggaaagatgtccctggattgtccccgcccctatttcacctgcggcaacagatggggacatggcatcgttatgaccctgtgaaataaaacagacatctgtcctggccggctgctgtggaaatgctctgttttccaaatgcacaaagcactcatctcagatgctctgagtgggccgtcttgatcttgctgacaggttagaagctttggtgcaggcgctgaatcgacccacctaagatgccagccctggcagggggttgcttggccacagagcagcaggggcctgcgcggtcctgtgttcccctctatgctctcggcccaagtgtcccctcctcagaccccagccactctcgtgacccctaggagccaggtgcagcccgacctcactcctgagtccctcgcccaggcaacctctggacctataggaacacaggggtgagggtggggcctttggaaccccttcacctcccaggcccccagacagcctccaggcctggggtctcacacccaagtgccttcagagaggaggagagcttgcgaaatccctccagccccaggcaaaggcggttctgtgcatttatgcttttgagcaacaaagccgcccccgcaggctcgtgggtaaaaactcccctgctccagcctagaggtctggggtcagctggggaggcccagccccttcacccctccctccccacttcaccctccctcccctttcacccttccctacccccttcacccctccccgacccttcacccctccctccccangcacgactgctgnatcagcaaagacaggcgggggtgtggcagccctagtcatcatcccccaaacctggcagcaaccgggacgccctgcagtcggtgagtgggtggttcaacggggtgcatcacgacgggggacttctattacatcccaagaggaaagatctttccccccttttgaaacacggaaaaaattgacatggccgttttttagttgaaaagaagcctctttctaaggccccaaaccaagtattcctactggtcggacaacctggggaaagggccaaacccttgtaggccgtgaaaagaaccgcggggtggccatttgggttgggcaagatttaaggggggaaaatggaaaatattggggacaagtggcaacctgccccccatttgggtggcgaccacgggcgttctcgagtatctcactgcatttgtgccccagaccccagcaccatgactataggtacaaaatattggttcttacagataacatgggtggttct

SEQ ID NO: 865 - DNA, 5335 bp, Homo sapiens
aggggtgattgtggcgggggcccaaagtttacccttagaatcacaccattgcaattcccagcttggggcaacagagtgaaacttttgtctcaaaaaaccaaaaaccaaaaaccaaaaaccaaccagtactaggggacctgaatcaaggcccggcttccttataagagaagatgcggagatgggggaggagacggccgggtggagacagaggcggtggcacgagggatgtggctgagggtgacactggatgtgggagaggcctgggacagcctccagaggggacccaccctgcctaccccttgatttcggactcgtggcctccagactgtgagggaaactccgggtgtttcagcccagcatgggggtctctgtcctgcagccctgccacccccacctgcccctgctactgtctccctttcctgcccttcccggagacttggaggcaaaaggagtgcttcctgtaacactgccacgaggtggttcctggaacggtgggcacaggggccgaccagggagaggcaggccggccctagcagccacggcccctcacgcttctgtcccgagcctcctccaggcccctggtactccagctgcagcccctttgatgtttttgggactcggcagggctgctcctgcctcgcacggccgttccccgggctggaacactgttccctagtttctgcttgtacagcatctccctaaggagacctctccccattgtccttcatttctgaccacaccgaacggcactggcatcagctcctcctgacttgcgggtggactgtggcctgactagaacgagggcagggctttccatcgttttgccctctgtgtgcctacagcggctgcctcaggacggggcatacagtaggtgctcagagtgcatctgctgagtgcacaagcaaaccagctgctctgtgctcgaccagcctctgggcagacgtagggcttacacgcaggctggaccctctccgtccctccatgaggcggacagagggcccgggaagcccggagtgcgacggggaggcccacccacctttaaagaagacgatcttgtggtcgctggtgcgctcgtacacggcgtccacgctgtccaggtgcagcggcaggccccgccagaagcggtgcatctgtgccggctgcagggacaccaggtgccggtcccgcgtcagccgccagaagtacttgcctgggggcacagaggggagggccgggctgcagagacggtctgcacccagagtgggccatggccctcagccaaccgccacgggaaccctggaggtacctttgaagaagaaagcttcaccccggatctgggccaccgcgtcaaagtgagtgctgcatctgtggggcacgtccttcctgggcctgcagggagagagccaggtgggctgggaggcggggcctgggcagcgcgggacagggcatcctgcggcagagcccctgacctgagcggcatgggacaggcatccttgtgtggagcccctatccttgcctagaggtctgctaaaggcaaattaaaacgggggtgcctgtccaccgcttcagcgggcgggggccgagatctacgctctgagcatacagagcgccagggagctgcggggagggcaggagctcaggggtggagactggtgtagcaccctgggcctggctgggtgccaaacacccacgccacgggaccccacgccacgggaccccaagcccgggcctagaattcggtcctacaagaagcgtgttcacagcgacgtggctgtagcgacagaaggtcagggacaaggtgcatgtccaccgagagacgactcgacacagagcgtggctccttcgcagctttaaccgggagggttacacgtacggtcctgtgacatctggggctgggtggcacaaggtcacagcttctaccggcctctggcaataccagctctcaagacaacttcactgggaatccagttgctgtggggagggtcatgcctcgtggagcagccccagtggccgtcccagttgggcccagccctggcaccagatgtgggccccggcagtgaacatccctcccgctgggggcacaggcccagacactcgcaggccctgcctgacttcctgatgctgggaatccatgagcttgatgaaacattcctcaagctgggctgcttgtcacatggcagtagctgacagggacgagggggagaggaaaccttgtctgaagttctcatttctgtgcaggacccctggcaggggagggccggtatttagatggggtttaagaaaagacaaaatgtcactgggggctcagtcggccacacagctgtgcgtttcccaggactctgagccacgatttggggcaaatgttgcgtgggacagggatgaggacagacagaccccagcgggtggtgaccgtgggcccagggcttacggggcgctggaccggttgtctgggggctccggcagcaggggaggctcctcgggctgcgccgtgggagacacagactcccgcacacctgcgggagacaaggaggaggacggcctcaaacccccgacgcccgcctccccccacatcccaccagcccttctgaatcccagggatgaaaccgaggccactcagcagacaggctctgtgggggcgcagctgcgatcagcgagactgctgcccccagagctgacgtcgaggtgggagtcagacccctcgccgagttaaacactcagtgtgtgagcactgccctgcaattccaccccggggtacaccctaaagagctgaagacaggcgttcccacaggagctcgtacaccagccttcacagcactgttcaccgcagccaacaggggtgacaacccagtgcctgctataggctgcatgatgacaaaactattcagccatgagaataaatccaggtcaaatccatgctaccatggggtgaacctggaacacgctatgctcagtggaagaagccgggccgggcacagtggttcgtgcctgtattcccagcactttcagaggccagggcaagagaattgcttgagcccaggagtttgagaccagcctgggcaacatggtgagaccccatttctacaaaaaaatctaaaaattagccaggtgtgatagtgcatgcctgtagtcccagctgttcaggaggctgagtcaggaggatcacttgagcccaggagttttgagacaagcctgggccacatagtgagacccccatctctaaaaaaaaaaaaaaaaaaaaaaaagaggccaggtgcggtggctcacgcctataatcccagcactttgggaggccgaggtgggtggatcacgaggtcagaagatcgagaccatcctggctaacagtgaaaccccgtctctactaaaaaaaaaatacaaaaaattagccgggcgtggtggcggtcacctgtagtcccagctactcggaaggctgaggtcgcagcgagccgagatcgcgccactgcgctccagcctgggtgacagagtgagactccatctcaaaaaaaaagagccagacacaaaaggttgcatggctgcattagaggcccatctatgaagaaaggaggtcaggggttgccaggggctggggggatgggatgggcgtcgggtctccttcggtggtagtgggtgatgaaaaagttctggaaccagatagaggtggcatccacacaaccttgtgaatgtcctgagcgcatagaagtacacaccttgaaattgtgaatttctttctttttttttttttgaggcagtctcactctgccacccaggctggagtgcagtggtgcgatctcagctcactgcaacctctgcctcccgggttcaagtgattctcctgcctcagcctcctgagtagctgggattacaggcacctgctaccatatccggctaattttgtatttttagtagagacagggtttcaccatgttggccaggctggtctcaaactcctgacctcaagtgatccacccgcctcagcctcccaaagtgccgggattacaggtatgagccactgcatccggccaaaaaagtgaattgcatgggatgtgaattttactacagtggaaacgatgcatggatgtcagagcatgtgaagcggcaaggacgatgctgaggccgggagggtccgggcggcaggggcagcactactgcagggtgtggtgggcggtgtggagggcagctggggctgggtataagtgaggtgaccgcgtcggcctctgatgcacgtgtgctgtctccccggggcaccagctcccaggacaggggctctgcctcacttcctgatgtgaacccagcagaggggtccctggtgcctgacttggctactcttgggtttcccaggcaatctacatacctctgggtgcctcagttttctcatctgtaaagtggggacagtagtcctaccttatatggccacaaagatcagatgatttaagacgtgcaatgtgatttgcacaggcctgggacgccatcaaccctgcctgtcgtaactccaccagtgtctggggcgcagaggtggaattctgatctaggggctctggggacgtcaggggtgggctctgtggacaggccagagcgtcccagctggcacggcaccatccgtggagggaacagcggggagagcaaaccctcccgggggggctctgctcaggggtgcctggggtttctgacccctcttccaggggccctgtgtctggcttcggggagacactcaccgtacagctgccagacgcgcaccttgtcctcgtaggggagcccgtagcgcagcgggtcacccaccgggccctggtagtacggccgcatgatggagtgtgcagcggccacatggcttaacccaatggcgtggccaaactcgtggacagccactgcaaacaggtccatcccgtgggcatctggggacacagggagccatgtgaactaagggcaagaagggccctgtccccgcggggagggaccagcaggcccccaccatgctctggggtgaccatggggatgcctcgatgccggctgcgccagagggattctgcagggttactgggaattaacgcgattcccctgggggctctgtggggcctgctgggcttcccaggcctggggtctttgtaccattcatggagcggctgataaccttttctgcataaggccacacagataacaccttgtgcctggggcctgggttacatggggccaggtgtcggtcggatgacctgaggcccaatgctgtgggcactgacccctggccccacaagacgggcctgggctcccaggactgcatggttcccaaggctacagtccagaggtcagaacagcgtctgcagtcttcaccctcgggtgcaaggagccgcgcaaagggtccgcgcac

SEQ ID NO: 866 - DNA, 10166 bp, Homo sapiens
cgtgagatcgaatgaagaattgacgagcataggtttgtcagagagtcagacagatacacgttaagtagcctattagtagtacataactgatagatagtagaaatatccgtcaagaaacaatgccaaacgctatatacttatgaacaccaaagataaggtacatactcattagaaagcaaagtcgggagatgctcgtacatcaactaagagagaaataaacggttgtgagaccgtcacatatctgggtgtaagcgaacatctggaagatctcttaacgactacttatgtagcgggacaccgaggatatagtccaacagagccgcgcaagcgatgatcgcactctatgtcttaagggtgggtaggtaaggtctgagttgtacaattaggcaacacaagaaggagtaaataaattgatgaacagacgcgtcggagaaaatattgacatcgatggtcacgtttgaatcctttgcagatcttaaagtaccaggtgaggggatttttaaaagtttaaaatgcatcatatgagcagatctggggacaacaaaaggaaatcctagacccattggaggcttaagcagggtggatccacatcacatgcggaaagatcaagacaagtggcccaggcaggggggacccctatcgatactaaaatgccaacaataagccaggcgtggtgggaacacctgtatttccaactattcagcaggctaaggcacgaaaattgcttgaacctagtaagtggaggttgcagtgagccaagatcacactactgcacgccagcctgggagacagagtgagactcaaaaagaaaaaaaaattgtttagttgtgatatcatcataggattggattttataggtgatcagaatatatgcatcttcgagtcctatgttaccatcatagattgtttttaaataaatattttcacttctaattctcccctcatctgtgtgaagaaaccactcagcattatcttgtggttaattcacaccactctgccattcgcgacataaaaaacaggagtctattagatttaagcatctggttttcagcagttgtgcattgtgggtgaccttttgtgggaatgattgctgatttaattggattggaaaagctatgggtaattaaaattcagaaattctattaagaaaagccagtttcaaattttgcatggggttagacattcacactttaattggtgtcaaactagtcttagttgttcgtctgtccttttcttggtagttattttggaaattgaaaccctgtgttcactcagttcctctgagacagccagctggggcatttggccacaactcgttaggacctccatgggtgcgtgcatgtgtgtgttttttctaaggcatgtacactgagtcctaaaggtgagccttttgcagcagaagagttctgcatggttcagaatattgaatgctaaggctgtgtcttctctgtttccagcccttgaaggtagtggacccagatcatcccctcgcagcacttgttcgtaaggcacaggctgacagttccactcccaccccacacaacgcagacggtgcgcctgtgcagccctcccaggtggagtacacggcagactgtgagtactcactgtgtatgtcctgacctgtgttcagctgcctgtgacagagccagctacagggctctaaaccccaagtgttctgtcctccaagtgtaacaagtatggaagcaggcggcccagagcctgcacatggtcccaagggagagtgccacgaggctgccctttgcttggcccagtgttggcaagatggctgccctactccagcattagctgtgcattccaggaaggaggaggaccggcaaaggtagctggctgcctctgcccttctttcttttttttttttttttgaggcgaggtttcactctgtcacccaggccagagtgcagggatgcaagcatggttcacggcagcctgacctcccaaactcaaacgatcctcccacctcggtctctctagtaggtgggactacaagcacgataacactgggctaattttgattttttgatagggatggggtctcactatgttgcccaggctggtctcgagctcctgggcttaagcagtcctcccgccttggccttcaaaagtgctaggattgcaggtttgagccactgctcctggccctggctctgcccttctttaaatatccacccaagccatagctagtggcttcccttacctctcagtggctagtgtcctgtcacatggtctccccactcagcagaggcaatggggcctccgttaaacacgttgctgccctaaacaaagtcaaatgctggtaagaacagggagaatgggagacacatagtattgtctaacacagttgctttctttaaaaaggttcacagcaggccaggcgtggtggctaatgcctataatcccaacactttgggaggctgaggtgggaggatcacttacgcacaggagtttgagaccagcctggacaacatactaaaaccgcatcttgacaaaaaataaaaaaaaattagctgggcatggtggtgtgcctgtggtctgagctacttgggaggctgaggtgagaggatggcttagccccaggaggttaaggctgcagtgagctgagattgcactgccacactctagcctgggcgatagagcagtaccctgtctcaaaaagaagaaagaaaaagaggcttacagcataagttaacatatgcactgagaaattacatttctttttctcgctgattgcagttcttttatggtattcattaaaggtaagtcttgaaggtccatgcaggagatcatttgaaagtgtttgacgttggttccagcgtcaggtctttctgtaattgttttattcagaggttaaatatggaatgaggaagctttagcagagccgaggaaccacctgctgagtctgcttcccaggcagctctggtaccctgactccatttgtaaagcttatctccttcagttcagccggagatgaattgttaaaacatcagctcctctttatttgggacaagcttttgtaaacatcacagctgtgttctttgcacttcccttttagcactggcacatactaaacgtttttagactttaaaaaactagttactagagtgaactttctgcatgtgtccccccaaaaaccttttaaagctgagaatgtctttaaatgattaaatcaagtcatatcaaatttcactgaatgttcaaatcagaggtcagctctactgctacagaggtgcgtgttcaatagtgtaggcagccagctgtctgaggtgctctgtagatcactcctaacgcccagtcctcactgcatggatttttggatagacggccgcacacctttaagtcttgagccccactcggcagcctgtgaagctcccgccctggagtcatggggcgctgtgctctgcccaggatgcctgcccactgagggaccatccctctgcttcctcctttccttttccaagcctgtcgttgagtttgcttgaaccaaatgcattgtccgtgcacgtccaccagatccctgaagctgctgcaaagcagaggactagaaattcagggcgggctgaccttgattatttgctgtgctaatcactggtggaagaacagccatgtgcagaccccgcaggaccaggcaggatggtggagccggctggtagtggccgttctgtgacacacagcatcccctggtctggtgggaatgtgatctgaactgaggcatgcaggggtggcattgtgagctgtctgggtcagaaggcttggtacattcccaagggttcaccgcagggcggccagagcccacacactttggtttcttcccacctgctgatggctcccgagaccactgataagccgtgacagcctctgcaggaaccctaagcttactctgttcaggcccctgactaccaccaccctgggcactgacggcaccccaccctatcctcccaactgcaagggctctagtagggggtgccctctcctcccctcaatacggtgccgttgttttgaaactcatcgtctcccctcgacacagcaagagtagtggatacacacatgtgagagtaagggtgcctgggggctggtgaaagcatgcgtgtctgctgttagggtctgtgggttttagacatatgctcctgcatcagccataggggtcagagccctcctatgagcctcctcgctgagcacagcactcagggccaccaccacagtcccacccatcttggatctggagggtcagaaggtgggggaggtgtcctcatccagtttccaagaagagccaagagctagaactttggctctaaatcactgtaaaacctagcagaaatcagtataaacctgtactcaggcgctcagccttatgggatgagtggctgtggcgtggcgttacgtcgggtcctccagcaccacgcaagcccgggcagtgcggccattccagaatctgcagaggttccagggcgcctgactcacacgcacctccctggcctgccgtcttcctctgctaccctttgagtaccttgttctgcctgcctcatgcttctgtgtgctgttgaagtttcctgggtgaaagtccctcatgacctcgtcttcacttcctgggttttcagtgaagttgttgcagaatttggggtcctgtgtggcaggttgttggcagttgcaggtggagacagcagtcattgatctacccaggttggtcatgattagggaactgcctgtaattcatggactgactactatgtggttattggtttgtaatcagtcattgataacagcatttatttacaaatacagttcaaatagagggaacactggtcatagtttttgggttgagttccgtcatgctaaagttcaagataatattgttacgttcattatatgtagtttccaaaagtattaatgcagtgggatctcaactatgcttaaaataataaactggagagagctgtgcaaaaaatactatgaggctcagagctacctctcaaattggcatttggttgattttttttctctgcatacttttttcattttcatgatgtttttgagtatgcattactattttactaattttttttttttttcttttttggagacggagtctctctgtgttacccaggctggagtgcagtggtgcaatctcggctcactgcagcctccacctcctgggttcaagcgagtctcctgcctcatcctcccaagtagctgggatcacaggcgctcgtcaccacacccggctaatttttgtattttttggtaaagatggggttttgccatgttgcccaggctggtctcaaactcctgacctcaggtgatccaccccccttggcctcccaaagtgctgggattacaggagtgagccaccgcacttggccaacaaacgattttttaatatttataattatattattttaaaaaatatggaagtcttcacgaatttgtatgtcatccttgcgcaagggccctgctgactcctctgtgtcactccaattttagtgtctgtgctgccccagccagtgctgtgtaactatctctgtcttgctttcaaagtcttttgattatcacttcagtgaaataaacgactgttatttcagagtgacctatgatcacgtttcgttcaattgttttaaaccttttgacatctttagcagcttctccaagaacaaaattctaaattaagtttttctgacctaggcttaactttggaattttctagctgggccccaggagaaccttaaaaacttatctctcattttgtagaggcattaaattattaggcttatttagtaaattatgtgagagacattatcaaataataaattatattaggcattctttcagttacatttatgttattaatacaaatgtttcatggctgggcatggtggcttacacctgtaattccagcattttgggaggctgaagtgggtggatcacctgaggtcaggagttcaagaccagcctggccaacatggtgaaaccccatctctactagaaatacaaaaatcagccaggcgtggtggtgcacacctgtaatcccagctattcaggaggctgaggcaggagaatcactttaacccaggaggcggaggttgcagtgagccgagattgcgccactgcattccagactgagcgacagagcgagactccatctcaaaaaaataaataaataaataatgtttaaaaattgtataaaacttaaaatctaatatcattagtcataattttagctgttatagtaaatcttctttaaagttatatctatgtaaatgtattaatgtgaatatcctatagactatgtacagctgatcagtctgatggccccagatgaacaatgagattcgccattccacagtcttcatttacagcagtctgcactgttgagaggctccagccgtcacactcactcacaggcaagtcccttaaacctgatttcctgccaggcgcggtggccacacctgtaatcccagcactttgggaggccaaggcaggtggatcacttgaggtcaggagtttgagaccagcctgaccaacatggtgaaaccccgtctctactaaaaatacaaaaattagccaggtgtggtggcgggtgcctgtgatcccagctacttgggaggctgaggcaggagaatcactcaaacctgggagagggagattgcggtgagccgacatcgcaccactggactccagcctgggcaacagagcaagactccatcaaaaaaaaaaacaaaaaaaaaaaaaacctgatttcctgcaacaaaaacgaaatgactcaagaaattacaactggcagagaacaaagagggtggagaagtggatatttcacagaagtcacacaaggccaggctcactgtagaaacatggaaaaatacagtatctgaagccaaactaaccaggagcatgtcctagcaacagcactcactacctacaaaactgtgggcatggcgcttttgttatcattctgtgataaaaacctcagtgaggtcaggcacagtggctcacaactgtaattccactgcttaggaaggcccaggtgggaggatggctcaaagctaagaattcgagaccagcctgggccacagagcaagatcccaactctaaaaatcaaattaaatttaaaatttaaagaaacaaaacaaaacaaaacttggccaggcatgatggctcacaccagtaatcctagcattttgtgaggctgaggtaggtggatagcttgaactcaggagtttgagaccagcctggacaacatggcaaaactccatctctataaaattaaaaaaaaaaaaaaaagagcaggatgtggtggtgtgtgtctgtagtcccagctccttgggaggctgaggtaggaggatcacctgggcgacagagcgagaccccacctcaaaaagaaaaaaaacttaaacgagctgttgggtaaaactttcagtgtaatggaaggaagacacgccaggccggaaatcagaatgctttccgggcactccactcatcctggcgtggggctcaggcttgggctctgccgcagtccacaccatctccccaacacagaactacggcagcccccgacccgaagccagcaaagcccctcaaccggagctcccttcacaggcgcaagtggtgggagttcaccgtccgctcatcatcccaacagtctgaggacggcgcagcagcctgggctcccatgggaggtgcagtgagggaaagcacactcgcccaggctcccccagtcgtggtgacagaaatccaagcatggggccatttaaaagagtagtcgtgacagcttaagaaagagcgactgaagctttctttgttttctctctggcgaatctttaggggcctctccaagtttcttgctgaagacatccacaggtcttaaccaggctggtccaccgcggtcttgtgattcgaggcacagtaagtggccccttactttccttctctacttgacttttctggattcgaaagagcgtttgtcaaacctacaaaaagatgacgactgatggtttttacaaggtgtgaaccatgaagagtgatcccatgccacccaggatggggttgaacattgacattgctacagacctgtattaggtggaaatagcactgaacccccaaaggaatctaacaacatgtaagacaggatattttttggctgggcgtggtggctcacgcctgtaatcccagcactttgggaggccaaggcaggcggatcacgtgaggtcataagttcgaaaccagcctggccaatatggtgaaaccctgtctctactaaaaaaatacagaaaaaaaaaattagccaggcgtggtgctgggcgcctgtaatccagctactcaggaggctgaggcaggagaatggcgtgaatccaggaggcggaggttgcagtgagccgagatggcgccactgcactccagcctgggcgacagagagagactccgtcaaaaaaaaaaaaaaattcctgtcctcccccacccttgtgataatgtactttgtgatattccccgtccttgtgaatgtactttgtaacattcctccccgcccctgtgacaatacaccctccccacccttatgaatgtactttgtaacatccatcccctgcccgaaaaaattgctgctaactccaccgcctatcctatcccaaacctataagaaccaatgataggcccaccaccctcctctgactcctttctcagactcagcccccttgcacccaagtgaataaacagccttgttgctcacactaagcctgtttaggtggcctcttatacagacgcgcataacacctacattcttctggattcatcgaatctaactttcttccatagaattactaaaaatggaaacttctctgttcctgaagtcctatcagctaaaactagatgaattctccaaaagaagccttgcgtctgatgtgtgggccacacaaaagttcactgtacctcccaatgccatagtcagagacattcgaactgcaaaccaggtcgcgaataggacgtttcatgctgtagacggctttccctagacgccggcgaacaggactcctgtcatgatgacgctcttacccatctcagtgcccacctctcccacggggcaggacggtggtgtcgctgaacttccacgatccgcggcttctgctggaactccacagaacctgacccaggagatcccttagtctcttctggttaagtaaggaaatgcctgtgctgttgctgccaccacacgctgcacctggagaaactcctctgggaaagctgagacccacatgcacaaaataagaaaacaggccacagggtcgcagccggtctcacccaccgtgaggttatctgatttattcccttggttgcctttacggctgggttcgtgacaaagccactgtgcaaactgggattgccacattactattaattttaccttgtatttccccttttgaagctttgcgtttgttccttgttaaattttgaagtacaactcctcgcaggatcatgctggcccagcgcgtcgagatggcagcaagagactccaaagcagacaaaactgaactcagtaacgggccccagggggcctcagcccaggcaccacaccctccaaacctcccctattgctcaactgtggctaaaagggttttgacattgactcctagtcaccacccaccgtaaccccacccggtgtggggaaagaccagcaaccaggacatccctgggacatcaaaacctaagttcagggccgggtgcagtggctcacgcctgtaatcccagcactttgggaggctgaggcgggcagatcacctgaggtcgggagtttgagaccagcctgaccaacacggtgaaaccccatctctactgaaaatacgaaacttagccgggtgtgatggcgggcgtctgtaatcccagctactcagaaggccgaggcaggagaatcgcttgaacccaggaggcggatcggaggttgcagtgagccgagattgtgccacggcactccagcctaggtgacagagtgagactccgtctcaaaaaaacaacaaaaaacaaaaaagctaagtacaggaagactgatcagtgatgcctgagaaagattttttttttttttaaatggagtctcactttgttgcccaggctggaatgcaggtcttcaccacgggctcgcaaggatccgcgctggcgcattggcggctcaa

SEQ ID NO: 867 - DNA, 11191 bp, Homo sapiens
  misc_feature (1)...(11191): n = A,T,C or G
gggcttcccaaagtgttggaattacaagcgtgagcccccgggccgggcctataattttcatacatagctgaattcagtttaatattttaccatctatacttgtaagtgatcgtggtctacagattgccaagctttgagagcttcatatttttccatcttctttaatgctctggagtggctttaatgatgtaggcattctatttcttgagggtgaattaacttgacctttaatttgtcttggctgactgcctgggttgagaggtatttcactaaccaattattttcaaaattctttcaggtctataggtctatgttggttcctgatttcttcatgaaataatttcagcacttatgttttcttagaaagcgatatttttcactgattttcaaattcattcaaatttaaaataatatatgttctcatatactttattttctagtgttaacttctagttgtagcttgtgtacttaaaaagatacctataattttcttcctctgtcacgcaggctggaacacagtggcgtggtcttggctcactgcaacctccgtctcctgggctcaaaagatcctcccaccttagcctcccaagtagctgggagcacagatgggtgccaccatgcctggctaatttaatttaattttttgtagagacatggtctcacgatgttgtccaggctggtttctatctccccggcttaagtgatcctcccacttcacagcctctgtgaggagctggtgctacaggcatgtgccaccatgcccggctacatttttgtatttttagcagagacggggttttgtcatttgcccaggctggtctcgaattcctggactcaagtgatctgcctgccctggcctccctatgtgctggcattatgggcgtgagccaccacactccacagcaatttctaagcaatcttttccatgtctgattaccagtagcactagttttataatattttccattttgtagaatacaaattagagacttaaaagatttttctcctgttacgcaagagtctgtttcagagatgcccatatgcctggaggctcagctgtgtctcccgaactttggaatctctgtgggcgcaatgacatttctgtctccgcatcttttcaaagagaggctggcctgtgcttttgagaactgagagttagcatgggttttgtcagatattgagtagatctctgttcaagtgtctcaggcttgggtggatgtagacggtaaacttctcggtgtgttgtttcatctgccaggttctaggacaatcagggaagtgtggagaaggtcacgctggttggcagcagccttgtgggcagggctgctcctctgcgggccccacagctggcaggggtcaggtgccttccctgggctcacaacccctctgcacaccccatagctggctgggtcaggcgccttccctgggctcacaaaccctggggcagcaggcaggctcgggctgtggttgtgttctggggtgtgagaagggatgaggtactgctgcctctgggaagctcccagcttgttccagcctcctgcctgcccctctgtggctgacagtcgactcccctggagtcactgccctgagtctcaagggtacttctctgcaagctccaggtatgctgccttaccctgacctatagacagtacctctccccgggtttctagagcagtaaccattttcctcctctacttattacattcctttgattatcccagtgagagtatgcgggtggccgaaaagggtgagaggtgtatcacttgtgctcaggtcacctactagtatgagaggcccaaagacacatatagtgaattgcctagttagcggttcatccacatggatttggtttcgctgaatgatcaccattctcatacaacaaggcatctttatgcaaaggacggtcctcttatcaccccagcccacttcctcaatctcttgtctccactctgcctttccttctgacccaagagctgtcgcctcgccccactgccacacctcaccccactgccacacctgtcacactccattccaggccaccaatgccaccagaaatctctgaagtcgctccagtggcttaaccgcatcacaaagtcaccagactggataaagttattccgctgacctaaagcctgtcagatgtgctggcccctccccgacagggtgcaccggggcaagctggccaaggctccttcaccagccacccccgaagtcactgctgaccacctaccgcatctcaacacggggccgggcagctcgcaccacggggctcctgcctagggctgcacccctgcctcagagcttcccgttcctctcgcaacaccagctgaacgcctctactccacagaacctccctcccgcggggggagcccactgctgctccacgaggttcctggctaagggcctgctctggcctttgcttctgtctgctttttaattacactgactttgtatttttacatgcctgtctgtcctgtgacatcaaagtcttgctccaagaacataacaaagtaactgaaatcgagtgagtgaagtattgcctggtagagattctcaaggaatctgctttgacaaattaataaatgaatttcactggtacaacagtttgcatataaatagtttcaccagtcacagggagcacaaaggactatgaataactttatgtacaaaggtccagtacactgaacagcctgttaatcacacacatgcctaaggagtgctaacactcacgttacctacaaggccacgcgaggcaagcatgacacagcatggaaggcagaggtttcaccacagcaacctccagggggccgccaaccccaccccagcctgcaggtgagggcgctgagtctgaggtcaccgaggatcctacgcttgccaacttatggtggaatgtgcaaggccaacatgcaagtggcagcatacctttcaccagcttcccgtccgggacggtcttactggacgatgcctccttcttcccgcctgagcctgcccgtgctcccacctcggctgcgtcttcaggcgcgccatcctccccagcatcacttggcttctcgggagcagagtctgtgggagcctcttctggtgcagacacagcctagagattaaatgtcactataaactgtcagcaggaaattatacagaaattttaaaaaaagagagatgtatacggtatatgtttcactggacaacggcaattgtacattactgcccaagcagcactgggaacagacttccaaatccagatctgctgttttttcttacaatggaatgtatcaaagaggaatggaagattttctcctgtctgaaaaaacactatactctttgaagccctaatactgccttgggaaccaattttcagtatcttttctttggacactgattactcagaattctttaaaaataccaaattatccccatcacctacagaggagtcagtttctttcagtgtgggctattggagataagggtctgaagaaatctcctgagaagtaaggcccatgtcatctcctcaccaaaactggctttacaaaaatgtcagggtgtctatataactgagaagagcagagcaaaggcagaagagggggctgtaggacaaaaagcacttccaagtgcgccagcaccacgctggggatctggtgagggggaagggcgtgcaggcacaggcagaggccgtgctgcaggacacccccagcaccagctggccaggcatgaggcgcccacttatattttatatatttcatacatgttaacacaacagaagcaaggtacccggctgtcatgaaaggtagctagtaactgtagacggccaaaacatcgaacagttgaaggaacaggattttttttgtttgtttagaacgtgctggacaaacaatcatcaatgctgtgaacgtgggcagatgctttcaacagatcaggttccagagctaagggggacgtgaaagatggagtatgccagacacacattaaaaaaaggtgaagaatcacccagccctttcacctgtaggagaagaaacagaaagcgacttctgatctggaaggcggagccacctctaagagcttcacagcctccctgcattcagacacgtacctgcatgctatcgcccccttctttctggaggaagaactgcttcttaaactcataataagcattatactggtgccacggctgcaggaactcaaatctgagcagaaaaagaaagaaaatgggtcatttaccaagacaagctcactgaagtaacaacaggccctgttctcctagctctttactgatctcaacaatcccacaaggtggttactgttttagctactcatcttatagacgagggagactgcacacagggggtcgaaatcgcttgcccggggttacacaggtcacgctgcaaatgtgacaacatatctttacgttttattagtactgaggcgtgggacattgcttggtttttaaaaagaagggtttgtgtctagatttttaaggcagattcttgaaaaccatgaattataggcttttattttaggtagcttcaaaattcctacttaaaaaatgaaacaaaaaacaggtaacataatttaaaaacaccacccaagtctaagcaatttaacaagccaattaaaaaatgtatttatctaaagacattggttgggcgtggtggctcacatctgtaatcctagcactttgggaggctgaggcaagtggatcacttgaggtcaggagtttgagaccagcctggccaacacagtgaaaccctgtctctaccaaaatacaaaaattaaccaggcgtggtggtgcgcgcctgtagtcccagctactcaggaggctgagacaggagaattgcttgagcccaggaggtagaggttacagtcaatcaagatcgcgccactgcactccagcctgggtgacagagcaagactccatctcaaaaaaaaaaaaaaaaaaaaaaaagacatttgagccaagaaaaggcttaaaaatatataaaaaaattaattctgtacctacatttttttaaaaaaaggctaaacgaaacccccaaatgccatatacctaacatataaaattcttcttctgacctttgatcattcttggcacgaacactggtctcgaacttcaggccgttcctggcgacatactcggccagcttgtcaatcacgggctggacgtcggggggcggggggatgatggcggccacgggggcaagtgcactgcaggagaagagtctgtgagacccctgggcttcaggggctcgccaagctcagtcctggctgctcgggggtcctcaccgcctcagatgcccggagagacatgtgagttataaacagtgtgttaggggaggctcttgttgaaggtgatgcacacgacagaaactaaagtcaactagacaggattgttgtcaagagtgaaaaatggggattttagtgataaaaggtgcatttttcctactaattaacatttccccccaatcacaagctaattcttagaaataacaaagaataagcagtttgttgttgttgttgttatattgaaaacaagtcggcaagcatggttcaacctccttcatttcctgtctgacttgctcagcatgaccagaaagagtcgttttcacagaaactcgcgtgtttcattccatttcccaggagtctcctttcaaggcagggcattccaggcccactggtaaagcgcctgtctcatactcgtcccctgaacactgggggccctcgctgctggagaagctagggctctgccgatggcttcacaggttaactaaagtagctgccagggtcccctggtggccaacagcttgggagagactcatgaagcaccccaacatcacctgcgtcaactttatgaacctgcatgttttgcaaacaactgcagcttcactgcatactgattttgcctagcacagctcaactgagactctgacacaaagcgcaagaacagatgctggagatctggggccagcgtgcgacgtgaaatgaattcaactttataagtggtttaacttcaatgctaaaaagtttgtgctacaaccatttctgttttcctgtcaactttgtaacttggggatttggaataataactactcagacaatggggacccctgtatatgatctagattacaagccccccatggagacacagacggccccagtgactgcagtgctgagtgactcacacagcaggcagcggtggacgctgcacctaccttgtggtggtggttgtggaggtggccccgctgctagtctctgctgtggttgggggcggtagtggtgtggtcccaggaggtggtggggcggtggtcgtcactccaggggagttagacacggtcacgccagcaggaagggtgctgtagtaagtagtcacgtcgattccgggagggggcggcgccaggcagtaagtgccgtccggtagcatgtagtagctgtaatacatggctgccacggtcgctgtggagacacattgccccggagtgagcatggccggccacaggctggtccatgagtccacaatgcagccacaagagcccttcccccggcaagatgcagccttgcctctgctcacttccaaccatgctgttttctagatttttctgatacaaaaagttgtctgcacaatatgcaatttaaaagaaccaggcaaagccacaacacgcatccaaagacagatggaaagcgaatggcatgaggacattcaaaggcaccagatatgaatactctctagacaaattaatgtcctccttaacttcaaaatgtgcaggttgggaacagtctcctctctagcggcaaccagtcatccctttgctcacacggcccacgaaggccacctatgctcctaaatgcacatgtgaggaaatgcctttggctagctccccgcgctgacacctgctttcattccccaggcacgctgctccctccattcacacgttaatccggaaaccatcccctcagtaaggcagctgctcctggcaaccctggcgtcagcccccggccccagcaacacaggctgtgcaggaatttattcagtaaataaaagttcccaggggcactgaggctgtgtctggacctttccatcacagacagtgatgtatgccgtcttgccacctatgctgtgcacacaagcaggtatctgtagggtagaggcacgctgtcttaacaattaaaaatcctgtacatttatcctttttggggttaaatgttcagaaccacgaatcacagaagattcaatgattaattacgaaatttaatttccagtcctgttgtagataagcaagtagttctgactacacagagatttaatttcctctttattaggagatggcaaaaatatttttcgaattaagaacttttatcttcactttcaatcaattcaccttaaaacaataacattgaaaaacagtaaaagcttaactatggtttccagtaatgtatgctatgcagagaaaaatttcagaagtacaacttagactatcttgacctttccatcttagattggcgaggcagcataattcctatgtgctgtaggcatattccccagctgctaatgacttatttaaattaattatacatgatgaactcctaaaccgttgttctctagctccatgttacacaccaaccaccatgacacagaaacagtaatactccaaattttcaaaataagataagtgggttcgatgtgctccacattatcgtcaacacagatatatctgagcaacatttctgagaaaaggccgggagcaggggatgagacccttggatgtcaatgggaggctgacagcagggcaggcaccgtctctgaggctcctgcagcggcaggtcctgtcttcactgtctctgcagcctctgcattgagcagagtatgtgctggaccaacgaactgacctgatggtccaacataggcttcctatcaaaatcaggaatccgaatataagcatgtgcttctgtaagagacaacgtcatccctggaaggggggagctgctgcttccacccactccctgctggagccatcaggctactatgtatggatgcttcctctcagccagggcgaagccagcactccaggggagagagtgcagcccagtgtgtgcttagctctggggagggccaggcggaactgaccccactaccgactggctactgtcaggtctccagcctcccacctcagcaggaaggacggaaaccccatgtcctgctctggacagtcagtctcacccctaaaaagtgtccaaacatgttttaaactggggccacaaaggacgggatctgaattcacaaaaacaaacaaaacaaaacggtttataattatttcaactagtagtacatattatgcagctccaacctgatacctgcattctttatgtaactgtgtaaagtgcaatcacactggaacacaacagagatgaagaaactgttttcaaagctgagcgccattcctttaaagaacacgcagactgttagtctatatgaccttcctgagccttccatcttgttaaataaaaacgaagtgttaaaaaaaatagcagtgccggcaaaatggcagactgctcagagactcatccactacaaatgtcaaaaatgtcagctaatttgaaaaatttaggctgggtgccatgggtcacacctataatcccagcactttggtaggctgaggtgggaggatgcttcaggcctgggcaataccatcagaccccatctccaaaaaataaaataaaataaactagctgggcatggtacacatctacagtcccagctacttgggaggctgtggcaggaggatggcttgagcccaggagtttggggctgcagtgaggtgttgatggcaccattgtgctccagcttgggtgatggagtgagcccctgagctgagctcacaaaaagaaaaaaaggctgcctgtaggtgtaaaaatgaaacaaatgcccaaatctgaaaacactccagggacatcctagcctaggtccacaacttgcttcagaggctccacgctaaaaaccactcaggctgacaatgctctgggcacacccttgacccagacccaggagattctcacagaggagagctgtgaagccgagacacgcgcagcctctgtgaggcggtctgctgctagccactgctgctgtcacctcttccccacacacacctgtgattctctccaaggttttaatcaaatttgaaaatcatcctgtctctcaaaaggactccaagagaaataaagtatgtgttgcttgatgagatgaaaacacttctctgtctgccgacagagaatgtgggacgtgtcctatggcactgccatgctcggaggcagcccgggaaccaacaccacagtggttcatgaattccgctacaccgttcctgggttgcttctcccagattctcacttcatagggtgtcagggatgtgaagatctaagggaggacgtcagatccatccttccccagacactgtggccctggtgggaggcaggacgggcacaagtcatctggagcagcccagggccagcctcccgaagggcttctgccgcttgcccagcccaccccttgccctggcttctgttccccaggtctctgtcctttgcacggcctcacagggtctctgcctgccatgaggcccctattcagcttatctccagtgccacctctttcgggaagcctctgcctccttggcagactcaggaggcctttgctctgggctcgcgtggggaccctgtaaacaacgccctatggcaactcctgcgccactaggactggtgtgcagctatgttcccaaggactccatatctccaaatagtgaccacaaaaccttagccgctcacacagctcctggcatgagcaggccctcagtaagtgtttaatgagtgagttcatgccagctggtggcacggcctggactgcttctaaaatgcctcagtgctaaaatatcctgcagtgaccatgaagctgcttgacacgtgccgcacacaatggtggcaccatacagctcacagaaccctttaactggactgaagccctttaaactgactaccaactataggacacagggattttgtatacagccccttgtatgttgtacacagcaattctcgtgaacactaaattttaagaatttctggactagtacagggtgacaacagaaataaaatctacaagctgggctgtagtctacaaactgaagtctgggctggcaaaagccacatcagctttacaataactgtgccattactagtcatgaacgggggagggcacagtgtgccaaggggctcctgctgtcctcaggctgccacgacatgccgggattctcctgggcttatagcgaggctacttcccgacaaccccaccatacactgacaacaccgtgaagtggaaaatgcacagaatccacctataacccaccgaacaccatggcacagcctcacctgccttaaatgtgctcagggcacctacagtagctgacggctggatgacatcatctaacacgaagcctattttataataaagtttttagtatctcaagcattttactgatgttctactgaatgcaaattgcatgtgcaccatcatcgagttgaaccctcagtaagctgggaccacatatatcttgttaggtttgttgctgttcttaggattttatattgaatttcccaaaggggactacgttttaaactaagttaaatgctgacgtaatgttactctaataaacgctatgagtactacgaaagcctactccaaataaatccaagaaagaaattccaataggtacctacacagtccctaaaggcaagtatagttgtatgacgagaaccaagctgcttaaaagcaggaagcacatttgtaagtccttctccaatactgcctcctctgaaacgtgcagagctacttaacataggtcagagaaatctgcctaattatctcccaaggccctctattcaactggcttcttgcaaaaatcagagccagttctctcgtatctctgcatgatcttaatctcgtgtgaatttaacacacagaacagaactcctgtgctgagaaggttcttagagaggagattggtgagcaaccacctttctggaagagctaagtcagggaggatgaacaatgtgtatattaagaatgaaaataggctggccagggtggcttacacctgtcatcccagcactttgggaggcattattccccccgggctaaaggtncgcgaaagccctc

SEQ ID NO: 868 - DNA, 10280 bp, Homo sapiens
tgcaccttcctcgtgatgggacctcggttctgtgtcttcagcaggcagttttccatcttcgcctgagtcaccatctaaacacctggagacttcacgtgacgttctggattttcagagtcactgcttatacctcaggctgtgctggcccaacttggagaagctgtgcccccaggcccaggaggcagggcatcgccagcccacagccacagtcaaaaccctccgaaggaggtcagaggacccacgccaccccagtgaggggcaaggacctcttcccttcttccttccaccccagggaggtcagcctgggggcccagggtctctcttgagccacacggccgggccaaggcactggctgcccttagcgtgacccaggcttttgaccaaaaacacacagccccatgggtgctatacaacgcctctgcatgggagacctccgaggccaggacacaccctctccagctcccatgatacaggaagggaaactgaggcacggtgtcttagctcagcttgccgtgacaggctgctgtagaccatgcggcttccacatgggtgacctctgaggccaggacacaccctctccagctgccgtgttacagggagggaaactgaggcacggtgtcttagctcagcttgccgtgacaggctgctatagactgtgtggcttccacacaggcatttgctttcccaccaatctgcaggagtctgaggtcaggatgccggcagggtcaggttcttagaggcccgcttcctggttcaaagccagcaccttctcactgtgtcctcacaagcccgagagagaaagtgctggtcccttcaccccctaccagggcaccaatctcattgtgggggctccgccctcacgacctcatctaacccaaatcgcctgccaaaggccccctcctaacaccatcacactagcggtcatggtttcaaaatgtgactggtggccgggcacggtggcttatgcctgtaattccagcacttttggaggccaaagtaggaggatcgcttgagcccaggagttcaagaccagcctgggcaacacagcaagaccccatctctactaaaaacttaaaaaccacacacacacgcacacacacacacacacacaaagatgtctgaggagacacagacattcagtgcataacatccagggtggatgggccaaggctgcccggtgggtgggtggccccagatcccagccgcacctgtccctccctgccaccctcctggcctccttcagaaaccctgtggggagtggattgtgggggcttaggaggctctggcgggaggcagatcaccccaaagcagcatgagtgacagctaagatgccgggcctgccctgcgatctgcgactgcaaactcactgaatcctggcagcgacactgagcggagggactgggttacttctgtttcccagatgaggaaactgaggcccagagctggcagagagctgtccgagcccaggtgttcagggaggggcggagccaagtgtgaagccagcgggcacactctgaggtcgggctgagagcagcactcccttgcccaggcggagggaccgcaggtagcaggacactctcgtgggaatcctaaggacgccagagcacaccgctccggggcagccgagctggacccacaggtgtgactacagcgcaagccagggccgcccctcccagctcccgggccgtttttagggcgccgtggctgcagcggggcggctggctctgggctgcttcaccccaagctgtgatgggccagggtggctctgcaccccgcccccctgagcccaggccaggcaggcaggacccccgctgcggctgagaaatgggaggagccgaggagacagagccactgctggccacactctccacctccaccgggtcagggtccttccaccgtgactgcaggacaggacccccacggcttctccacttaacagcagcaggatccttgccttctcgctcgctctgtcacccccagtctgtttctctgtctctgcctctctctgtctctgtctgtatctctgtctgtctctccaactcagtctctatctttctctctccttgtctctctgtatctctgtccctctccctgtctcttgtctctctgtctctctccctgtctctgtctctctgtctctctctctgtccctctccctgtctctctgtctctgtctctccttgtctctgcctgtctctgactctatgtctctgtctctgcatctgtctctctctatctccctgtccctgtctctctctctgtctctctgtctccctccctctctctggaggttgcctggcctccgccgctggtctcccctgcacttgcaccatggtggggggcctggcttgctcctgtcgtatggcagttggcgctggctctggcaggagcctccatggggcctgggctcctcccagcactcggctggtgccatgcaggtgcctgcatttctgtcactctttttttttagacggagccttgctctgtcacccaggctggagtgcagtggtgtgatctcggctcactgcaacctccgcctcccgggttcaagccattttcctgcctcggcctcctgagtacctaggattacaggcacaggccaccacgcctggctaatttttgtatttttagtggagacaagggtttcaccacgttggccaggctggtctcgaactcctgacttcaggtgatccacccgccttggtgtcccaaagtgccaagattacagatgtgagccactgcacccggcctgcctaatcccatcttaactcatcttaactaacacatctgcaaagaccctctttccaagtaaggtcacgtcctgagattctgggtggatgtgagtttggaggacgtcattcaatccaatgtggcagccactcccacagtcacgggcgggaccctgtttccttgccgaggtaaagggtgttctgcgtgtctgtcaggggaaccacttcctgtaactccatcgcctgcccggccctcagcatttgactccgtcacccccatcacttgggagccctccggtgactgttcccggaggcctgatccctcctgaagggtcagaggctgcagctacctgggaggctgaggcaggaggaccgcctgagccagaaggtcaaggctgcactgcaccatgatcgtgcactgcactccagcctgggcgacagagcaagaccttgtctaaaaaaaaaaaaaaaccaaaatgtcacgcgcagtggctcacgcctgtaatcccagcattttgggaggccgaggcgggcagattacaaggtcaggaaatcgagaccatcctggttaacatggtgaaaccccgtctctactacaaaatacaaaaaatttgccgggcgtggtggcgggcacctgttgttccagctactcgggaggctgaggcaggagaatggcgtgaacctgggaggcggagtttgcagtgaggtgagatcacaccactggactccagcctgggtgacagagcgagactccgtctcaaaaaaaaaaaaaaaaaaatccccaaagacagtacctggactaaaaaagaaaaaagaaaattacttgcaaacctcatgaccaattgctcctaacctcccctaggccaccttgccaaaggccccagggtgccctgtagagcctccccgagcaggatcccatcacgtgcggctcccctgccttgcacacattagaagtgttcaggccgcttcccccaggtggacccgtctggcatctcctccagatcaggttctggttttgcacatctggcaggaatgccaccgagggcaggtgttctgagccccgagccgccctgcctggtgatgttcgctgtggtcacctggatgaggtgtgtctgcaggtttcgctaccataaagccccatttctgggtgtgaggggttggtcacctgccaggagagacttgagaacatgtgggtctcttgccacaggccgtctcacccctgctccccctctgtcccctgtgtcgcctgcccctgcctggttccctaccaggcgcatctgtcctggttcctgctcagccatagcagggcagggcccattggtcctcccatcatctccttaatccctccccctatttacagacatcacagccctttccagtctccagcaaaggactttttctggtctttttatattatttttatttttaattttattttactgtatttttttgagacagagtctcactctatcacccaggctgcagcgcagtggtgtgatctcagctcactgcggcctcgacctcccaggttcaagcagttctcctgccttaggctcctgagtagctgagactacaggcgctcaccaccgtgcctggcaaattttttgtatttttggtagagacagggttcaccgtgttggtcaggctgatctcaaactcccgacctcaggtgatccacccaccttggcctcccaaagtgctgggattacaggcatgagccaccactcccggtctggttttttggtcgttttaaattgtgggcgtggtgagcacactttactatttcagccattttgaagccacagctcggtggcatgaagcacgttcacgttgctgtgcagctgtcacctgcgtccacctcccgaagatttccaccttcccaaacggaaacgctgccccgtgaaacacggatgccccgccccgcccctgggcagccccgcccctcccctgggcacccccacttcgcttgctgtccccatggctctgagtgctccagggaccccatgtcagtgggacagacaggatctgcccctctgtgcctggctcgtgtcactcagcggaaggtcctcggggctcatacacgcggtggcacgtggcaggatttccttcctggctgaggctgagcggcattccatggcacggacggactgcacctcgttcgcctgctcacttgggtttcctctactctgggctcctgtgaaggacgctgctatgagcgtgagtgtgcaaacgtctctccaagaccctgctttcggttcttttggatttatacccagaagcgggaatgctggatcacgtggtaattctatttttgacgttttggggagcctatgttctgtctcccgcagcggctgcacaatttcatactccctccccggcagcgcccggctccgccgtccccatatcctcccgacacaggtgactttccacgttcttgacagtgggggcgagggggcgtctcattgtggttttgagggcgtttctagtgacgttgaccatcttcaagtgctcaatgccatctatatttcttgggagaaaagtgtatttaacgcagggcacggtggctcacacctgtaatcccagcactttgggaggccagggcgggcaaatcacctgaggtcaggagttcaagaccagcctggccaacatggtgaaaccccgtctctactaaaaatacaaaaattagctgggtgtggtggtgggcgcctgtaatcccagctacgcgggaggctgaggcatgagaatcgcttgaacccaggggcggaggttgcagtgaaccgagatcaagtcactgcactccagcctgggtgacacagcaagactccgtctcaaaaaataatgatcataataataataggatggcatgtcgtgggcctcggtttggcccgagttgttgtttccatcggtaaaggggtggccggcagcgtccacaggctggatgggacggcccggactgggcacagtaggtgctcactaagtatccatgtggcccctgtgatgtggggtgattgcagtgtggccgctgtcccatcaagcccaggtgaggggccagggcaagggcggctgacacaggagaaggaaaggcaggagcctcctgcccttcggggtggggccgagccccggcccacagctgtttctctcgcccccaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgagtgccagctggggggacgggccatgcggccttggtttccccaccaggagaggggcatcactacagggcagccaagaggttccctgaaaggaggacggccccggtcggtgtgggctctgagggtcccagcccctcgcctggagctgccgaccctgcaggcgtccccgagtcgctccccgaaggcctggcccacgagctgcccttgttctccccgccctcagcactccctcgcccctgctgctcccccagccacgctcctgccccagggccttggcactggccatgcctcgtctgggcacactttcctgagatgtccacacagcccctccctcgccggccccagccctgccaaacgccctcctgggcatcacccctgccacgtcccacagtgtagaagaaacctccccacagggtcagctccagggacggcagcatcctctgttttgttttcaacgctgcatccttgtcacctggaacagccctgcacagagtgggccctcaataaatatccagtaagggaaagagactctgagggtctcctggtccatcccctgccccagcaggctcctctggagcttcccaggcctgtgaccatgcctgcagagctgcccacagctgagcagatgctgaccccatctcagatattatctgggcaccccctgccatctagcacgagccgccccccaccagccgtctggtctgaccccccactgcagtcttgtgcaagccccctgctgtctggcccgactcgagccccttccgctgcagccctccctgagcccaacgctccctcctcgctgtccggctcgagcccctcctgctgcagccctcccctgagctcagctctccctcctcttctcaggtgcctcgtacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcactgcccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttgtagcggctcggctgggctccctggtgctccagggccatgggagtgggtaccctcgggcctcaaggggcttgaccctgaccaggggcccacgcacctgcacttggggtgggggcttcccaggaggtctcggcagtcgcattcctccttgttcatcagcccgtcccgcgctgtctcttccagtcctcgtgccccgaggagtccccacgcccctgtcacagatgggagagttgaggcccagcgggggatgagcctcagtgctacaggcaggggcatcacgggcgggcggggcgccagctggcccagcgagatctgagtgtgggaggtgcccgaggaaaggcatcagttgttgggtgagccacttgggacgctgtctgccccgcagcactagaccatgatgcccggccgagcaccgggacctgggtgcgcccaagagggagggtaggtgctccctgcgcaagagggagggagggtgctccctgcacggggctgattctagctccagccactctgtcacttgctccctttgctcccagcctccagatccacagcggagtccctcagcctgcccccactctggccggcgagtgacgcgtctgtcctgcagtaccctcttgttcagagggtgcagccgatgccactctgcagggcccagtcctcccgctggtgcacagtcctctggtctctgcggcacagacgcaccccgggccacaggttcggggcctcaggctctggctcaccagcatctgccctgggctgtggagggcccgggtgccccctcaaacatgactcagtgaggatgaggaggtggccgttggactgtgggggattcactcccacatagcaggaagttcctgaccacaggcccagcatagggagcggctggggccacccagggtgcagatgaggcttcctggcacccaggagccaaagcccacagcccccttgtcccatcccagggatggcacccatcccaggatgaggctgccagggccgggcaggcaggccccaggccaggcctcatggagccgggccacctccccgtgaagagaggccacatcctcatggagtccagccgtgtcctctgtcccccgcctgttcaccatctgctccctggagcaggaggagtccctgcctgtcagaccagtctgtggaaagaccgacctccctcctgtctgtcggggacactggctctgccctgcaccaagtggtgtttcctcatcacgctttgttgcccagcagcctgtggggtgaagtcccccgtgcagctggcccagccccgtggtccccacgtcctgggtcatgccccagtgcaaagccggctgtgggccttgtctgctgagtcgggctctcacgttggcagggctcactgcggttttgaagtccaaactctccgtcataagcctcttctgccggtcctatctctggtgaagaggtgaaccgtaggcggggcaggggggctgctctgaacttgcctctccatgctgcagcccacctccctctggcagtggggtggccgtgctgggtcctggggcagggcctggagccccgccagcccatgacgcatttcatgagcccccaccttttgatatgcacatgcagctgaggctaccctgaccccacattcaaagtcggaaatccccaaaacccaagaccttttgagcactgatgggctcggggtgcacacagaacatttgggatttcacttttttttttttttttcatttttcagagacagagcctgtcgcccaggctggagtgcagtggtgagatctcagctcactgcaacctccgccacccagattcaagtgattctcctgcctcagcctcccgagtagctgggattacaggcaggcaccaccacgcctggctaatttttgtatttttagtaaagacagggtttcagcatgttggtcaggctggtctcgaactcctgacctcaggtgatccacccgcctcagcctccctgaggtgaggctaggattacaggcatgagccaacacacctggccaagtggcagtatttgaaaaaagaaaagcagagaaaaatgctcaacctgtaagtataatgcaaatatagtgtccaaactccaaacaatctgagctccaaaacacttttctggtcctgcgcgtctcggatgaggaacacgcgggcagggcgtgttgttttgtggaaaggatctcatgttcatagaaagctgcacccgcagcatgagagtcctctgcatcctttgggaggcgctgaccaccctgagctcgcttctgtgtctcctggaacgcaggtgtcctcccaaggtcagagttgggaaagacacgcagccagtggatctcagatcagaggatgctgcagggacagacctcacccagggcagccttctttggcccgtcttcaccacggggcctcaaggatccgcgctggctccacgcgggtgtca

SEQ ID NO: 869 - DNA, 20043 bp, Homo sapiens
  misc_feature (1)...(20043): n = A,T,C or G
atgcaacaagcgcgatcctagaagcgccgtggtgaaaactgctcaatgtgccaacctgaagggggaaccgtggttctctgctggtgtctgactctctcctggggttgctatttgcacagctgcaagcgtctggcctcccttatgattctgcgtgccacgaagccccttcccagcctggcctcctctgccttccagggagacctccagggcctgtgcacaggcccagttaccccaagccctgcccctcatcagggcctccggacttcatgcatttcttgtgccaccccccgatatctgggacattcttgcttaatggctggggctgtgctcagagtctggggtgcagaccccatcgaggggctgtgccctctacccatctctaggacctcaccagtgtctggccctgcagaacttagacagagctgcggtagccagggaccacagcatgccctggtagggacagccccgatatgcagggggggactgagcgtttctgtccgggctcccttgtgtggttctgggcgtgagcagactgtgttggtgccagtgaagtgacctaagcagcagcgccagacctgtggcgctcccacccagctccattcaaacaaggcgggacctgccagagacggtgctcgctggcagcttaaatccagctgctggaggggctgtccctggtgagctgggcccgggcagatgacttggcatcttctggaagcctgcctgacgtgcccagtgaggacaacatgttgtttactgttcaacacacgcatgtgggacctgcacgaaagagtcatttttctaaactgcaaaatgttttgtgaaattgttgtctgtaaacacatgccaggatttcaaaggaagcggcaaataaataaaacatataccagcatgtgacatgtgtccaaaatgacttactccccaaatccagctgagtttatgtggctgcataatgaacaaaaggcaggttactaatccttaactgcaaactggttcaattctgctacaatctgatctaagcccttgctgaaggaatggagcaactcattcatttttttttaaagcaccgaggtgccactgtccactgggtgaaatgctgtcctcggtgctgccgctgagcttggcaagtgcgcacaccctgacacctgggccttatccacgcaggggcgtcccttcattccagaaggctcctcaatgccacttcaagtccgtctataccccttctccaccctcagcgttccccactgctctggtttctaggacacagcttaaagctctatgtagacaaaccccacgctatgtctgtgtttgtttgttggtttggcttcttggttttctgttgtttgtttctcagtttccctctgttgcccaaactggagtgcaggggcataatccctgctcactgtagccttgacctcccaggctccagtgatcctcttgcctcagcctcccaagtagctgggacgacaggcagacgccaccacaaatggctaattttttttttttttaagtagagatgggggtctctaccaaaaaaaaaaaaagcctgcaaatcctgggctcaagcaatcctcctgccttggcctcccaaagtgctgggatcacaggtgtgagccactgtggctggcctgtgtctggctgcttttgctcagcaaagcatgtctgagactcctccacgacgcagggtgatcctcaatttgttccttttaccgatgaatagtattacaggacaggacgctaccattatctgttgattcattctcctgttaatagagatttggttgtttccagttttcggtaattatgaatcaaagtgtttttggttaaatgttgactttatagaggagttcacagctaggaacaggacagctggtcagggagtaggtgtgtacttaacgtcacaagaaactgcacacgtttcccaatccagtgtctgagagcgcagccgctgggcccgtgcccactctcccccgagcccgtcctggtttttagggacgggtgacccccgtctagtcctgtctcgttggtttcatcagcacgtccctgactggtgactcatgccgttccacatctttccatgtgtgtaccggctatttaagagatccttctgtcaagtcggctggcttcatctgcccccttctaattgggtcctttgtctttttggtactgacacaggcttttgtcagagacacatgcagcaaagcctgcggcctgcctattcatcttcttaactgcgccttttgagagaagtttttaaacttcaatgaagtctaattggttttttcctcttatcagaggagtttctacatcttaaggaatctttgccaccctcaaattcatgaacatattctgtgttttcttcaaaaagcttaatggttctagtttttgtttagatctctgatccgccctgaattaaattttgcatacagcatgcagtgcactttttccccattccgatatccagctgttcatgcaagttttgttggaaagagtttcctggctgggtgctgtggctcatgcctgcagtcacagcattttcggaggccaaggtaggaggactgcttgagcctgggagttcaacatcagcctgggcaacatagcgagaccctgtctctacacacaataaaaaaaaattagctgggcatggtggtgtgtgcctgtggtcccagctgaggtgggaggattccttgagcccaggaggctgcagtcagccgggctgagtcgagatcacaccactgctgcactccagcttgggcaacagagtgagaccctgtctcaaaaaaaaaaaagactttcctttctctttttcctcactgaatcgctgtggctgtggtcccggccccctgccctttgggtatggaattttttttctgtactttctattccatcccactgctctattgtatcctcatgctgacaccacactgccttggttactgtagctttctggtaagtcttgaaatcctgctctttgtcaaggaggttgttttgggtctcccaggtcatctgcatttccacacacgctttggagtttgtgtgccaatttctagaaaagccgtgggagctctgagtgggactgcactgcatctctgcgtcaacttgtggagaacaggagtctcagtaatacttagttggcttatattttgagagagatttttgcatctatgttcttgaaagtcctggtctgtgaacatataattatgggcacacacaggactggtctgtgaacacacatgcatgtgcaccagtactgatctgtgaacacacatgtgcacacacagcactggtctgttaacatgcatgcacaccagtactgatctgtgaacacacacgggcgcacacacagtactgatctgtgaacacacacatatgcacacacagtactggtctgtgaacacacacgggtgcacacacagtactgatctgtgaacacacacatatgcacacacagtactggtctgtgaacacacacatgcacaccagtactgatctgtgaacacacacgggcgcacacacagtactgatctgtgaacacacacatatgcacacacagtactggtctgtgaacacacacgggtgcacacacagtactgatctgtgaatacacacatatgcacacacagtactggtctgtgaacacacacgggcgcacacacagtaatgatccgtgaacacacacgggcgcacacacagtaatgatctgtgaacacacacgggtgcacacacagtaacgatccgtgaacacacacgtgcacacacacagtactgatccgtgaacacacatgggcgcacacacagtaatgatccgtgaacacacacgtgcacacacacagtactgatccgtgaacacacacgaggtgcacacactgcactggtctgtgcacacacacgggtgcacacacagtaatgaccagtgaacacacacgtgtgcacacagtactgatccgtgaacacacacgggtgcacacagtactgatctgtgaacagacaagggtgcatgtgcacaccccctcccccaaacacagaatccttatctggcttaggtatgagagttatgatggactcaagagatgagatgggaagtgttccttcatctattttttaaaaaagagtatcccttctttctttctttttgttttttgagacggagtcttgcactgtcgcgggctggaacgcaatcttggctcactgcaacctccgcctcccgagttcaagttattctcctgcctcagcctcccaggtagctgggattacagacgcacactaccacacccggttaattttttgtacttatagtagagacagagtttcactatgttggccagactggtctcaaactcctgacctcgtgatccacctgcctcagcctcctgaagtgctgggattacagatgtgaaccatcgtgcctggcccctcctttcttgaatgttagaattcactggtgaagccatctgggactggagtttggtggaaaagtttcgtttatttttctttgagatagagtctcactttgtcacccaggctggagtgcagtggcacgatcttggctcactgcagcctccgcctcccaggttcaagcaattctcctgcctcagcctcccgagtagctgggattacaggcacttgccaccacacctaatttttatatttttagtagtgacggggtttcaccatgttggccaggctggtcttgaactcctgaccccaggtgatccacctgccttggcctcctgaagtgctgagattacaggtatgagccaccacgccaggccaggtcttgctctttaatccactccacaatcactgccttttaactagtctttagtcttcttacatttaacgtaattattttacagatggttttaagtctacaatcttgtttttatttgtcccatttgttctttcccccacctgcccttttctgctgtttcatgaatttaagaaagcatctagaatcctactttatatctgctattggctttttagctacatttttgtttttagtggttgctctagggaattaggttatgcatccttcgcttagcaaagtctacctggaattaacatttcatgtataaaggcagatctttactgcagcagtgaactcccattcactcactcaacaaacagttgtccatgtgcctcgtgcagtgttaagtactagaaactcaatgggaaaaacttgtaactaatcattcattgtatttgctacaataagataaccgggacatcttgttgaagtgtgctaccagaagatttggtcaatattcttgtgaaaagccctggatgtgaactcctaggctcaagagatccactcagccctccaagtagctgcggctgtaggtgcccgccattgtgcctggctgaaaaacacttttatgacatactcaaaataactttcatgaatgttgttttatatatttccacactgtaccaaattttactcctaaaaattcctcatacgtccacatctggattttcaaatattcactaaaaggaaccagaggtccttgaagaaatggtagattccagggctggagcagggaaaatgcccagtaaacctggaacatcttgtaccaaacgcaagaatgcaaagaactatgggaggtgtcaaaagaacagaactgacttggaagggttgccactggccaaactggagacaatgtcaccatctaatagaataataatagcaatggattatcacacaacaaataaaaaatcaaaaccaaaaatgctcctgagtccacggtgagatttaaacaaaggggcagggtcttcagcataaacacagaaggaagaagagagggggaaagtcactattttgcagtcagcagtgtaagaactgattcaggcaggggtcacccagggatgctgagacaaatgagaagacagctgctgggagcaggagagccgcgctgcttcagtgtcacctcctggattcctcgctggtggggagacgaacgggcagatgcagacttaatcaagtggtcaaacttagcatcatgaatgatgggacaaatggacacttctgtgtgtcctgatctgcgatgcaatgggaagctacgcaatgtcgcctacgcagccaaaacatttgccctgaacccanccacggggacacagcaggacgaagcccaactgtggaaccatctatagaggagctggcctggaattctcaggaatgccaaggtcatgaaatacacacacgaacggaggagggagggaggggagtggatgggatgggcgggatgggaaggggtgagagagagcaatgtggcaaaatgtcagctcttgtggaactgagctacagattttatgcatatgggtgtttattgtacacttttttttgaaagagagggtttcactctgttacccaggtggggggtgcagtggctattcacaggcacgatcacagcccacactacagcctccaactcctgagctcaagtgatcctgctatcttggcctccaagtgctgggattataggtgtgagctactgaatctggccccattgtactattttaaaaacttgcctataagttaaaaaagtttccaagtgagaagtcagtgaaagaatcaggcaataatcagtttacagaaatgacccttcagggccgggcatggtggtttatgccagcactttgggaggctgagataggcagactgcttgaggtcaggattttgagaccatcctgggcaacatggcaaaaccctgtctctactaaaaatacaaaaaattagctgggcatggtggcgggcgcctgtagtcccagctactcgggaggctgagacaggagaatggtgtgaacccgggaggcagagcttgcagtgagcagagatcgcgccactgcactccagcctaggcgacagcgagactctgtctcaaaaaaaaaaaaaaaaaaaaaaataataagatatatttgcatatgtgaagtaatatgtaactaaagctattctaaattattcaaaaatatgtaactctaaatcgattctaaaataaatcattcaaataatatgtaaaatgaccttttctactatagaccagtcaacaaaaaggatgtacaacttagaaacctgaaattccaagtgttaggtgaagcctttcagctctgaatatgccaatgtgggaaaagctgggggccacggcatcacctgtctttagaggtgaatggtaggatacccggaaatatcagacatcacatccgctgtgtttgcaaaaactccccacatgaaagctgagctaatttcttacgctaaagaaacaccatgaacagctcttacaatgatcggtcccccaaggtttgggatttaggaaggaattatgcttccttttgagcctgtagaaaaggaaaattgggaagaattttactgaatgtggttactaggagggcttgtttatgcctatcttcagctatgtaatgtcgtaagaaacatattcaagtgggaaattttttattttaatcatttaattgcatttagaggcaaggtctcgctctgtcacccaggctggagtgcagtggcgtgatcatagctcactgcagcctcaaactcctgagctcagctcaagcaatccttccacctcagactctacgcttgagctcaggagttcaaagcatccactgccatgcctggctaattaaaaaaaaatattttgtagagataggttttcactatgttgccaaagctagtcttgaactccaggcctcaaagtgatcctctcatcttggcttcccaaagcactggaatttcaggtgtgagccattgtgcctggcctcaaatgagaaatttttaaaaagcttcgatatacaatacaagttcctgggagccttcaaaaattgaagatatattagcaaaactgttcatttgattagaaaatagcaaggtttcttttttgcgtgtataagggtatgaagtgatgaaacgtttaaaacactcgcaaaaatgtagagtgaaagatcaaattgatttatcatggagtcaaatccaatttcactgcagaggagtgtaaatgcttgtcaaactttaagtgttggccagggtaaaaataaggaaagcaggctgggcacagtggctcacgcctgtaaccccagcactgtgggaggctgaggtgggtgggtcacctgaggtcaggagttcgagaccagcctggccaacatggtgaaacccaatctctactaaaaaaacaaaattagctgggcgtggtggcacatgcctgtaatcccagctacttgggaggctgaggcagaagaatcacttgaacctgggaggcagaggttgcagtgagccaagatcgtgccattgcactcccacctgggaaacaagagcaaaaactccgtctctaaataaataaatgaataaataaataaataagtaaagaaagcaagcatattgtttttaggatatattcagagaggcaaatgtgtaaaattacacttaaaaagcccgtaaagctcccaaggcatgtgtatttttcccacagaaacataagagctaacaccaattccagaagaaaaactagatgagcacagtcagtgcggcgttagagaaaccgaggagagtcagccagtgttcagcagcgaacccaaggtgtaacggggttctgaaaacagggcaagctgtgccaacctcctgtaggtcagccactgttttgtttttaaaaagtggttttcaccaagatgtaaattctgtgactcttaaatgtttttacatttttaatttctgctgccagaaatgttaacctgctttctgaaaaactggctcctcatcaagaaggcctttggtttaatagtgactcctggagggagggtggagaggaaacattctgcaccagcgccgccctcttcacacacacccacccgcgccgccctcttcacacacactcacccgcgccgccctcttcacacacgctcacccgcgccgccctcttcacacacactcatccgcgctgccctcttcacacacactcaccgtcgctgcatctctgcacacacgctcaccggtgccacacgaagtgtgtgcagagtgtggcaccggtgagtgtatgtgcagagtgcggtgccggtgagtgcgtgtgcagagcagagaatccaaacccagaaccagtgctaaagagttctcctgtcttgcaactttacacatttgagacaaattagcatgggaaacttcacttatacaaataaaacaaaagacccccagcacaccaccctgtgaatctttcacacaatcggcaaatgtggtaggcttgcttccaggaaccattagaatttaaacaaaccaatttttaaaaacctggcagtagtttatgaactttgaaaagttaagtataggcctgcgcggtggcttaggcctgtaatcccagcactctgggaggccaaggtgggtggattacctgaggtcaggagtttaagaccagcctggccgacacggtgaaaccccgtctctactaaaaatacaaaaattagccaggcgtggtggtgggcacctgtaatcccagctactcaggaggctgaggcaggagaatcacttgaacctgggaagcggaggttgcagtgagccaagatcgcaccactgcactctagcctgggcaacaagaacaaaactctgtctcaaaaaagaaaaagttaagtataaaacaaacaaaaatctgaaaaagatcttacttggacttgcagggcacacatgcacatgcatacacgcgtctgcttaatgaaagcggcactgattttaaacgttctacctagctctactgggtgtcctgtgaaggacatgggggtcatgagggtaccagaggtgctgcccccttcacacccacctcgaccgccgcactgtccgataggcactgggaagagaatgctttgcttttgagtgtgatctagacctggacttggatgacgaatggtacttgggagaacgtgatcttgttcgagatctttttttgtgctttttctttttcttttctttctcttcttctctcggtggatctttgcttttgctcgaaggcctatcgggtggtttaacttctaaagtaggcagaggcctgcctccagtcagtagagggcagggcgtagtgctggattcctaagaataaaaggaaaatctgggtgttaacagggaaaacagaacattgaagatgtatatctataaaatttcaactttgggcccctcacaccaacaaacacagcaaccatctcttagaaagtctcctcctgtggctatccagagtgacctccttgtcacctcccaggatgcaaaatcagaaagtgaaccctctggttcccgagcatttccacaggcagcactctcttcccagcccccaggctgtggacagccggagccaacaatagcagcgcagtattacagtattagagatgctacgctgggaaaaaatacgttcctttttagttcaaccattgtggaagtcagtgtggcgattcctcagggatctagaactagaaataccatttgacccagccatcccattactgggtatatacccaaaggactataaatcatgctgctataaagacacatgcacgcgtatgtttattgtggcattattcacaatagcaaagacttggaaccaacccaaatgtccaacaatgatagactggattaaggaaatgtggcacacatacaccatggaatactatgcagccataaaaaatgatgagttcatgtcctttgtagggacatggatgaagctggaaaccatcattctcagcaaactatcaccaaggacaaaaaaacaaccaccgcatgttctcactcataggtgggaactgaacaacgagaacacatggtcacaggaaggggaacatcacacaccggggcctgttgtggggtggggtgagcggggagggatagcattaggagatatacctaacgttaaatgatgagttaatgggtgcagcacaccaacatggcacatgtatacatatgtaactaacctgcacgttgtgcacatgtaccctaaaacttaaagtataataaaaaaaaatagttcttaaggaaaaacaaaaaaaacagttttaactaccagaggagagattcctcaaacctccgatgttaggtttttaaatgagtatcggcactactctgacaataatttttaaagaaggtctaggctcccctttgatgttttaaaacctctccatctgagtgttacatacatacagaagagcatatgaatcttcaatgcatgctgacacatttccaccacagcgcatcggaaccagatcaggagacagcacccttcaacagcataggcctgcagcctgcccctctttacccagaaagctcactctctcctcacttcaagtgaattttaaattatagctgttaaacatttcacacctttagacacagtgaaaaatctgcaatttatcctttgtgcctcgaagaaattcaggttaggtgctggggtgggacccagtctcccaggctgcccccagctgctccccggggagagctccagcccagcccgcggcagtgtgcgcaggacggcatctgtgaaaggcaaagtggtaagggggcttccctcccttctttcctctccttaggtccgctgtggcaaggccaactggctgcgggaaaacactgtagaaacgattcttctacagttatgcttcttgctttggctttgagatcaaaagcaattcagcagagccctggtggggcaggccccaatttaagatgagtttccacttgagctggctgctttatgatggcacggtgatttctcagccctctgttcagcctccttgctgtttccgtttacactgtgctctctaatgcccctccctggttgtgggtgtgcggcgggcaagagggcagggatgaattcctccttgggatctgatggccgctatgaggttcatctttaagtctctgcctaaattatctccagggacattttggcaaaaaaatccactttactgtgggacagttcttatcaaaaaggtctttctcatttaaaattctgttaagtgtaacaatatttttcaggtcaaacttttaaatattttattatttttgtttgttttgaggcagagtcttgctctgttgccggggtggagtgcagtggcgtgatctcagctcaccgcaacctccgccttccggcctcaagtgattcttgtgcctcagcctcctgagtagctgggattacaggcatgtgccatcatgctcagctaatttttttttttttttttgtatttttagtagagaaagggttttgctattttggccaggctggtctcaaactcctggcctcaagtgaactgcacacctcagcatcccaaagtgctgagattacgggcgtgaaccaccgtgcccagctaaaatattttattgcttacataattctaacacacaaacgtccaatgacaaagcaagctctatatccaagaacacccccactctggcattagtcaggatttgcccacaagcaatgctaaatgatcctttaaattaaacatacaataaataaaaaggtagtaagctttacaacttcagaggctcaacatcctagctatggcctctcccatacacaccgaaagggagagggcttccattctgcaaagagcaaagaacacaggtttgcgagctgagcacatcctctgaggcgagccctgggtggacaccagagaaatcagctgatgcactaaaaaaatgccagtatccacggcctctacatcaggagcacacgctgcgcagaaagcaagccggcccaggggctgaaagacgccattgggaacctcaacacgggcacctgtgagtgttcgggaagtcagagctgctgcaggtcctttcaacaaggcccgggatttccccaggaaaacaaagagagagctgaagagaaggagagctgagacacatactccaccctcgagtaaggagtttgttctgtgacgagaaggaagagaaacacgtctttgctgtctttttctggtgaagaactctcctcatttactctctccacgctcacaaaatcactgcactaatttggtgtgtgattggtaaggcgctgtgttaaaacagaggggagatggaaaaacatggtccctggcaaacgtctgtgaaagacaaaaccaaacgggcgcgagacgccatctgaggcacagtcaagacaaacaggagtgcgaggagtcaactctccagctgagtttctattcatatttctactgccaacttaatgatttgagcctccaaacttttttttttgcctttatcctaactaatgcctgtcattaataatacttatctcaccactgtgcttaaagactagggctccattttgaagcgacgggacaatctgaatcaacactttcaaatgtcacttgtaatcaagtccaggtctatttattccaacaacacgatcatccttcaccatgaaggtgaaaactagagctgttgtgacctctgccaggctgaattaagatggttcattatgttgacattactgcttttttcagcttcaagtgctaaaagtgaacaaggactgatgccaaacacagcttcccagaaaccacagctgcctttgagatgcatttttaatattccagcaaaaatgatcaaaacggaagtcatgtttgaatgtaggggggcagacgtacattggtttaggtagagtccgggacaaagcaaataacttctgaaaaatggtcatttatgagagcattaacagcttaccgccggccacttctgtaacactggaaattaacattgattagtccccctgtgtcacgatgaagtatttggcaacaaaattagcacatgaaccagcaacgattatttcctactgtggcaaaacaaaccgctcaaaagcagactgactttgtatctgattgtatttgaaaataaaagaaatcttatttgtgaaggacactacattaactatgaaagggataaccaacactgcggcgttgctctccatcccttcacccagccccactgccctaccacgtcctgcccaggtgcatcctcccacccctgcctccactctgctccagcgccccgtgccccgcagccacactgtctcagcggaaatgcggctctcatcctgtcggtctctcgtgctcacttattctggcgtcccaggctctccacaactggcctcccattgtcattccggttctgcctgagaaagtgtcttcctgagtggggccacctgtcctttaccacttgtgggtctttggccctcgtgggccctcactattctggtaagctcctcaaggcctcgcctgagccccaggtcccggagccgccactctcctcctggctgtgctgtcctgatggaaatgcccatgtgtgaacagcaacagctcaaatgcagtcatggtcactggttaacaagcaagcttctaatgcatatcccaaagcacctcagcacctagcacacagcagagattcagcaaacacaggcaggtttcagttcctatttccttttcaaactcttactggaattgtaaacttggcagatcagtaacttgaaaacatttgtgggctgggtgcagtggctcatgcctgtcatcctagcatcttgagaggccaaggcgggagaactgcttgaggccaggagttcaagaccagtctgggcaatatagcaaaatcccatctctaccaaaaatacaaaaaaatttagctgggcatggtggcaagtgcatgtaagtcctagctactttggaggctgaggtaggaggagtgcttcaggccgggaggtcaaggctgcagtgagctgtgatggtaccactgcattctagctcgggcgacagagtgagactctctcaaaaagaaaaagaaaaaaaatttgtggaatctaagaaatcatcctgcagtctgttgctactatgtaaatgaccgcatgaaaaaaggggttcaatgaagacttctcccttctcttcatcctggattacgaacacacactaggaatgaagagagaatgtatgtgatacaggcaggaggcagggaaatactggtgagggcttcacactcaagcctggacccgtggcccaaagtgacaactatccctgttttcccacctgaatgttgccttttggcctgctctgccccctatcctgtgcccataagaaccccagactccagacaaaggggacacacacagaagagaaagcatctgagcaaagagaggagaggaagcagctggatgttggagaggagtttggctgagggatggccagactccaggggaaaattatcttcctgctgtacccccttgtcagcttccctttctgctgagagccacttccacagctcaataaagtcctccatattcaccaccctttaattcgttcgtgtgacctgattcttgctggacgccggacaagaactcaggtaccaagagggcagggtgtaaaggctgtcaccctgaccctgccactgagctgattaacactcaacactgattgtaacacaggctttctgaggctccaggggtcacagacacccactcccagatggcagagctaaaagagcattgtaatatgcttggaggctgccgtgaggccagcgcagagcctgctcccgccagagaggagagttcctttgctctggttcccgcacctgtccgttcgtgtggtccctcccgtaagggattgagtggcagccgagaaaacgagccaccccctgtgccagtcctgagaagggtcaagggatcttcccattttcttatgcaggtttatatgcatgatttttgcatatgcttttatatattttatatgccacttgaaaaatttagagtgctgccaatatctttccatgccaataggcacactttaggacatcatttacaactgtacctgaatatgtaaaatcacctttcctaacgatcaacgggactgaacaggaacatggatgcagaaagatcgagtacaaatgggaattcagcacgttgtaaagaaggctctgtgagtcactggggaaaagatgtatgacttagtgaatgcgttgcatcgatagtgacgtgctcctcaaactcaaataaattccaagtatggcaggtcagaaatgtaccggggaaaaaatgtttgtgacactgatgacaaacagctaacatgacgcagcataagacaaagaaagggcccttcctaggtcgaagaaacatgggcccaggctaagggaaagccagttcaaaaggcagcagacaatgccaagaaacattagcaaagtggccgggagcggtggctcaggcttgtaatcccagcactttgagaggctgaggcgggctgatcacgaggtcaagagattgagaccatcctggccaacatggtgaaaccctgtctctactaaaaatacaaaaattacctgggcgtggtggcgcccgcctatagtcccagctacttgggaggctgaggcaggagaatcacttgaacccgggaggcagaggttgcagtgagccaattgagccgagatcgcgctactgcactccagcctggagacagagcgagactccgtctcaaaaaaaaaaaaaaaaaaaaaagagacattagcaaaatgactcagtgttacttaccattaaatatgtaagttaaagcagatgctgctttcccaccgaaaggctgatggtaaccaatgccgacagggacatgaagaaatagttcgcacaccctacgggggcaaataaaactgctacggtcccttcagaggtcaactgagcagtatctcaaattaaaaaaggaattccatggtgaggatttcccccgtgggtgcactcactggagtacacaagacacaggacacagattgggtgaaagcggcatcgttcacaaagacagacccacagctcacatttcccacagcaggggaggggcacacacagagggggtgatttacaggtaaactacttaaagtcattcggtcactaaatacctaccgagtgcctgtaacacaccaaacactactgtaagcattgataacagaaggatctctactgtaagtgaaaaaagttgtcagaaaaatatgtagggtatgatcccctatgaggttttacacctccacatacatgaatcgaattgagtttttcccctcaaggattcacttggcctcccaaagtgttcggaaacaaacggggtagatgcacacgaccgagcaccattcaactgtaaaaaggaagggggtccaatgcggctgctgcatggctggacccagaggataccacgctaggtgaagtcagccaggcacagaagcacagacactgcagaatcccacacacatgcggtccccaggagtcccgttcacagaggctgcaagcaggtgggtgccagggctgggggaggggagggcagagagttactatttaatggctacagagttttggttttagaagatggacatcctgggaacggttgggtggtaatagttgcacagtgtgaatatacttaatgccagcataaactgcacagttaaaaacggtaaaatggtaacctttatgttaaaaactcaaactctacagaagggagagaattggaggaattttaaaaagtgccatttccacaggaattaaaaaaatacacaagaaagaaaggacctctcctctttgttttatacctttctctagcattggaactttaaaaatcatatgtatacatcagttttatagaaagtaaagacagagaagtgactgtccttcaggcacataagctgcactgtggctgttttcagttaactttaaggtgacagcaaaattcctgccatgttatgccaggccttgtgtaagggagtgtcctcatgccaccctgcagagccagcccgagctagccacggccccgacagacctgggggtgccatgagcctcctggtgccgacgtgccctcagccacgcaggcttcctcacccagggcgtgcggtggccgaatgtggtcttgtctcaagtcctcctggactccgagaatttcacaactacatagctgggtcaaatgtctcaacatcagcgagtaaagcagatgctagaatacttagtaaagtcaagggtaacctgtcccagaagttgttttaggctaaaaatattttcgagtttgaattttctttatggcaattgccaatttaattacaagtatttttgtttcagaagcaattaaagacatttatcatcatctgctacaaccattacatttttgttgaaatggcttggtagctgtaatctgcatacacagacacacacatatatccagggagagcatcctagtgatttaaacgctcatttctatgttctacagattcaaaaaccaatgcctgcaaacaggagaggtgagagggtacgtgtaaaaataaataggacagattgagaccatcttggctaacatggtgaaaccccgtctctactaaaaatacaaaaaaattagccgggcgtggtggcgggtgcctgtagtcccaactactcgggaggctgaggccaggaggatggtgtgaacccgggaggcggaggttgcactgagccaatactgcgccactgaactccagcctgggcgagagagccaggctctgtctccaaaaacaaaccaattaattaattaattaaattaaattaattaattgggccccggcctaagctgtaacatatcttatgtttataaggaaataattctggttgctgtgatgcggaactacagcagattgggaaaaactgggctagtgataaattatacttgtgactgagtttcactggaaattttatgacgacatacacgtatagtcatgtaatgtaactggttaaagcattcctgtgaatgtctttcaattaacccctttacccgctgcacaaacgatatcaaaacatgagaacccgtacgccactgtaacaggtcccttactttcttaaattcccttccctccttgctacatgcatattttcatggctgtaaccacagaagtggatatattttatactgtgcttctcctgcttattacatcagaagcattttctgtgtggctacaagcgtcctcatgatcatttttgttgttgtgtatttcatccacttattgctgcagaacatcctttatttatttagagacggagtctcgctctgtcaccaggctggagtgcagtggcgtgatgtcagctcactacaacttctgcctcccgggttcaagcaattctcctgcctcagcctcctgagtagctgggattacaggcacacaccaccgtgcccggctaatttttgtatttttagtagagacagggtttcaccatgttggtcaagctggtctcatactcctgacctcaaatgatccaccctcctggcctcccaaagtgctggtattacaggcgtgagccaccatgcccagccatgagccactccatctggcccatgcatttttcttactgctgcataatactccactgcagaaaaatataactgaggattgggatctttccaccttttttttttttttagacagggtctcagtctgttgcccaggctggagtgcagcagcaggatcacagctcactgcagcctccacctcccaggctcaagtgatcctcccatctcagcctcctgagtagctaggactacaggtgcaccccaccattccaggctagttctctgttttgtgcagagacaggttcttactacattgcccaggctggtctcaaactcctgggctcaaacaatcctcctgcctcagcctctcaaagcactgggattacaggtgcccatcactatgcccgcctcttttctagttttttactattatgaatagtactgctatgaacatcataaattgattttttttttttgacagggtcttactctgtcacccagactggaatgcagtggtgtgatcacagctcactgcagcctcgacctcccaggctcaggcgatcctcctgcctcggcctcccaagtagctgggaccacagaagcaccaccacagcaggctaattttttaattatttgtagagatggggtttccctatgttgtccaggatgattttgaactcccgggctcaaacaatcctcctgtctcgacctcccaagtgctggagttacaggtcttccntctgtatgtggaaggagccgcgtcaagttgtttaa

SEQ ID NO: 870 - DNA, 1035 bp, Homo sapiens
atgcgcggatggcgcggtccttccagcccgagggtgaagaccacttcccccatccatctggcatagtctgtaagaaaccctgttccttctttttccaaccttgtatataaccaggtgatttgaaattttagagaatacatgctgtctagtctctctttttaatattagttcttcacatttccatcaaatgcagtcaaatctcaactgatccctaggtataacaataagacatacagagtggatgatattgactgggaccagaatcccaagagcacctttaagaaagccgacggctctgaagtcagcttcttagaatactacaggaaggtaagatgccagtggttagatctcaggagaaatccaaaatatctttggtagaattctctaacacttgttgcacatttggaacaagttgcgtttaaagctgtgtgtaaatgtatttgttagggcaatcacagcataattttattcattaccaaattattaaaatgcctctttttatttggtacagttcacataatgagaaatgccctctcctggttccctttttccagtagaatgaaagcttacgtttgaattgaagcctatggaggacaagtaggttggataacaggtggcgagcagtgggagttaagagcttgccatactgtctctccctccataatcaacatttcatttaatttcaccttggagacgggtaggaattaaagatctttgaaccttcagtatcatttctgctaaatctactgcctgtgggttaactcttaacttttgattacatgttaacaaaatgcagacgggcttgttagcacaggctagaacagtcttttgggcgatcatctaaaacagtttttaaagagatgaatctaattttgaaaagaacattaaaggccaattgcaggaaaagaccactttttgactagaagaaactgaacttgttcttgtaagaatgcctgcctaacattggttaggccctcagaagaaccgatctggccccccaaatccttaaacggcccatttcctttggattggtaa

SEQ ID NO: 871 - DNA, 1566 bp, Homo sapiens
  misc_feature (1)...(1566): n = A,T,C or G
ggaagacaaagcagcaagcagggtctcatggagaaagatcaccacacttcaccagacacagggccacgggtgccacatcacttctggggggaaggggaagaagaagaacagatgtgtatgagttgattgatcagaaggtagaggaaataaatactaagacttgttaaatgaattataaaaatagggcctggacaggagatgccatttagaaaaggagaaaaatgaaggcaattcagataacaaggtgagtgacagaaccggacaaaagagtactatgaggcaggggaaggtgcggagatctgacgtgtgactcatccaccatttgtttattcaaatacccaagaacctacttaggcatggggtatataaaccataaaatctcttgcctctgtccaagttaccttatctgcattgaccaagagcaccgagtaggggccgtgttgagaagacagaacacattcaacactggcaacatgggagaggtatctttgagtcatccaaatacttaagaacaaccaggcagctaagcttagacaagtctaggctggaactggaagtctggggattcttaacatttcatgcctgaagcctgggcagaggagactggaaatcacccagggagtgaacatatagtaaaaggggtctgggcagagctcctaagtatgataacacgtanaacaccacttacaggaggatgagctgccacaggacactcagtaccagtcagggaaggggagagggttcactgaccttggctcaggtttaaatcacattttcagctaatgttttctttatttttgcttgtgatataccaacttctaccatccctgagagtgatcacttanaattaccgacggaaaaatgcccccacttatttcctaacagtaaccttctgacacncagagggatccaggttaggcatggttggagtcctcaaggagtaaagaggctgaaaacagtgggaggaaagacatgctgaaatgacccctggctgtttccatcttgccaggaataaggtcagcccttcatgcagcgtctcatagaatccctccctccgtagtggcttctcatctttttagtcacagcagagcagctggacagcagcacacagacctttccaaggccactgataagatgcatactttccatgcaaaatatgaatacttttcatatttaagctcatttatccaaatttttagaaacaggaaatactctattgaaagtagaagaaaatgtgaaatgttagcaattcaaagacaagttttgagattttaattgatagttttctagaaataatcttcctgcgcttttaacatatcaaatggaatgtgacgttctaaggatttgggggccagatctgctcatctgagtactgaaacaatgttagcatgcattcttacatgaacagttcagtttcttctagtcaatagctgctctttcctgctatttgcctttgatgatcttttcaaaactagaatcatctctttaaaaactgttttagatgatcgcccaaaagactgatctagcctgtgctaacaagcctgtctgcattttgtcttcatattt

SEQ ID NO: 872 - DNA, 1125 bp, Homo sapiens
gatgattacacaagcgcgtttccttccggccccattgtgaagactcacagcatgtccttaatctgtctctcatcagcagactaagggtgcttgcatatttcttattcctagcatatggcaaggtcctggccacctactacaagccctcgtgaattaagaaaccatgaattctagcccgttcttgacttgtttcaaataagaaaattttaagtagaacactcacatctgacctctgcttcacgtagctatactacctattttatcacattttaaaatgaggagtctgggaacagttaccctccacaccacatcactgacttgcaaacacaggtggtagaagtgtggtcgtaatttcagaaatgtgtcctctctcaccctatttcacccaaggccttaagggcatggttcctgatacagaacttgtactcgctacgccccctccacttttatattcttaggtgccaaacagcctgtcattcattcattcatttatttatttgagacagagtttcattctgtcgcccaggctggagtgctgtctcggctcactgcaacctccgtctcccgagttccagcgattcctcctgcctcagcctcgcgagtagctggaattacaggcatatgccaccacacccagctaatttttgtatttttagtagagacgaggtttcaccatgttggtcaggctggtctcaaactcctgaccttaggtgatccacccacctcggcctcccagagtgctgggattgcaggcatgacccatcgtgcctggccctgtcaaatatttttaaacatttttctctacacctgaaaaaacagcactctcaattttattagacattactggttaaccttttattttaaaaccaactatgaccttctctaccaaacacccttcctttctctactctgttcctaaatttatcttcaatcccaaaccatcacttactagtaaaactgctttcctaccagaaatctaagaaggctttgattcttttaatatcttacggcaacctctttcattaattatttctactaagacatctgaatatccctggatttccgaaaaaatcttccttaaaaaaagaacttgaactgggaactcaggcataagccttccagggg

SEQ ID NO: 873 - DNA, 1229 bp, Homo sapiens
atggcgcggctccttccagccccgtggtgaagacgtacgcacacaatccacgtagttaatccatgaattagaacaggtagcaattagaacagcactgccaggtagtaagcactagataaacatgattattagcacctccatctccaactacaacattagttccttaagaggacagatacacttgatttccaatgctgggaagcagagggttttatacagtatggacctagtaatgtctgactcggcaatgttgctgatgtttttcactgaaaattgaatagggcaagaaactcagtgagagtacttgagtaagcagaggacatcttcagaaatgtccctatctgcctacgcagactactgctgcccagcgactgcccgtgctaatagctctgaatataacaaagccacaatgaacgtgttgaaaatgtgtgcagccctctgtttcaaatgcctctgccacttacagagattaagttcagcatagggccttgttagaaagtgatgactatctaggacttcatgacagcatctaaaacaagtatcagtcttaggaacggaaggacataaggtggataaagttaatcctataacatcacgagaaacaatttagcaaatatagtaacaaaaacaggtcacaaatatgctggcatgactttctgatttgttcttgcatcaaacagtctaaatcagctgccctgtgatacgttgctataaaagcttaaaagcaacatttcaatttgaaagcaaacattgtggttctaatgataactattagacaaacattgaagtccaaactttgcattttctaaaagtgaagaataattttcagatattttacctttatgtacaacttgaaggtttttcccagaactatctaccatgtattgaatacttactggatactgtgtgaagtccattacgtatattttcatttacgccttgcaatgcctcagttaactgttcccttcttctacaaacgaagctaaagctgggattaaccaaactctgattttaagacatattgctttttaccactgatccttactgccacagttcacagtgtgcagtctactttacgcaacagtgcactaagtgtcagcccagccagccgacttaggttttccttccttgccacgctgggtttccacttccctatgggactgggaaggcccacccacccactgcaccaggggccattttgcacattaaggacaatgggccccgggcct

SEQ ID NO: 874 - DNA, 1812 bp, Homo sapiens
  misc_feature (1)...(1812): n = A,T,C or G
attgcgcggctccttccagccccgtggtgaatactaacacctccctgtgctgtgcctgttcatttctccctcccctccaacccgttgtaaccactcatgttttcactgtctccatagttttgccttttccagatgtcatacattctgaatcacacggtatgtaactttctcaggttggcttctctctctcagtaatatgcatttaagattcctccgtgtctttgtggctcatttctttttagcactgactaatattccattatttgaatgtaccagtacatgtatccatgcacttgcttgaaggagtcatcttgattgcttccaagttttggcaaatatgaataaaactgccataaacatctctgtgcgggttcttgtatggatacaccttttcaactcctttgggtaaataccaagcagtgtgcttcgtaaggtaagactatgtttagttttgtaagaaactgcctgtcttttagaatggcgtaccattttgcattcccatcactaacaaatgagagttcctgttaattcacgtctttcccagcgtttgctattgtcattgtgggttttggccattctgataggtgtgtaatggtgtcatattgtcattttactttgcaatgccctgaggacatgtggtatggaacatattttcctatgcacacttgccatctgtgtgtcttctgtgctaaggtacctgttaaggtttttggccccttttttaatcaggctgttgtctcattgttgagttgtaagagttctttgcatattttagataacagtcctttatcagataggtcttttgcaaatatattgaatcctctttttaaaaaacaggttaggtggcacttagttatgggagcaattgaaggtagaatggaggtgtttgatgtttgggtaaagttactgcctttggagaattaaaatttgttagcaggggccacgaggcccttcctgatctggatcaacctatatcttcagtggtcacttcccatgtggaccttgggtcccaaccctatgaatccacttgcagctcctaaagtgtgtgttgtgccccggagtcgtctagctgcctcccgggtctggtaagcctggacctgtgaaccactgagttctcctcattgctgcctctgcaggctaaatacttcaacaaaaattccctgaccctcttcctgaccaccatgctgcttaggggcctgggccgccgtggtctgagcctgtgcccacggcagtttctgatgtgagtgctccagagccacttgctggccaaatggatttgtcgtcactttaaccccattctctccatttgcaaactgccacattgacaagcaaaatgattttctgagtaataactttgttaggcttttcaggaattctcagtaaatcattgataaaatcaggtgtcttcataatttctgtagtgctgaggctaatgagcttcaatgtcttcctcttctctcccctttacctcatttccccccaccccaaggtttatactgtttaattgttgntatattggccanaacctgggttgaatttttgccttaaactctacatagtttcagtcaaataatactacaaaaagccccaggtaagtatgcttttatttttaaaaccaattttagtagtacagtgttttggaaagcttgaattataagaaagtttacacatggttggttagggtaaaatattggttaaaggccttttaggaactttgtttcttaactttagtgtaaaccaaaatctcctttcatgaatacctcaccaggataatatgcaggctttattaatttcccgaatgtgccactttta

SEQ ID NO: 875 - DNA, 1394 bp, Homo sapiens
attgttaataaatattgttaataatatataaatataccataaattaagtgatacttattttccatttacagttaagatattttctttaaaagtaacgttaaatattgattcaattcaaagaatacattcattaatcatacagatggcgtctggctaggtgacgcatcatgacagtggtagggagtgactgaagttgagctggtgcacagactgccagttttacaacccgggaagtgttccctgaccatccgcttccccatgctgcccgccccgtcacatgagcccttaccccctggcgctatcccatctgctccaagacaccgatgttctagtgggtggaagcctccacttttagttgactacggtatctctagcatttcacacatagtaggtgctcaatgaatgtttgtcgaatgaatgaatgaaagaagggaggctgagagtagctgggacatttgctctgaaaaaatcacctccattctcccaatattacaaaagcattttcattaagtccacaatgagaaatgctcactgtaccaataaataatatctttagttatctatttttaaaagtatttcattgacaaagattgtctatgttccgggtgtacgtcttgatgaccggatgtgggtacacattacgtaaagactgtcagcatggctgagtgtggtggctcaagcctgtattcccagcactttgggaggccaaggcgggtggatcacttgaggtcaggagtttgagaccagccaggccaacatggtgaaactccgtctccactaaaaatataaaaattagctgggcgtggtggcaggtgcctgtaatcccagctactcaggaggctgaggcacgagaattgcttgaacctgggaggtggaggttgcagtgaaccgagatggtgataccacactccagtctgggcaacagggtgagactccatctcaaaaaaaaaaaaaaaaaaaaaattgactgtcccagtcaagttaattagtacatccgtcattgcccatgctgaatactaggcccccagaacctgctccacatgtaaccgaaagtctgtacccttattaaatctaaggaaagaggcttttaagaggaatttgtgatttttagtttggcgagagaaaaggtggtttgccgagtgataagactgaagtttgctatagtgatgatccaaatcctgtctcgtggaggctttacctcagcctctttataagtgaaatttatagccacaggcctcctgctggatgcggggctcagcacctcccctatccccagggagggccatctgcctgctggcattctccactgaggactggagggtaaagctgcgtgtccccctaggagaaggcacccaccacgctcaggtattcagccggggcagaagggccgcgca

SEQ ID NO: 876 - DNA, 1328 bp, Homo sapiens
aatgcagcgccctttcagccccgtggtgaaataccggatgctattcggacacctggagaagcccactctttttttttttttagtttcattttaagttccgagacacacgtgcaggacgtacaggtttgttacatcgtgccatggtggtttactgcacttatcaacccatcacctaggtattaagccccacatgcattagctcatgcattagctatttatcctgatgctcttcctcctccttaccccccaacaggccccagtgtgtgtgtcattctcctccatgttcatgtgttctcattgttcaacttctgcttataagtgagaacatgcggtgttaagttttctgttcctgcattagtttgctgaggataacggcttccagcttcatccatgtccctgcaaagagcatgatcttgttcctttatatggctgcatagtattccatggtgtatatataccacattttctttatctggtctctcatcaatgggcatttgagttgattccatgtctttgctattgtgaatagtgctgcatgaacatacatgtgcatgtatctttatagcagaattatttatatttatttgggtatatacccagtaatgggattgctgggtcaaatggtatttcgggttctagatctttgaggaatcaccacactgtcttccacaatggttgaactaatttacattcccaccaacagtgtaaaagtgttcctatttctctcagccttgccatctgttgtttcttgactttttaataatagctattctgactggtgtgagatggtatttcattgtggttttgatttgcatttctctaatgatcagtgatgttgagctttttcatgtatgtttcctggacacataaatttcttcttttgagaagtgtctgttcttgccctttgcccactttttaatgtttttttttcttgtaaatttgcttaagttccttgtagattctggatattagacttttgtaagatgggtagattgcaaaaattttctcccattctgcaggttgtctgttcactctgatgatagtttctcttgctgtgcagaaattctttagtttaattagatcccatttgtcaatttttgcttttgttgcaactgagaagcccgctcttaatgagcaccaaagtcatctgtaatcaccagcactgcaaatggtttgtgcctaagctgggaagccgggcttggattccagccctggcatgatttcgctgttctttctgaacaagtcatttaacatttcttaactcctcattctttgaaaaggtagctatgtcttcaccctcgggctggaaggacgcagcatgcgcgcat

SEQ ID NO: 877 - DNA, 2025 bp, Homo sapiens
ctttttagaaatttcccaaggaaatatgaagtaatggccattaagagggatatcctggctggtcaaccgtccccgaaggttcatttcccaaagctctttgccgagtcctcctacttctcaggtgggtgataaccaccctccgcttctgtttccttttgaaaccataataggtgctgagatgtgtatttgtgtgtaaagtatctggttagagttattttatgtggtgtcccggcttgctacatgataagaagtcagcacaattaaagcaaacctatcataggtttgtcagttaactcttttctgagttatgttcagaggctttttccttgttaaggtgttgacatagatttgctctttcacccaatttaacaagtgtgctactgaaattaagacacgcatgcagcctttggaattctacggcttcagaaaaatccaaccacattcatcaaaagtagtttcatttgggaagggtttttatgatactaataaaactttaaagcttctcactgctgatgaatgcagttttaaaaaaaaagtctcaacaatatacagccatttgaaaagcaatactgatctaggaaaatagcaaaccaaagcggagacaaaaaataattatttaagccaatattgagtctaagtccaagcaacaagacaacccaggacagtagatttaaaccagactctgacagcgagggtcaccctggcaagactgcaggcccagggttggttttcttggacttcctggctcaagtgctgatttgtcacagcacaattttcagttctcagtcctaggagactggagtagaagacctaccatgcctcttccaaaggacgtcctttctgagcgcctacagcattaacttctcagcggctacaccatccccaggtcacttcctgagccatgcttgcagtcttcactcattaaagttacagtcaaatgaagactcgaaatctcaccctaaccacagagagagaatgagagccttgaacagggggattggccttttccccacatcgtttctcaaggcaggacatctcggacaggtcatttaacatgaaagccaggagaaccgatttattaagctccatagtccctccagagggaacgacacacgaattgaatgaagatttgagagacacacactaggtttagaatacccgaaaggaatctgggctccactaaccctgctagctgatctgtaataagtgccatcaatgttctgtgagcctgactgcatcttttattactcagttaactgaaaatacggtttcctaaggatctttaacattgcatgaaatttttaccagagaaacataaacacaatctaaaagctgtgaagatggaatttttttcttattgtttgaattgtacaaggaagaaaaagtctggcaggacacaatttcaaagaatctgttttgctttatgaagcctttcttcattttgaattgatggaaaagaccaatggccttttaaacttcagctatttcaacgagattccaggtggcttttcagtggcctagactatccagaagttatcctccttgagccctgtcatgccaaaccaagacggtttctcctcatctatttctgctgtatcaagagttctccctgcatttatatgtgtgtgtgtgtgtgtgtgtgtgtgtgtgtgttttcatagaagcctggttcctctgtgctgatgaccagcttccattatcttgtgcataatactttttggaattttccttgccctgattgaacccaataatagaagtatcccccttcctggattgattaggaagactaaaacgatagcttttagcttgggtggctgaattccaaaagtcagggaaaaaattggaaccggaatgcccaatgaccacttcttgagccagggaaggtgcccaaagggttggtggggagcacacttttagaggggcacacttggctggccgggggtcccccaggaattaacttttgctggcaaacgggtttttttgcaaaaaggcagaatttcccttggtggggggctcaaaaaaacc

SEQ ID NO: 878 - DNA, 1970 bp, Homo sapiens
tggcgcggctccttgcgcggatgctgtgaatactagcatctgactgagaaaaagacagaaatccaagataatgtatttcaaaataaaaatttctctccactgtcagataacagagcagactagataagactaaactctgtatgctattatcattttccacctaaagtcgctatagtattgcctcatttacccaagattcacacaggagaagtgttccacatgtcaactttgcacacaggccgagactttatcctcttaaagtcgccttcttcacaaaggttccaaagcacctacatagaaaaacagaagtcctcccaacgattcgctgtcctgagtacagtgtcaacttagaatgactgatgggttgccatcacgaacatgctcactgcattaacaacacctcacacaaaagggtttttgaggaactcactaaaaatggaacaagtttcggctgggcgtggtggctcatgcctgtaatcccagcactttaggaggctgacgcgagcggatcacttgaggccaggagtttgagaccagcctggccatcgtggtgaaacctcgtctctactaaaaacacaaaaattagctcggcatggtggtgcatgcctgtaattccggctattcaggaggctacggcatgagaattccttgaacgcaggaggcagaggttacagcgagccgagattatgctactgcactccagcctggggaacacagtgactctgtcccaaaaaaggagccaagtttcctgactttctcacggaatcctcccgtgctactaaggccatttccctgtgcctgccggtgcccgctgtaagctccggctggcattctgcttttcttgcggtcggtgagtgcagctcggctcagaagccactttactcataagcacctctgtctcagataaaacttcttgacctttagacaactaagtgtattacaaatctaaacactttttactagaaaacaatctgtggataggttatgtacgtaaaaaatataaaagcaatctacagaagcaatgcttaatctccctatgtgtagttaataccacagaaaataatcctctttcccccaatgaaaaactgtacttggaaacctctgttcagacaccaggaaaccatgggctttattaattatgtttgaccaaattagttgaaaaaattaatgtttataaaaaatataagaacaaaagtaaaatgtattaaaattggtaaagcataggggccatgctaaagaaaccaccaccaaggagaaaacaaccttcagctcatcacatggaacttaccattctggtctggtaacctctacatcaataactgttccaggaagtggattctgaagtcttcctccagactgagcaaaaaatctggtgttcactcttttcttcaccacaattaccgttagtctagggcttaaaaatgatgatgaatgtaactgcatttagccagtcatattttcagggcactcattcattcaggtgttcacatgctccatttaaaaaggaacacatccctcctggggcgtatcatctgtccaggttgtggagaaggatcaggatcttactcttgacaggagtaaagaccacggataaacggtgagagggaaaccaaatggcacatatgtcctgtgacacacggtcatgtagatggtttatccatagaccaaacacattacataccaatcacaccaaaatgttaaatccagcatgtcttcaaaattcacaatttataacagtcttcagtgggcattttctactgtgtagaaaatataatattaactctaaaatctttgacaggtaagtggatttaagtagtgcttttcaaaattaccgtttcactatatatcggggatacacccagacacacactcatacatacatactacatattcatatacctttttcaggaggagtaacttcattttgtcttcaccacggggccggaaggaaccgcgcgtgcgaactctca

SEQ ID NO: 879 - DNA, 1668 bp, Homo sapiens
attgcgcgcccatgtagccagcgcggatccttgaggccccgtggtgaagacttctctcagtaacagagaatagttttagaggaatcatcctatggtgaagttgcagagttacacagactactgtttctaaaccaagaaataaaaaattaagcaatgagaactgtgactaacaaagtctgaactcagaaccatactgtcctggaccatcacagtttttaggaaaaagatagggcactcagtagagcatagaagtcacaacctctgttttaagaatgttaaaaaaaatgcctttttaaaactttactctgaagctattatcagccttgctattggcatcagctctttatttttttaaaaaatgaaaccctttttgcccactgagatgctactcgaggcatttgccgtgaacagcgaccctttcgtctcttgagcagcaatacaaccaagagatcaccgacttgaagcagcctgtcttggtcagccagcccaagagaaggcggggccctggggggacactgccagggcctgccatgctcattcctgagctctgctatcttacaggtactgttgcatttcatttactcggaaggaagccactggatttaccctttctttcctaggagtcctcagacattcctttacttccccttccctccccccagaaaaccttttattaaaactgctttgtctcctgggaattcccactcaccatcaccctatactccagttatttagacctgattattatttctttaaccatatgcctttaaatgtcttatttaaaggtctaactgataaaatgcgtaatgattttaacgtgatgaaagacttagccgttcatacaagactaactccagagcaaaggcagcgtgaagtgggacgactcattgattacattcataagtaagtcattgatttcactggggcagggtttcagttttgtgtttagtattttatgtggctttgaggggtatcttttgagggagtggcagaaagtaactttctcctttggtatctgtagtatttggggtgggcttgttcttcgtgtttctaagcaaggctacctatacctcacttattcctcaggaaataatgaagttaaactttgcagtgcgtagtctttctaactcttccattagcaaaaggtgacaacagaaaaaggggatgtttctggtcaaatcttttttctatctttgttatatcaaggggtttcctttgacggggagaaagtttgggcatcagaattttaagttaaagaatgtcatgaagagaagcctgaaggtgatgagagaaagatgattgtgctcctgtgccagctggcattctcaccagcgccttcaccctgacggcgacattggagtgtgttgtaggctggagtggatatctgtttgactgtgtcttcttgctgtgtctctttgttgagtcgcatgtaaatgtgttaaatttacagaaacgataatgttcaaagggagcttcgagactggggtttgagccttgattccaacttactgggccttttcaggaggatttttgcaaccagaaaagattcacccagggtggaaaaacagtaaggcagttttttccttggtggtggtggtggtttttgaaaacggagttttccctttggtccccccagcccggaataacaatggtgcaattttaacttac

SEQ ID NO: 880 - DNA, 2682 bp, Homo sapiens
  misc_feature (1)...(2682): n = A,T,C or G
atgacgcccgcgcgtatccttccagccccgtggtgaagactacaggtgtgtgccacctgtagtaatttttttgtatttcttgtagaaatacgagaaatacacccagctaatttttttgtatttcttgtagaaagagggtttcatcatgttgcccaggccggtctcaaacttctgggctcaagtgatccacccatcttggcctcccaatgtgcagggattacaggcataagccacagagcccggcctacatattgcttattattcatacttaaaagcgcatgcctgggaatcgggggctggagagggctgaaggctccccaagccaccttcccaaatcctacgtctcatctgtgccatgaaaggggcaggttagatgtcagcgtttcccacactagcctgagtgtaagcatccactgagggaacttccaaataatacagactcccagatcacgctgattccaggaggtctgggacgggtgcaaggaatttcaagaagtaacatcaagttattcttatgctcagagaaggctaataaatttggggcgaggccaaaaggcgttggaagccagtagtttgaaagaaaaatagctttccaaaggctttcgctttgtaaaaactaaatggtgccttttggaatacaatgtgaacataacttttccaaggatttaaggtgttgatgagaaagacattctgagacctgccagcagatggagccataaaacaagaaatagatgtttacagcctcaactcgggagaaaaataccgtgaatgcaccttacactatagaagtaacacttttccctctgctttattttctctatatgctaaactccttacttgcctctgctaaagaacatcgctggagtgtcttggtgtgtgaagtatgaaatagtttctaaagacataagttgtgatatagcaagacagaggcaaaacccctcattcttctgagagtgtaaacatcatgtcgcaagaagctcacctaaaatttgaaaaggaaaactcaacgaaaatttgaaaagaaattcaaggaaaaaaaaatgtgacctttaaaatttccatgttgacagcaccaccaggaccccttctgggatccgttgctaggtataacttcgtgcctgactctggaagttaaaaaatgaatagttacagattctttttccgggagccgcctctagaggggtgtacccaccagggaaggtgagcagagtgccaccaatcctgtgggtgctcagcgggaggttgctgagggatgcttcgtgactcaacgctgctgaagccctgaaggctgatttgggtttgcagggaacaggaggatcggcatggcggagcacgttggtctgagcacatgtgaggtgtttagaaaactgcaagtcatccagcacgggagcaacgccaggcacaggcaggggagtcgtaggggatgatgctgcagaagggacagaccgggttctagaagttggcgagcaaggaaatgtgagcatctggactgccgaacgcaccctgttaagtgctgtgagtaaaacacactctgtcctcccattgatgtgaataaaacacactctgccctcccgctgatggcccaacaagggaagcagggagtgtgacaattgggaacgtggatgctgacctgaagggccagtggctgcttagtcctagccagttaccaggagagaatgagggctcagatttgctgggcctcacatgatggctttggttgttgttgttgttgtttttttaattgaggtgaaattcacataacactacattaactattttacagtgaacaattccatgatatttaatgcgttcataatgttacgcaaccccccacctctagttccaaaacattttcatcatcccaaaataaaaccgtcactctccatctccctcttccccccactaccctggcaaccacgaatctgctttctgtctcctttcctgttcatttcatagaaacggggtcatacactaggtggccgtttgtgtctggcttctttcactcagcgccgtattctcaaggctcacctacgtcgtagcccgtcagagcttccgtcctccttacggctggatcttactctgctgtttggacggaccacattttgtttatccactcatccattggtggacagctcaaacgtttttaaaggggagcaggaaacttggacattttccggtgcgtttttaggaatggccaccagtgctctctagtgttgggcagaggagcatcccagggaagggaaacaatggaagatactcagagaacagaaaaatcccaagttacttcatgtaaagctgaaaatatgatctgggtagattatgctgggggtgacagggactagatggaaaagaaactcatcatgaaccctgcatgctgtgtccagagctttggactatattctgtaaccaatcagtttcccaagtttttaaagcagaaaaccacatactcagagcaagctttgacctagttcctttcattcaaggatctcaaagcccctttaaacccatgatccagattttgtttgtaaaagaaagagatggagttgaaaaacaggaatctaagcagttcctatgaaatcccttaatgtaattttttcagagcatttccccttcttcctttaagacttatggcgntcttgattgggccttggaaaaaaattttttttttggtgaaaaaaaaaa

SEQ ID NO: 881 - DNA, 4412 bp, Homo sapiens
  misc_feature (1)...(4412): n = A,T,C or G
atacgccagcgctgatccttccgccccgatataagaagacccaggaggatatgcccagggtgaggctatttcatgagggacaagttaatttgaccagggcctgcaggcagtagctggcttagaatacaaattgaggagacgtgttccctatgagaatcggaggcagctttactcctgagacaaggaatcagggtcagtgactaggagttccaacagcaaaccagagcccccacttggatttcctggggatcgaatagctgtatctttgtggtagaacttgaagtgctatgatctgcctacaggaaagccaaggtaaaatgtctctgacttccctctaatataatgatggggcttcttgcagtcagggatcttctccagatttgctagtgatagcgcggcccaaagagtatgtgagcctcagcagctccccacctcccactccagattggggcgctttttaaatgcacgtacccaagacaaaaattatagaggcatcaagtgctaaatagaccagcccctggctggttcttagaaacctatcgtgtggttttcaaattttacgtaatttttgttaaagcatttagcctgtggtgaggcatatttgctntaacatgtgcttattacagaagttatgtttcactgtagaaatttctggaaatacaaatgcaaaataaaacacaaatctctgtcattctgcagaaacagcattcttttgagccctttggtntattctatagatggtatatttttgggttacagaaacttgatcatactattttataacttgctgtttcatataaaattatcatggacatcttttgggtcatgacattttttttcttttaaggagtgcatatttttcaaaatccaattcttccatattcggttagggttcctcccctgctagaaattttggtggttccgaatttttatttcccctttaataaatgtctcttgggtgacggttataagccttccagtataatccagttgatacataagcgaatgaagacagtaaccctcaaacagatgtgtgtgtggcatgtacattaactgctatcctttcagcactttgttttgttgaaatggccatttccattatgttcaggaaaactcattttgggaagaataagcaataaatttgtaattaatgaaatctggttcagtttttcagtttgtccaggttataagagaagttaggcactggcctagctttaactgatgtctgttgccagtgagttgagatcatcaggattgctctgaatacatgccagataaggacgctgagtaccagcacataggcacgggtgaatgctgcttcaaatggtacaaaatgatgttcacccataaagcaacaagaacatgttaatgacatacgttgaatggcacctcttgaagtccaaagtcaggagctttattgattaccatatgaagtgtttcctgggatgcccagcatgtttccagaagagctgctggggtgcatcgtggttttatacaagcttggccatgaaaggacagatactcaaactattgtatgttttcatcttttaaaacaaaccttggtcatagaaaaccaacagagtcttgtccacctttgtcctctaatgcctcccaacatgttatcttcctgaggggagaccctaaatagatgacctttttaaaaaataaaaagatgacttttttaaaaaataaaaaatctaacagttgctcatcttgaagttatttactctttgttttattatcagtttcattttccagtttttgtatttgaaatattttggagaagggaaagatattttagagaaaattccccgaaacaataaacacaacatctctttttcggtaaaattgctgtgcattttctctccctcttccacgctcaccataatacactattatgatttttatactgcagggctgttagtctttgcttttgatgaactattagttttcatttccatagataatgaagtgtgtagttagttggcttggtgatgagaaagaatgttaatatatttctgcccactttaccagcctgtccacagtgctgcagatttattttcagaagctttcttaaagcttgtaattggatggaatttaaagtgttttgtgtaattcaaaattgtcttttaaagtactttcttcattgttgaaacattatcatgagctactgttgaaatcattatttcataacatccttacgtgggttttttagactttgctccagttcatttgctgtgctgctttcgttcatcaaatgcctgattttagtaactctttaacatagttacctacttaactgtgaaacaaaacacccactcaaatatatttttaacttaatgtaagtactgctttaatatatgatgcagtttaacctgttttcctgaagatgcgtctatgtgaacggcttatagatgtttcattggctgcgaagttctcatgttccacacctcagggcagttgcatgcacattcagagatgataagaacttattatttcagctttccggatcagtttgaggagtgtcttgagattttaaggcaaaacagacatgtttgttatttgacatttgcactgaaatctgtggctcggggctttctggatacagtgatgtcccaaaaattcagaaactgggtattaaagctgttgaaaaatgttacttctcctcccttccctccaattttaaatttatgcctatcaaaagtcatgctctttttaccaggtgactgaaatgatatttaagttgcaaatctggccttaaaaacatatcagtcctttacttgtctatcttaatagatgtctgtttttcaaatgaaactttctgaagctccttgctgcatgttcttctgaatctccctgtgcaggtctgtccaaagacctaacccaccgccatcagtaccacacatgctgtggtttgggaatgttgtggtttgcttcagactttgtctctgatcctcttatttggatgccatgggagaagttaagacaggaataagtagattgtttgtttcttttttcatttttacttttagaaaggctaagatgctcagaattggagctgtcataatccttgttttacaagagtttatcattgacccctgcatatcttttattttccttattaataaggaaatgataataaggaaataattatccttaataataagcccccttgagcccatctcccaatcctggaactaaaccatggcaatagccaccgttcacccatgcacaccaccccttcctgtctccattcacccatgcacactaccccttcctgtctccattcacccatgcacactaccccttcctgtctccattcacccatgcacactacccccttcctgtctgcattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccaccccttcctgtctccattcacccatgcacaccaccccttcctgtctccattcacccatgcacaccaccccttcctgtctccattcacccatgcacaccacccccttgctgtgtccattcacccatgcccaccacccccttcctgtttacattcacccatgcacaccaccccttcctgtcttcattcacccatgcacaccacccccttcctgtctccattcacccatgcacaccaccccttcctgtatgcattcacccatgcgcaccaccccttcctgtctccattcacccatgcacaccaccccttcctggttccatttacccatgcacacacccccctttctgtctccattcacccaggcacacccacccctttcctgtttccatttacccatgcccaccacccctttctggaaacaatcacccgggcacaacaacccctttcttgttttcttttacccatgcccgacacccccttgctgttttccaatcaccgaaagcacaaccaccccttttctgttttcattttaaccaagggccaccaacctctttccctggcttcaataaaacatgccaaaccaaaccttttttggccccatttaacagaggccaagccacccatttatctttttctttaccaaagacccaccaccccttatcgtggttcttttacaacatgccaaccacccccgttaatttgtttaatcaccacaggaagaccccctcttttttgtccatttaaacaagcgccccacaccctttatttgtttatc

SEQ ID NO: 882 - DNA, 3418 bp, Homo sapiens
tttctttgcaaacaaggaagcatttcctcggggtgggggctccccaaacccctgagggcccggttacatcacaggttttgccccctgccaaagaactgtgacccctaagggttcccagggagccccatgccaggaatgagggaaggtgaaccacaaagtggttcccccctttcaagggcttaccctggtaaagctctccagggaaaaaatccaacttggagaacatgggatgtagaaggccaatttgatattttcaagaatacctacaaatagcctttcatttatccttgtgctgttcccggctttcttttttgcaatgaataacagtgttttttgcttagcggaaaatgctactcctaaagttttgttcatgcttagatggagtaagcagccacatgctccgcggctgaaagacacaacagcgatgatggggccactaaccgatggatgggactgtcacgggccgggacctctgaggaccagcgctgccacggggaaacctccggcccatgtgatccacccgtcctgcagaggctgggttccctaaaatctaaagacaaaacaacaacaaagtcgtaagtctcgccagcattgggaactgaagaattcagttagccaaatcaagcgggttgaaaagcagaatctgtaaaggcaactaaacttagcttttaactgaaaggttagctgaatggcctgggagagaacaaagccgggcaccagcaccccactgtctactcggagccgctgctgggcgcatggtggggtgagggcaaaaataattccttgtgggggggtctcttttggttgctgctgctggtgctgaagacaaatgttttgggaccaaagagacaatggcttgaatacatcccaccccgccttggctccttggagcacctgagtccctcttagtctccacatgcccccctcccagctgtcacgaaagtggggaagatgttgcagttcctcctgtcctgcttggataaaagtcgtatgtgaggtttcaaaaaactgaaagacggaagtttctacattttatcagcttcaaaactcaacattctacttctaatctgaaaatgctggtaacattctatgactcagaccggtctctctttctggctataattcacctctaaattcacctttagatcagggttaggattgactaaagacaatcacagcaaaaccttcttcttgctagtaagtaaatggagtgaggaagttctcaggaacacaggcatgaatggtgggaagggagtccggggatgaggcgtgtctgctgcagaacctgtggcagggcaggggaggctgcgggctgccgtgggcggctgagtcactgaggcacggatctcgcacctctcctgggtgggcccatcgcaagcacacggcctcagacccaaggcctggcgccatgtggatggctcacctgtgttttcaatgaaaaggtcagcatgacaggagcaaatgttccgaaaagaggacacaatatagagatgaatgaagccttcaatgaatccctatgctcaaaaccaacaacaagcccagacggcagggccggcggggagaaggctgatcatggaaaatttgttctggaaactgtgggcacagaaaagaaatgggaaaaaaacaagaactttggaaacaatatgcaaaaaaaaaaaaaaaaaaaatagatttcttcaatctttttttttttttttggttataaatgtcagaaagcaatgaaaaaaactccaaaataacaaggaaaaaaaaccctcgacaatactagtagtcataaataaatccctaaggatccctgtgaacacaaacatgttgccaaactttcagataatcacacttcagctaacccttaattaaaatttagattcagttgtcctttaattcaagcagccatactcattactgattctggggggtggaaatcattactctaagcacagtaaagaaatcttcagcatggtcaaaaggttgggaagcaaatcggacttgagaaatcaaaaatgcagggaaaacgaaagacagccagcaagagagtccccagggatggacaccagaacaaacagaaaaccagtgaaaggatgggacagattggtttggcaagcggctgtgaaaaggaagtttaggtcacacaccagggggccttgtgcgactctgggaggtggctttgcgtggggggcagctgccctactgtcgggcatggttatgcttttcttccagacaccccgaaaatcttggtgctcggtgggctcgccccagccgtgcttcctggggggcggcctctccgggccgggctgggggtcgtcgttcctgaggaggccaccagggcccacctgctccccaaagtcctcctccacgctgctctgccgggtcagcgtccgccgccgggccagcagcggcctcgggcccctcctgcagggacagtgaccagggcctgggctgcacgcggccacggtgtttccgaagccaaaccgcgactcgtcctcttcactcccacagtccaggccgctgtccgggctccgggtggccgagcggctgaaccgacagcccctgtcttccaaaaggaagtcctccacgtgggggacggcccccgagcccctgtgcttcaccgggaaccaggagccccgaggggcctcgtcgcccctgtagggcctgccgggcctgggctctctggccagccccgtcctggccctgggggacggccctgcaccctgcttgtgtagcagcccacagcactctccgtcctcttccgctacttcggggatactgaaaagtctcttcctgtggggctggtggggaaactcgggctgctcccagaaagtgccttccgaggtcctatggtcagtgcagtccttacggggtggtgtgtcaagaacaggcgcgggaaagagtgtgtggtcagcatgaagtgggggccaggggaggaaagaaaatacagacagaattagtcctggaggcaccgaggggggggaagcatgcgtctactcaggccgggggcatgccgtggagggctctgcaatgaaaacagaatgggttacggggctggggcggggtggaggctgaggcagagcacacgcagagccagcgggccgggcaggagccagcgccatgcatccagccaaggagagggcaggtgagatcccggcggcacatcaggccccacagtgcccacggtaccgttgctgtaaatggtgggtgtgcccacggtgccaggggagactgcccgggggctacatcttcagaaaccttaaggccagctgccattgaagccggtgtgtgattgaagccagttcaccagacacgaagcttgaccggtccctgtccatccagtgggccaacttcccttccagcgctcggcaccctctgcaggactttcgtcttcaccacgggcccgcaaggaaagcgctggttgaattcacac

SEQ ID NO: 883 - DNA, 3582 bp, Homo sapiens
  misc_feature (1)...(3582): n = A,T,C or G
cgagagcaggtacgcggtccctttcagccccgtggtgaattacgccgttactgggcgtatggcgtacagacacgaggccggcgcccgggaggcggtgttcatccgcccgggaaaagagcgcctgttgctcgctgcccgcgtgtccctggctctctcgggaacccagcgccgaaggcgaggtgggcgcgggccgaaggaggtcctgggaggtcggcggcgcggagggatctccgcgggagccgttggggctgttggcctcgggctgaggtgcaaggaccaggactagggcgagggcagcggtccaaggtgcggggccaggctgaggtgctaggtgtgcgggggccgggatgcgggggcggcggctgggggtccgggatgtggaggtgaggctcgaggtgcggggaccgggttgcgggggcgaggtcccaggtgcgggggatgcaggagccgggtgcggggtcgaggtcccaggtgcgggagatgcaggagccgggtgcgggggcgaggtcccaggtgtgggagatgcaggagccgggtgcgggggcgaggtcccaggtgcaagggatgcaggagccgggtgcgggggcgaggtcccaggtgcgggagatgcaggagccgggtgcgggggcgaggtcccaggtgtgggagatgcaggagccgggtgcgggggcgaggtcccaggtgcgggagatgcagaagccgggtgcgggggcgaggtcccaggtgtgggagatgcaggagccgggtgcgggggcgaggtcccaggtgcgggggatgcaggagccgggtgcgggggcgaggtcccaggtgtgggagatgcaggagccgggtgcgggggcgaggtcccaggtgcgggggatgcaggagccgggtgcgggggcgaggtcccaggtttgggagatgcaggagcctggggtgcaggggccggggtgcgggggcgatgtatcaggtgtggggggtgcggggccggggggaagcgctgaggcccgacttgccggggctgtagggccggggtgcgggggtgcaggggccggggtgcgggggcgaggtcccaggtgcaggggccggggtgagaggctgangcctgagttgccgggggtgcgggggcggaggtctccgcattggcggccgtgcgtgagactgcggggacctgagagctctgcaggagggccttcgggacctcccgcactacccacgcggccgcggggcgcgatctctgcggagggcgagggccccttcccgcgtccgccgccgctgcgctgcgcccccgggagccttgggagccggacgttgggaagaggacggaactccggaggaccccaagtgaggcggcgaccgcgacggccgggctctgcgaggcccgggggtcctcgcgggtgctggcggcccggcccttggcacctgtggagggaaaggggcggcggggcggtggcgtcctgggatggatgctctcgccgtcttcagccccggcggcctccagggcaaagccggctgcacccctgcgcagcctgttctctgagcgcttttcttttcgtttttaagttgtggccagagagaccccgctcgcatagaatgtaccgctcaacggtttttaggcgtgtggcgcggtggtggttcccacgtgcacggcgtggtcctgagctcagcgccggagggacgttaggtggaagcgtctttggcagagctggtagcgaatcggagaggtgatttccagcgagtgtggttattggaagcacacacttgctttctgactttaagaattcaatatccagactgaggtggttttgaaactggaaggagataaagctgaaaaccagagttgtgctgggaaacctggacgtagagcgctgagccccccaggtatttagtgaccagcacagcgcgccgccgtgggtttcaggccctggagatgatgagaatcagctggagggctgcttccagtcggcttctaactcgggagggctgagagccgctccccaccccgtaatttctgttcccagccagtccagatgctgcccgtcagggaccaggctttgagaactgacgtgctgctttaggaatatttcctgctggagatgagagttcagcttgtcactgttttttaatcactgtttcacaccgttgtttgtaaggtgtcaagcgacggactgggtgcaaaggcatcaattgtgattcgcagcctagttggagaagctatggagtgcagagatgtggggagggagaaaacaggttaccatgtagtagggtgaccgtggtcacgccggggaaacggctttcggagaagggagcaagggatggcctgcgagctggtccttaagcggttcactggattcttgtggtttcagaggagggtgaggctttgttagcagagggtgtgccacggtgtagggtgagtcacggaattgatagtgataggaagcaagttgtgtttgctggagtctcaagcggatgctttcagattgatttgtagatcagcagtccccagtctttttggcaccagggaccgatttcctggaagacaatttttccacggaccggtgagggatggtttcgggatgaaacggttccacctcggattatcaggcattagattctcataaggagcaggcagcccagacccttggcacgccgacttcacagtagggttctcactcctaggagaatctaatgcctccactgatctaacaggaggtgagctcaggctgtcctgctcactcactgcggctcacttcctgctgtgtggcctggttccggtacaggtccatggggcgtgggggttggtggtggtggttgcccaancttnaatacngcaacgcacttttctaattccgctggccaaagcaaggctcatagtctgcctggtttgaggggatggggaagctgactctgtctccagctatgaggagccaagacattacgtcaccaagactgttgatccggtgcggggcaaggagcccccaaatcagggcttaagatgggagggttcttggctttgcccaccgaagaattcaatggcaagctggaggggttagctgcttttactgaagtgtctgtgcataacagcctcagaagtcctgctccttgcataacaaggctacctcacaggctgttcgcctaaaatttggggctcaaaggcagcttccaagtcgtattttaaaccaggtcttaattacatgcaaattaaagggcgggctattcagaaaattcttggaaaatggtgggtaccttctggatggttgggtcactgccatggaaaagggccataacttcctgacgttgccccttggcaggggaaaccgacatggcccttgcggtgcgtttcatgggaaggggcctttccctggggcctaatttagccttgtgcagggcgcgtcaagaatcaaccccccagttttttaccccttctaccttaaaattccggttgtgaaccggtgccatagtcttccattagaattttttgcacaagccgacaggaaatttaaaaaggaggtggcagattggcttttgtttctataaagggaaattccgcatgcccccccaaataaaataaactggtttgcaagccggggcccacctgtggct

SEQ ID NO: 884 - DNA, 4255 bp, Homo sapiens
  misc_feature (1)...(4255): n = A,T,C or G
atatttgcccccccattgtcaaaattttttggcccgggggtgcccgttagccaggaacacaggcctgtgatcctgtgtttctcatggccaagggtagggagtggaatggaaaggattacttagatttaccacgtaaataaaataacctgtgtcccttggtcaggacacctgccaaggtctttgtccgtttgtgtgtgtataaagaaaatacttaagactgggtaattttgtaaagaaaagaagcgaatttttttcccagttttgcaggttgtccaagcatggccccagcatctgctcagcttctggtgaggcctcaggaagcttccaacatggccagaaggcaaagtgggagcaggtgcatcacatggtgagaaaggtagcaagagacagggaggaggagccaggctcccttaaacaaccagctctcgagtgaactcagagcaagaactcacttatcgctatggggagggcaccaagctattcatgagggctatgcccccgtgacccagacacctcccaccaggccccacctccaacacaggggtcacatttcaacctgaggtttggagggaacacatcctaaaccccatcacgccgtgaagggctggccacgtggtgatgcagggacaagcatgtcggacagcaggaatggcactcgctaagacctggagttggggatgaccttgacgtgatcatggaactgagcgaagccagtgtggcaaaagcacagtgaggaaggggcagaggtgagaggtgagggcagagaagaggctggatcacagaggagcctgttggctgcagccaggagtctggattttgttcccggtgcagttggcagcctttgtgctcttgaaggagaatggctgtggggcaatctctggtgcagccagtggctctggaggagctgtctcggggcagaaagggctctgaggagctggttatggtccaggggagaggaggagctgtctcggggcagaaagggctcttctgccgtagtctaccatagtctaggggagagatgaggtggcagcgttggacacaggagagaacggcagacatgggtggggggagtttgggtgcacatttttttaaattgggaggtttttttttttctcaaagatctggatgttgaacaaggcgggaaagggggcaggaagtcaagaatgactgtcagctttgcatctggaggagctgaggggatgatggtgtccttggccgagatggcacagcttggggagggaacttgtttgaggaagaaaatcaagaattctatttcggacaggctaaatttgagcttcctcctgtacatccatgtggggataatgagtaggcagttgggtatgagtggcgggggggcgggggacggggatgaagggttcatttggaattatgtggcaattaaaacctcaaagctggctaagatcacctaaggaatggtataaatagagccgtggcccctccaggatttagagatcagcgggaggtcattgcagaggtcagggggagagaccaggtcagcgcgccccacgggggccagagtccagggcatgtccaggaggagcagccctggtgtcgggtgctgctgagggatttggtccagtcagggcacgaaagtggccatgggttcgggctgcagggactcctcggctgccttagtgggagaatctcagccgagtgacaggagggaggctgactggaagggctggaagagcgtgtgagatgggaggcagatacatgggcagtggctggagggggatgagggctttgcagaaacaggtaagatttggagagatagatgctgaagccaaaacaagccccagcaaaccttgtcctcccagccatggcatctgtgatgaaactgaggctgtcttcgagggccgagtgcttctcccgctcacgcctttctgacagctgctttgtacggacttggttcattaaccgtagaaatgcaaagacttcttccctgtacttgtttccatccatctgatctataaaccctcatctcactggcaccccgaagcaagagcccagcatagcatccgccacccctttatcctcagtgactctgaggccgcaggaccacgcccggagctgtttcggtgcctggtgaatctacctagcgagtcctggtagggaaggtggcaccctcctctcgctaacaacttccttcccagaactaaataaagatgatacagtctgcctttggcagtgcccccttccaaaataaagagaagcacaaaattagccagaattaagccaaaatggcagaattaagcagctgcacaatcggccacccaggccaggtgggccgcgaggaagtcgaaagctgcttctctgccctggcccccgtagtgctccaagatggcagtggctggtgtaagtcatctcaacccagaagtggggcagtggccgggagcagactggctgtgagttctgacattctcatcggccatgttccagctgtggcttttagcccttgctcagcttccctgagtctgttgctctgctgggatgcagtgaccacagcacccaaccctcagcctcaaatgacacagtgcctgggcaagcatagtgccctgcatatagtaggtgcttaataaatgacagcagccacattccgatttctcaccgtcattttaccaatgcggcggtagctgtccatcatcctgttggtgcagccctggttgcctcatgagtccctccctcccaccctgtacctggtgtttaagtgacatcacacagggctacacacgtccagtgggaaagggttttctcctcttgggactaaaacataacacagagaacttaatagatgccaaggaaaattcaaaacacctctatgaagtgggtgttaattaataatcaacattagttatttcactaatcactaaccaattgaaaaagaatagtgttgaaaaattaatccaaaagaagaacatggagaacagagaggttaagtaactactctaagaccacacagcgggccagtatcagagctgggatttgagcccaggtgttcaggctctttaatggcttttgctggcctgaaatgctggaagcacttttcccccaaccttccctgccagcccctgatgtgggcagcgtggagagctccaggggctgggaggaggcccatgtggctggagaagggggtggtggggacagcagtgggactgagctccaagaggccatgaaggcggcagtttgattatttggcatctgtgccgagtgacccattgtggggacagggacacagtggggcaaggtgcctgctcatgttccaggggaaggagcagatagcaggcaagggagccggccagtgcactggggatgaggatgctcaggaggaaaataaggcaggtggagaacatggtgtatccaggaggggccgggcggccaccaggcttcagtgcgaagtggcatctgggcaaaggctggaacgtgagagtcaggctagcagggagagcaacacgtgtgaaggtccagaggcgggcactggtctgctctttagaaacagcgcgaaagccagggtgttacagcagggcatgagaggcaggcagatggtggtggcagcggcatcaggaggcaagaggcagtcaggtggccctgtgacagcatgccgctttactccccaccgaggggctttcagctgggatgcgacatggggccaggggtccacttcggggggcatcgggctccttccggccaaggacacctaagtgacagtcgccggcagactctggagagatgtttcgcctccagtctatccttcccatgggacattgtccatgccagcaagccagtgcctgggggaacttctggggcctttccaggagccgcggaagccctcgcagcccctgttagtggcatggctcagggacacatctaggcggggacaggggctccgggcaccgtgtctaggtggggacgggggctccgggcactgtgtgtaggtgagggtgggggctccgggcaccgtgtgtaggtaagggtcggggctccgggcaccgtatctaggtggggacgggggctccgggcactgtgtgtaggtgagggatgggggctccgggcactgtgtctaggtggggacgggggctctgggcactgtgtgtaggtgagggatgggggctccgggcactgtgtctaggtggggacgggggctctgggcactgtgtgtaggtgagggtgggggctctgggcactgtgtatccgtcttcaccatgggcccgcaaggaaagncgcgatcaaaacacgc

SEQ ID NO: 885 - DNA, 7454 bp, Homo sapiens
gttgaggacccacggaaggacacagggctcacctgcaggcaacgtggagaactccacaaaggcctccttcttctccctttgctccagcgggagctgccacggcatctggtggggtttggccagaaccttcaccttataggccatgttgggcctgagattgaagaactggtacttgtacctggcggccttgacgatgtcgaactcctcctcgttgaggaagatgacgtggctgtagttgctgttggtgggtagccaggagagctgggcggagatctgcgtgatgttgtccacccgcaggtgggagggggccaccaccacgtccttgcccaccagcagcgtgcactgcagctcatccgagctgcccctgctggtgacgcactgcacggagatgcggtaggtgcaggctgccatgttgagcttctcgatgagggctttagttctgctccccagcgtgaggttcatgcgtgtctccttgtccaccaggacgttgtagctgctcaccgttccccatcctggtggcaccgccgggggctcccagcccacaataacacttttggcgagttgtttgatgagggtgatttttctagggtaaggcacgatgtcttctccgatgtcgtcgatgttcacgtccagggtcccggcactgttgtcggtgatgcccgcatctatgtgggttggggagtggaggtccaggatgtgctctccctccaggccgatgccggaatggttgatgaagttctgatcctgctcgttccccagcgtgcttgccaaccgcgactcgttgtcctgcacaaagtccacgaagttggagggcaccagacccctctggccatcgaggagctctcctgttgggtacaaggacagagttatcacccagccaacacagcaggggcctcgaggcccccagtgtactcccacctcccccaccaggaccataaggcagagcaacagggttgccctggggctcctccgctgttcccaggagtccatgctggggccagctccacacccaccatctaaagagccagctcctccatccccgtggcccagtcttcttttctccatgatacttatcgcaacctgaaaccatcatgtttgtgtatccgtgtacgtacactgactaccccctcccaacacgaacaacactcagggacagcagggaccacacgactattgaatgcccagccctagagtgacagctggcccacaacagtgcacaggaaagatttgttagaaggacgagtcagtcaaatcagtggcttttggagattaagaaaataaacatcttactatgatttttgattaagaattaaaaggtgatttcctggcccccttgaaaagcactgggcacatcttaatgaatgcacaatgtgtccaatttgatgtgaaacaaaactatcaatttggtgtcagaaccacaagttgtgtggcaaaaaaaaaaaaaaaagtcaaagtagctcttgtggttaagagtggacatagtggggaccgctgtattttgtgaaagtctaacttctacgtgctttcttcattagtagggctcacaaggctgctaacagcagacggccagaaaacggagaagtgttcagagcttcaaagatgaggcagtttgggtaatcttccagcacagacccagaatggaccgtttccaccaattcatcacaaggtacccacagacccacagagaggggctgggaaatgctgagcattggattctgcgcccagaagaccccctgcctcaggggagcatgtgatgtgttgtggcccaggggaagacatgtcaaccatttagttagtcctggatgctaataaaataaataagaaggacttggattccgttccaaacctccacctagggtgtgggtctgcaggagccaatcctttgcactgaggatatgctatttaaaaatccttagtttggcataggaggagatggaggtgatggtgatgatggtgacggtgatgatgatgatggtggtgatggttatgaagatgattataatgctggtggtgatggtgatagctactatttattgaacaattactatgtgctaagctctatccgaagaccgtcgtatctattatctcatttctcctcagaccctctatgaggtgggtactattactatctccattctatagcagaggaagctgaggcacagcgaggtgaaggaagtttcctgctgtcacacagacaatggagccctgagttttgatccctgcctgcaaagaggctcctggaatgcttctgtgggctccatgtgtggtgagaaagttccagagatttcaacacaggttttctggcagctgccttgggcacatatttttgtgcttatgtgaaatcaagtggttataatgtggactatgggaagaattcaaactgccttggctaccacttgtggtgagagttcttggctggaccatccagagccaagaacagctggtgagagagtggtgagcgagtggtgagtgaggcagctcgactgctgggctcctgctcatggacacctctagaagtgacccgacctcaccccaagtaaacacccaggaaaagcacctggggcttccatcagctccgagaaaacagcatgaggtcacgaaagagaaacctgctagcttagcaagcaagattccttctgctcagggggaagaggaagaaaccaagaccacgctatttgtccagggcagttgaaacatgtagggaattagggaatcaaatcctttagaacgttgatttatgggctgctggtgctgttacatgtttattctcaagctaaaaaggcaacaaaaggtggggcctttcagatgatttcaaatttggagaggagacctcgagggaatgagcaggggcaacctggggccaccccctaagttgacaacagtgccttgaagtcaaggagatggatggccttccacaggtgccaagagccaccttcccgtgaggtcacctggagcagaacaaggctctgccagagagggtgcctctgggagaccctgagggtgctgaaagacaagagcaggagagacacttttggaagcagagggtctgtcagtcccatgtgtctgcaaatagctgccaaaagctctgcagaggttagcggaaaacatctaccatgtgtcagaggtcagcttagagctgaatactggaaaccccactcaggtttctttccagtcgtcaaagagggcaaacctggtaactacggagtggggaagggtcagagaggagggctgggtggccaggagtatgttgggagccctgcctatctatcaggcccctggaagaggtggtctgcggggtggactggcccagcctacgtccgccacagccatgttccaacagagaccttcatagaacccatcctcatccatgtctccatagacgtagaggtattttcccgccgtgaggggcagctcagcttcggggttctcgttcggtccatcgaaggggttgtaactgcagagaaaacacagttccttcattagaggctctggaggacacagcccgcacccctgtccgtgcagaacgccagacgggcacatggcttctctcccactcctagggaattacaaacccacataatcgttcggggctgatgagttctctgtacactggaaattcaagccactgccagctcacacacacagatttaaagtaaaaatgcaattcggaaatgaagttatatgctcagaactatttgcatcagataacaggtttatgattctgacattctattcacacttatctcttctgctgtaactatacatctccaaattagcaagcagatgtgaagaaaattaaccctataatctttcaataatacaatttagtgaaaacagaatcatatatactatttagcaacctgcttattcttccaccttgcaagatagcatcctatacttctacctcttgaaatattatcatcatagtctttttaatgggtgtagagtattccactgaacatattaacatactttatttaaccagtttcctaatgttgggcagtgaggtttcttctaacttttggctaatataattagtattgcattatatattcttataaacatatttttgcacacttccacaatttcttcctaatgataaatcctaggaaatatacttatttggtcaaaggcacctacatttttaaggtcttgggtgtggacagtcaaaatgctcagaaaaacagacgcatgattttatgctccccccccccacacccccaggaatataagagtatccatattctccagtcctcaacatattgggattaataattttcaaagccgtgtccaacttggaaaatcaaacacatgaaacaaacccagatgaattggggattctctaaataaaaggcaaattaacttaaaataacagcgaagaactcattaaaaaatgaaaataacattagagttggagaagatagccagacactgtaatattataattatgatatgaaaatgattcatgcatcagtggcactgtgcagtttaccaacactttcatacacgttttattcgatggccattaaatgttaggaaaacagagaagataaggtccccagtctcaatggctgagtgaggtcaggcaacatgcccaaagtcacaagcttatgaatcggtggaaggggaaccagagctgagacctcctgacccgtcctgcgcagttttaaccacaccaggtcacgtggcccctcatggtcagggtgcagaggtccaggaacccaatccaagaccctgacagcacccagcaggtcagcctagagggctgtgcaccaggaactgacatgggccaccctctaacacaaagctcggcagtggaacgggacaagagctctggaagaaggaatagcatgcgccaaggcccagaggcagggaggagagagatgaggttggcagggaccagactggttttaacctgatctcacaagctgtgggatgtcatgaaagagttttaagccagggagcgacaggatcatgtttgcgttttacaaagagacctcgtgggtgctgtgtggatggagcttggtggaggagttccagcaaaggagtttggtcggggagtgacttaggaggctgtggaaatgcgggttgcctggctgcagggatgagggactgaggtgcaggaggaccctcggctttctggcctcagggtgagcaggcggggacacaagtcactgagtgggggttttcagggggatctgcaggggggtctggatgggtagatggccgagacacagaagctggcagagtgttctcggaggaggaggaggaggaggagggagcgagaggaacaggagcccccaggccacgccttcaggagtgcccacacctgacgctcaggaagagaagcttccccagggagcaggtagggaagacacaccctgagagcttgagagggaagccgcggaggccaagagggaaggtgaacaccgagaagggtggaagaaggtccctggctggtaagggcacggagaagaagtgggagatcctacggctgtcgtgacaacctcgtcggtgctcctgcgtgtgggccctggaggccacccgacctcgtgggtgttcagggcagacgctgccacgtactgtgtggatgagaccaggggacacgtcgggaatggggactcaacagagacagaagtaggtcaggggtcacgcagcgctggaggcgggggaggagggacaggtgatcactgatgggaatgggttcttgaggggcgatgggagacgagggacaggtgatcactgatgggaatgggttcttgaggggcgatgggagacccccacatgtggccgtggcatctgtgagcacagcagtggccctgggcggcacactgcaagtgggtgaactgtgcagtgaggaccatctctccgtacagctggcgaaaggaaggatggtgatgaatgtgtcagcctcaccctggacctcgggtgggaaggacccaggagccctcagcaaggcgttccccacggcggaggctgcaccagatggaagggaggagacatggacacagaggcagcccctgcatggagggcggggagaggccgctcggcacccagagtgagcgcccaggtgagcaagaggctttcggtttgcagaaatgtctaagcaggttgctgaataatgacagcaagaggagacactgattagacccggggcagaaaacataaccccctccctacatctacctgcaaagccacctcttaggggctctgagggctttcagaaaactcagaaacagctctctcggggaccagcactatatgcccctcacaatttgacttggtttgagagagggtgggtggttaaaaaaaaaaaaaaggcataaatccatcaccagtaaaataggaataccactgaaagagtgagataaggagaatgtgcgtgggctgtgactggtgatggccacgggagaggcagatgtgctggctcgtcacgcccccgcttctggagccacaccagccgtgggtcagtcctcgggggacattagctctagggcagctccccccagaaaagccatgccctctccatagaagtggcaggaacgcaaacccagtggccctctgaggttggccatcgtaggtcgcatgtggcagcctcgctggaccaggctcatgattgggaaggaaggcgtctgtggcacaccaggcccctgcttggctgggaagccacctcagcatgtgccaggctcagaggacaccagcccagcgctgcccctgtgctggcattgagggttctgtgaatggctgcgcctgggcctgctccacacacagcaagaaccggactgaaggagccaggggtaggactgggtcttcatcctggccccgccaactgtggccctgtgcgtctgcatgcaatagcctctcagcgctgtgatgctgtcctccagcatggtgacagatgagcggatggtgggcctgcccccacctgggtgcagccagcattcacatctgcctgggctggattctaatgggagcccacagcccaggggcatctaccccagtgcttctgctacctgaacctcagaaatgggtttgctttggtggaactggtgtattaccaacgagcggaatgtgatccgctgatcctcttaatggtgttagaaacagctcttgctggaaaaaggcaaagggttttcaggtgtatgggactggcttaaataaagaagcaacttcctttgcctgaaccgaatttaaggacttagtgagggtggcaacggcctttaaattgggtccccaaacaaaaccagggacttttggttgccccatgccccttgaagggccggggatttctgcctttgaaatattggaagggaagcctaagggcaaacccccccttaaggctgtggaaacttttgggaaaaaaaaggttgggtttcccaaagccttaaaaaagggggggaaagttttttttttggccttcttccccgggttataaataaaccaagtcccccgcg

SEQ ID NO: 886 - DNA, 7331 bp, Homo sapiens
  misc_feature (1)...(7331): n = A,T,C or G
aatgcgcggaccctgtacgcggatccttccaacccgagggtgaagacaatttaccagttacattaactcaaaacaagtatttatcacaatgaattgtcctatcatcagtgacagttatcttatgactaacttaaagagggaaattacagatacaagtattatgccctactattctcacgaaaatttcagccttatccagattgtttctcatccccctcaaaaaacaaaaatttttgcagaacacgtgtcttgcttttggataggaaatatgtgatatgtacactgaaagcaaattatcaagcatgcagtatatctcctgtggtggaacaaacgacctgaactctgcacctcctcctgatcaaggacccaccgtggggagaaggaataccaagttcgcaatagctctcgaggatatgagtgttctgaacacaagctcagacagtatttgaagtcaacagaattagggaagtaaaggcaggatacttgcttaaagcaaatagatgaattttctatcagtaaaccacaccttaagttactgcaatacagagaaactcaataatcccaaccaatgctgaaaatctaggagaactgaatgcagatgttcaatgtacaattatttcaactttgctgttttcttaataaaatgttgaaataaaacacatacctcctgaaaataatattatagaactgcaaacaagttggtgatgtaggtggaagttcatttgttaaagtgatcgttatcctcacatcctctccattccgggtcttactaaaaacttcagtaacctgaagccagagaggtggaaaacccaaactttaaatccttaaaggacaattatgcccaatcacatactgcttgcttaataaggcaacattgaaaaccataaaatgttttaactggattttttttaaatggctctgagaaaaagagtggctaagtgtattataactcaattgtaatcatcaagttacccagacaaatctgacaatgctacaataatgccaaagtaccctatgtgtttattccaagtcatatcagacaggagactcctggggcctctctaaaagccatgtgagctatcttacattgtggtagttctgctttgaagtggaaatcccccatctcccttttcccaaataaccttttgctgtagtcttttaggtaaaaaataatatcgttccatcaaaagcatgacactttccaattagatcttcgtgttgaaaaagaagagctgaacggagtcttctggcttccatcagtgggttatagtcaatgtgatactgatataaggcccactggggacgggatgtcagccggaaatggttagtgcttaaccttactataatgcctgaagaacctggaaaaggaagttatagtcaattaacaaaatatcaagtttatttttccttgaaatctttcctaccatgacaaggcaggcacagttccgtaaacacaaggctaagagcagcagacaacatgaaagtcctcagacatctgactttggagaccactagtctctctctttaggtgaatttctaaagaagcatacatttagaaacaaatcttccttagactaagtaatttacaaataatttgcaacaaaaccaagtaaatctcttcatggcaaagagttttaaaaatgatctattaatatttaatgagatgacgtttcaaaatgtgcagttaaagatatctataacctacttcatcaacgccaaaagaaagtgaggaaaatcgaaaagccatgcaggatccttggccaaataaacacctaaactaaagtgcctcaattcactgtcctgtgttcctgagatgtaatctcacaaaacttattcttaattaacctacctgtttttgattctttaacatggtctaggttctgccttgtattcacaccaagatcatgaaaatctctacgacgacctcctctctctgctaacgataactcctgaaatccagcagatatctggagtccttaaaaaaaaattgtgtacttgagcaacataaagcacgaaataaaggatgacaatattaactcccatagtgctattatgtgtaatccaaaggatactgaggtgtagaagacaaggcataaaacaatcctatcaacatgttttaggtatctgccagcctaacgagagaatggtttcctagttataacttcattcataaaggccttgtcactgtcctgggcaattgcagatgcaccctttcaagagatgtgcaccttgaatcaagagatcaagccaactggactgtggtgcaagagtgcaggagcatatgtttgctgactgggaaattatttttctgtattgtaagtctgataactacctaaaggtcttcatgtattttccacagtctgtcatgatgcaattacaactacagaagttgctggtttagagggtttaaatctgtaacctggattagaaaacttacatctaaaatgcaacttcctcactacctgactctcttcagaatcagaagaatggatttctgcacctgcacatattctatgaccatgacacgcatctcatactggtataggtaataaggtcgtgattaatcagttcatgcttagtgctacaagctgtggttataagaacctaaattattcaagtcatttgatttgctgaaattatacaattatctcagatcaacaatctgatgtgagccaaaaaacaaatatgaactttgtagtcaagcattaaaattccagctgtcaattaataggcatgttatcttgtgtaaaagagattaccagttgactatccaataactaacccctcattctttaaataaattctatttttggagtaatatacttaatagactaaaatttccaccctccccatggttagggatggcctaagatacttaagcagaaattgcaggatgacacttttggaaaaattccataagagagccaatagctgacatgtgacttttgtacttcctgaccctttgccctgcccatggagcctggaatctggatctggcagggagggctcaaatacagaagttctgaaccaaacagaggtcttaatgatggcagtcatgagcccaggacaaaagaacaaaaagatcagagtccagttctcttctgaccacaaacaccagaactgcctactctctagacttccttagagaaataacagtggcttaaaatatttcagtccttgctatactttggaaaccagttatttaatatgagtgtcaattccttcacctgaaaaattgagaataagcatcacaggcatgtcagaagttttaaatatcacgtctaaagcactttacaaggcacttccatgtttgtttctgtacctcatgatttggagggggctctacctaaaaatcctttaaacatgtaactgttcatacttgtctctctcagtgagctttttatcccagaggcttggtttgaagtattgatggcactgggtgagtaactacactaaatcacgcatactgaatccaacctgatgacactgaagggtcataaaggctgatatttttccttaaaaatttttaatttgtcttaaaaaaattcagttctggacgcaaaaatccaattgccagtttctgaatataaacaatgatgaaatcagttctgcttgagatatacagtactgctatgacacttagccaaagcttgattttgtcacttgatgaagaggacagatttcagaatggacaagactgggaaccttgctaattcccccttccatgcagctcctagagtgattttatttcaaacacacatcagacctcacaccactgtgctatttaagaatccttcaatgggccgggtgcggtggctcacgcctgtaatcccagcactttgggaggctaagccgggaggatcacgaggtcaggagatcgagaccgtcctggctaacacggtgaaaccccatctctactaaaaaatacaaaaaaattagctgggcgcagtggtgggcgcctgtagtcccagctactcgggaggctgaggcaggagaatggcaggaacccaggaggtggagtctgcagtgagcagagatcgcgccactgcactccagcctgggagacagagtgagactccgtctcaaaaaaaaaaaaaaaaaaaaaagaatccttcaatgcatccacatccctttacagaatgaaaatcaaggtccaaacaatgtctaattaacaataatctgttaaacttatattaatttctacaatacattaggtatttgagcatttaccgtgacaagcaattctcaggtataatccctaaagagcagtgagagatgacaaaacagggccttcatttgttatcccatgtattaatggtcacaatgatctttacctctacaggtagacactaccttgttacagatagggaactgttccatagagttaaatttgcaatcctgagtaaccatttttttaagtcatttattaatgaagactgatacatagaatgtttaagaaattatatttaagtattttccacaattgatttgtgtgttgtggcaacattataaggaaatgtttcttaaacagtttcagcacaaatttttgtaccaagttttaattcaataaaatttgctgtatatgttgaacagagttgttaagacttccttttactttctcttcaccttgtgacttggctgttcctcctgctgttcctctctgccgtccacggccaaataattccccctctgctggtggcggctgaggcctaggctgaatataaccaggttgctgactctgtagttacatgcaaataaagaacattcttttcgtcaagcggtcagacaccagagaaaatttctagtcttaagtctcaggaattcaaccaacacctatctaaattaataatcaaatattttattcttaaaaataaatttgagagaagagtcaccaaataaagtcacgaatcagcttctaatatcctgaggaaacagggcatgatctcccttgctcacttcctatatccttcccagcacagtttttagtttattttcaacagcctaggctgatcaagagtcaaagacattttctgtagtcagaaacggtgaagcactcacggcagtggagcccaccagctgcgctgtctcctgaccgcgggcccttcctctggctctggctcgggctctcccagtcattgttttctatttctggagaggaaacaatcttgaagacaatactcaatggaggcaatcgcatttgataatttctacaatgttactttaaacttctttgagtttcaaaagtaagctccccaggcaattattatgtatccttctaatctttaatgacagttttttttaatgtaacattcctacattcaacaaactcagttgcttaccttgcactgggcactgcagtagggccaaaggggaaaacctattttaatataagacttagtttttcatttggattatttattataaacagacttaggaggagaaagtgctgaaagaattaggatgctggtggctggttctttctttcccatttggagatacacatgtacacacacttaacacatactcccatacacagacacacacacacacacacacacacacacacacacacggaaacaggcacttgtggcaagtgtcccgccaggccccttagaaaatccttctgcatacataatgagtcatcctggatcttcccagagttccatgtgtggcttacactgaacatacccaaactagtatctcttctacctcatgtcccataatttcattcttggtgagtggcatcaccatatacgttatatctaaataaaaagaatggagtcattgatttcaaaaccactcctttatttctcctacatctgccaggaccgttctctccatttcttcaacatcatgatggtactaagtgcttcctgtgagctgggatcagctttgggctcagctgtaacaatctctcaccctcatcgtggtggtacacaatgtcatcaggctattaagggtagaggcctcagagctcaactgcctgaacccaactccttcacattttagacaacatgagaaaacaacatagcgtgtgactctttgtcgaatggttggaataacctactgcacaagtcaatggtgaagatcaaatgagaactcacactggcctctagtgagcagtcaacaaacattagccctaatggaaagggcaggtaaaattataactacacgtgttaatacacgttatttacacacagctttaaaagcaacttgaagtcagcttcttagaatactacacgaaggcaggatgctagtagtgttatctttttcatatgaagtagttagatcttaggataaatccaaaatatctttggtagaattctctaacacttgttgcaccttgttatccacctctaacaagatttaagctgaaacagagaattaggaattggaaggtagggtggtaccagtctttcacacaaacggtaacaacccacacataagtgcttgaactggatgcagaaccaaaagacgtccagtgggactggaaagagaaggggcaaggggagtggaggatttcatgtgggcagggagcagactgctcagggtcctgcagacagcttggatactcaacacatgagaaaccatccaaggttctacataggggcaggcgatgacatcatctaccatcactctgccttaaatcacattatctttttcatcctctgagttttaacagcttctaaaattcttggcttcatgatcttcacagaaagataaatctaatgccatttttcaattttaaaaacctccgacttcctattgtattttacaggattaaagcaaatattcattgtataagaccccttacaatatgactctaaatcagcaatttccaaaggagtttacacaggataatccgctgaggtgccagcatattacaactaattttaaatctcattttaaactgctttgtatttattttataatgtgcgcatcatgacaatgattacgtatgcatgctcggcttacacacggggcatactggcgcatgaaagtctcttactgataatctacaggcagcgtccccagcagcagcagcagnaccaccaccaccaccaccaacccctgttctgtttgtgcatttttagataatttgcggaatgcaagcctttgacggagatttcccccttcttgggaggaacgctcagtacaccggggatgggaaccactctgtattgacataacctttacactggtgcaagttgacctgaaccttattttccaagaaaggtattatctgggaggtttttgggcgtggggaactgttcacctgctatgtttggttgagggcgaaaatctaattccgtgatcgtccccattatacg

SEQ ID NO: 887 - DNA, 4858 bp, Homo sapiens
tggtcccctaagaaaaaggcccccacaagtaaggtgtttaagggttagttctcggtcacaaaaggaagggccaggcttggaccctggtccccagcccggttgttttacttgtgaggggcctttaaccaagccataagacttctcactgaaaggttgggtaccttggcttaaaaccatattccaagaatggagagagggctgacctcaagcatctggcgaatgccagacacctccttccgtcccaggagttgacccctagctcactgctggggttgaataaagtgagactgtgcggtggtgcaggcagtcccttcccagaggccttgggagggcctcgttagacccagtctcaccttttaaatccatttaaacccagttcgctttcgtgccttccgcttggagcctggttggaagcattagggctggcgcagctgagaggctggtgttgcagactgcccggccgaggcccttcccgtcctccctctcacgggcttggggcagggaaccttccgcccgcagccccacgcagcttccctcagcaggccaggaactgaccgtgacgccaatgcatacacatcttcatctgggttaggaattgaaaccagatttttttttagataaatacgtcacagaatgctattgaatacctttgtcttgccacacctccgcaaaataaactgttcttaatcgataccatgtagcaaaaacagaatatctttatggatgtattacattcatcaatctgagtgcatcagaacgtgtagttcgagttgtcgaaggtttactttgctttgaataccgttaccacgtgactaggtgctttctctgtgagtggaaacccagcggctgctgctggcaccatcactgggagagaccaccagggctgtcgctgtctccaagctggcatgttaccaggtagcctcttcatttaaacacactttttttgttgaagcctttctgctgtccgcagcctccgcccagtgcccctactatctgcacaatcttcgtctcatgctgaggctgagctgggcccggagtaagcacacagtctgtgcggtggctccacctcctgccaggccaggctgtctgccagtgtctgcgcgtgtgtgttagacaacgtggcatgttttaaaaacctaagtgtcttttgttttgtttgttttttgagatggagtctcgctctgtggcccaggctggagtgcagtggggcaatctcggctcactgcgagctccgcctcccgggctcacgccattctcctgcctcagcctcccgagtagctgagactacaggcgcccgccaccacacccggctaattttttgcatttttagtagagatgggttttcaccgtgttagccaggatggtctcgatctcctgaccttgtgatctgcccacctcggcctcccaaagtgctgggattacaggcgtgagccactgcgccccgcctaagtgtctttttatggtacatatacacctcaccttaccactatccccctgcctctctgacacaatgctggatccagggtacacctggtgtgcactgatccccaccgtcaccagagtttggagcctttgtccagccaataagttggagaagctgagggtgcccagaaatggacattctgcccgcgtgtcttgtaagccccagtgggttttctatcttgtccagagctcaggtgtttctgtacctgttggagctgagagacctgcgctgatcccatctgtgccacttcaacagagagagtgggtgtgtcctctctccagcctcactttccagaacgagtaacacacaccctgtgcccgtctctaggcctgtgagccccgtgagtcagcgaagcagggaaagggttggcaagctcaatctggcctcttgtaggatgcgggaggagccacccgctcagtagccccttttcttggcccccagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaaggtgagtggctggggaagggggaccctgcactccgtccccagagtagctccatccacgtccctttgctggggctggtgaggcaggctccagaggggccttgccctacaaccagtagccctcggatttggattcgcttcttttttactattgaatctgcatttgggaattacctacactcctgtcttgcttctggcccaaaggtctgggtaaaggagtttagaggattctatttggcccccttcaagggggcacccagctctgtgccagaacttaaagggggggaatagaccaaagaagaaccccctccacagctataagtctcatctcgagagaatcggcagccgagagagcgtgcatcaacctctaaatgtaaagcggaggccaggacggtgtggtcaccaggaagctccttaaagaagggcactatggtggccctgcctggtggtgggcaggggtcaagctcagtgaggtcgaaagagatgggtgtcccacatctgatcacaccggcctcaaagacaggctggaggctccatgcacctgctcagaccacctcccgctagaccctctcccttctgctctggcagaggccatcagcaaggggtcgacgggcagttacctgcaggaatattgagctcgaggcaccctagagccaaggagggtgggtttcccatccacgtggctttcccttggtcctggccttggggagatgtttgtcattgctgctgcggttgctggccagtgcgtccgactcccgcattcatgtgctctgcagggcagtgcgggatgaccagctctatgcaccaggccctgtgctaggctaaggggtgccctcttcaggtcccaacctaatggggagacagacaaaggcaagccattggtaggagctttgtgggttttccaaatgaaaaaggccttggagaggaaatcccccgggacgaagcttcccagcactgctttctccaggaacagagggcgtgcattttgaatggtggacagaagactcatccaaatctggcctgccaactcggtgcctacttgcatagacaagactgacttatgttctcctggcaaaggcccctggcagggccttgggggatgtcctgtcaccaaagaacatgccagatccctatgcaaaccctgcatggtgcagcacgtgctatccccggcagctcctccgtccccgctcccaggtgacaccacggagcagattcacactggcctttgcggagtggtccagtctgaccccacgacccctctgtgtgccccagagccaggagctccgaaaaagtgcccatgagtcaggcccggtgaggcgggcagctggtcttcccccgccccctgatgcctttccttttgatggaggaagagcccgggaattgctcagtagagaaataatgtcaccttctctcctcagaaggtggcccagggtcaagcgagttcatcataaagttcctgggctgagccccacccccacaggcacagccccactccctccacctcttagcaacagggggatcgccggggctggagcttggccaggatggcagcagcctccctctcccatccacaaggtgttgtctggttttagaaatcatgtaggaggctgggctcggtggctcatgcctgtaatcccagcactttgggaagccgaggcgggcagatcatgaggtcaagagatcgagaacatccttaccaacatattgaaaccccgtctctactaaaaatacaaaaattagctgggcgtggtggcacgcgcctgtaatcccagctattcgggaggctgaggcaggagaatcacttgaacctgggaggcagaagttgcagtgagctgagattgcgccattgcactccagactgggcaatagagtgagacactgtctcaaaaaaaaaaaaaaaatagaaatcatgtaggcaggtctggatttctgggttctctttagaaattacaagatgtggtacagagatctggccactcagcgcacacgttctcacgtggcagtgaggagctgtagcggagccggatccctgatgggcacggcagatgttcggcccccgctggcccggttcactcattcccgcctgccttggaaagtgcctggggttgccatccctgtcctctaaggatggtttgttttcgatgtccttattcgctccaatattagctgatgtgctcccgaatctgcaaagtgaagggagagagctatcagctgcacagtgtgtgccccgatgcctcctcacctggcttgtggcaagtcccaggcccatggcagaccctgtgttaggcaaatcccacatggtccccaagatcaaggggcccacagcaagaggggggacagacaagtggccctgttccgtgcccatgtggctcatctctactgagcatcccgagggccgacggccaggacccaggggcacgctttgcctgggcggtcagccaagcccccttgaaggagagaccagtcaggagtccttcatgctctttgggtagagggtgagttgagggctgtccccggcagagagtgatggcgtgcagacgggcagtataaaagtcatggacactggtctggttaagcagctcccggtgtggccagctctgtgccacccactggagactgtgatggctcaagtgtggctctcagggacttgatgcaggatgcagaggagacaggcggaccccagtcctttgctgacacagactctgcacgatggtgtgcgggcgctgttggtgtcttcaccacggggcctcaaggatccgcggtggcgcaagtggcgcat

SEQ ID NO: 888 - DNA, 4912 bp, Homo sapiens
attgcgcggctccttgcgcgcccgcggtgaagaccggctcccaggttcaagcgattctcctgcctcagcctcccaggtagctgggattacaggtgtgcaccgccgcgcctggctaatttttgtatttttagtagagatggggtttcaccatgttgttcaggctggtcttaaactcctgaactcaggtgatctacctgcctcggtctcccaaagtgctgggattacaggtgtgagccaccgccttggcctacaacccagcatttcagctgcattcacgtttatgtgtaggagatccccaaagagtattcatcttgtgcccttcgatcaacagcccccggcccggcccctggaaaccactgttctgttctctgcttctgcgagttggccttgttgaggtttcccacgtgagtgggggccgtccgtgccatgtttgtatctctgtgcctgggttactccacgtagcagagagtcctccaggtgcatcgtgttgtcacaaagggccaggtgtcctcctttcctgaggccggataacatcccattgtgttcaaatctgtattttttacctgttcatctgccgcagatcttcccacactgacctgagagagaggatggtggaaggtgcagggctggccgcaagacagagaaggggtcccgggtggatgtgctgtcactcacctgcactttcacccagggctcctccagcctgtggctggggcaggccacaaagggactcgcgccctgtatggggaggcacctctgacacagagtgaggcgctgcagtcagtatgtgagggcaggcgttgctcatgggccacactgtccccggcaacctcctaggaaggagtgtgttggggagaggacgcacctcttctatccctggcgcagccagttttccttccagtatgggagctgggttttttgagtcaacatttttttgacctatatttttctagaacatacgtattttgaagcattaccatcatgagagagcgcggtgtttgcatctcgaggggcccgtgggaaccagccccatttgaaggcactgcacgttttgtttctaatctcaccttgtcttctcaggcacaatggcaggtaaaagctgccacggggattacgttatttttccctagagagttgggtttggataaattgtgaatacaaggtgactactgtattcatatcaccttcatcagctgtgccgtcccctgctgttcactgtggcgcggtgtcaggcaggaagggccaagttctgctgcagtcacacgcggccccccaggtctcggaacgctggaggacagtgtttcctctctggaaagttccctggccactgtgtggggaggaaaagtggcttttgcccacaagtggagcctgccactcccctcaaggttcactggcccaggtgactctcgtggctgggagcagagaagaggcagcaatgccagttggaaggggagtagcctgcagcaggctctgctgtcggctgggtttccgaggcttctggaagctgaatcgttcgatattcactttgcacctgctacacgccgagccatgttatagtgaatacaacaaggtcctgccctccaggatcagatgttctcacaggggaccccagggcagggctgccccagctccaattccctgccatggtggcgctgtcctgctgttcactccagcctggagttgtggggcctgctaggggcggctcctagggcagccgttgtggaacattcctcatggttttttaaatcattttatacttactgatttggactcagcaattcatattcatcagtgaggtgactgtcatgatgtgacagctacagagggaccgaggaccccagggagggggtgtcatcattcccagcagcggagagcttgggaaggaagcagccgcgtcatgtttcacacccggatcctggttaaagtgctgcgctgtcgtctgacacccaggccagcgttagtcacgttgctcaatgctcccttccaggcaaccaggacagggctcagcagcccctgagaccccaggaggataggacgggataagaactatttcagcccttgcaaatctctcgtcaagagtatttttttagccacaaacccacccctttggccagttaggactcagggtcataagtgacagcaaagccaacctaaactggtgtgagcaaaaaggagtctgtctgtcacctgagtagatgaagagccaggacgtggcttcagggacatcttgaaccaggggctccaagcccatcgccgggatccactttctctcggtctcgctgtgagcaggcgccgtcctcacgtgagcgttcctctcgcaggtgcaggaggtttgcggcctccctgagcttcacagctgctcaattttaagccaaggaaaggagcagcctgtttgccatcaactctcctttagttccctctgcctgggaccatcctcgtcctgagcccccaaacagcgttaccgccagggtggctctgccagctggacgggcccagagctgagggtggggtcgcgccgccagcctacatagatggcgagcaggagacgggtggaccccaaaatgaaaatcagtggctgttgtcaaagaggggaaaggcaccccgggtaggcgcatgaccaacgtgctttgacgatgttattcgcatatttgtttcaacttgttttaatgttcgtggccaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacgtgagtcccgtcccgcaggggctgccggggctgcctgtgctgtgtgtgtctggtgtggacgttggccagtttgtcctgttttttcttccccatcttcctccctgtcttccttctggttggttcttccctttgcccctgttaattcccttgccctactatgtgctggaatgtgggggggcccctctgtgaacacaggtgaggtccctgttctaagggggagcagagagaacactggcgaggcagcgtttagaaaagcaaatcccatcgaggggtgcaaggatgacgcagcaaggctgttgacgcagagctggccgggaggggcctgtggaggttggggagggccctgcgcgtcctgtcctgtggcattgatgggaaggggctggtgtggctggagagggggcgggggcagaggacagcgtttggctttttgtctgagtccgaggtgaagccactgaaagctgttaaggcagggggtgatgtggtctaattcctgcttaaagactgttccagcttgtgtggggaatgcactagggggagtgagagtgggatcactggggggtcgtgcacatactgcttaattttacccccacccctatgagaaaaggccacgccgctgactcccgggattgctgtaggagacactgggcggagtctttgagccttaccttcctgtttggggactgggttctctacaaacacagagggggcctatgtaataaggggtccacaccgagggaccaccctcctttccaagctcgcatgtgggtgtgcgggtggcagtgcctcctgggagtgccacagtctcaggccgtccctcctggggcccaggaagctgcgaggggctttcccgtgtgccgcgggaatggggtgggacacctccagcttcaataacccacacacccattgcctttttcacagatggagaatgaacggaattccaatacctccaagcagagatactcggggaaggtccacctctgtgttgcccgctataggtaagtgcggcccctcggcgtccaccgagcccctgtgagtggggcagatgagatgttgggtctgggaacactctggggtctgagaagttcccttctcccagggcacgaggagaaggtgggatttcagcctggcctggaggctgagcagggttcggtggagagagtttgggtggcacgcaagtctcccagggctgccatgacaggaggtcacaaacctggtggcctgaaactacaggtttctcctctcccaaccctggaggcagaagtttgagatgggggtatcggcagggtctcgccctccgagggctccaaggaggggtccttctttcctcttctggctgccgggagaccaggcggccctggcttgtagctgcgtggctccagtctctgcctccatcctccatcctgcctggccgcctcgccctccctgtctttgtgcgttctcccctcttcctttaaggatacccttccctggattggaatctgccccgctgcagtatgactaactccatcacatttgcaaagactgtttccaaataaggtcccattcacaggtgcaggggttggtccatgagtgcgtctttccaggggacatcccgccaccgagagtgaaaggggacatgtccagagccccgatccccaccaccgagagtgaaagggggtgtgtccagcaccctgatctcccgcatcctcaccctctgctgggcgctgcaggctgcatctcgctgcgatgacagccgctgagtgggcttcccgtgcaggggccttcagtgtttgtgctcgctgagaggtaatgagccagttttgtcccgcacacctctcaggtcctccacgggagcttccgcagaggcggacgtgggcaaggatgagaggtcccccaggactgcactacctgatcgtaaggaaagcaagctgcagccaactctgcccatgggcggacacttgggaattcatcagccaggggcagcaggcccaagacagagcagttcacccccatttcttagcactcgtgaagacccagccttttgtctcacagatgctccaacagctctgagcgtggcgtcttcaccacggggcggagaagcggccat

SEQ ID NO: 889 - DNA, 9780 bp, Homo sapiens
ctttccttccggccccatggtgaagacgggtgggggcaaaggggaggggctcaagtggcagcatcagggcaggggtcactgagcaatgatagtcatgtggaggagaaagccactgggtcctatgatgcctggggacacagaaaagtgactgctgacacagcgtgggtgactagagacccacgagggccccccatactcccctttctcccttgcgtaccttgtgctccatctgctctcaccctcccactcctgcccccttgccaagtgatgcttgtcactccttttttttttgaaatggagtttcgctctgtcgcccaggctggagtgcagtggtgccatctcagctcactgcaagctccgcctcccgggttcacgccattctcctgcctcagcctcccgagtagctgggactacaggcgcctgcaaccatgcccggctaactttttgtattttttagtagagatggggtttcaccgtgttagccaggatggtctcgatctcctgacctcgtgatccacccgcctcggcctcccaaagtgctgggattacaggcgtgagccaccaagcccagccctgcttgtcactcttgaggagtgggcccacatcagaacagcttttggacctatgggtggggcggggggtgtacccaagagcacccaagcctctttaatcatgaggagaacccccaattccttttttttttgagacagagtctcgctctgtcacccaggctggagtgcagtagcgtgatctcggctcactgccacctccacctcccgggttcaagcaattctcccacctcagcctcccaagtagctggaattacaggcagatgccaccatgcccggctaatttttgtatttttagtagagacagggtttcgccgtgttggccaagctggtctcgaactcctgacctcaggtgatccacccgcctcagccttccaaagtgctgggattacaggctgaggcactatacctggccaattttagataaattttatgtagattttatcacaaaaattaattggaagaggcagccccacatacttcctgcatcttcctgttcagcaacgctgccaggtgcacactcactgccctgccccgccccactcttctgcttggaccttgaaggtcctactcttatttacctgtgactgccctgggccttctctcaccggctccattattagcttatttttctctgttgacattacagactatttctaggccacctatcctttttactgtgcatgtgcccctggcgatttcttcctatcgagggtttttaataacatctaaatacgaagacactcaaaagttataaccagtcaagtcccccctcattaggtccaacagccagatttctctgccagccttagaaaagattcttcctctggctgagcaccagatggagtagttggcttatatttggggagtgtgttctgtgaacacacacaatgttatgcacacatctccgctggtgtcatgctcacaccacaagaggcgtgtgtaccccagcctgcagaggctcctgtagagccaggcctccaggccagcccctgctctggctgagtagaatgtgggtggaactgcctgcactggttattgctcttgttcttttgggctgaacacacacagccctagtaaaatccacgtcagaacgcacatgtaccatgtcactcccttccccatgtctgatgcctctaccactgcgtgctactggcgtcaaagtgacaaccggacttgctcgcggtgtgaatactgctttggcctaagttccgttctgtttggagaggctcacaggtgctgtgcacacccctcaaactcaagagtttctatgccaggttttccacttaacgttgttctctatatctcgcgtgctcaagggcacccacaacctatgtgacagatataaggctcccccagacgacattctctgtccctctgactggcagtcagaacgctggataagatcatcttgagtctgccttcccctggtactgacgtatttcgggccatgtttcctgcctggagggttccatatagcatgtttcccagcctcctggacccactcccatcccccttcaaaagtgtaccatcaaaaccctttacagaataactttctctaaaaaaatttcaccttgacctttccctcctcagtccctccataatttgatctctgcttctctcctacgcctcatttcccaccatttctctatttgcggccaaacagtaactacctggaggcctaatgtccagacagaatgggaataggctgaaaggcagaaaacaccaaaatcgatcccctcccagttttctctgtgccccagtcagtgagacatccactcgtgtttgcacactcctctggattatctcccgtaccttagtacgccacgtgatggcttgcttttgacataggaaggtacaggatttaaggtttcagataccgagatgctgggctatagcaagaacagcacacgctttaaaacacgatggggtgttagaagtcttcagtgacttaatgggggctgatgtaaattatgaaatagcaaaagaaggaaaaggccagggaggacagcaggagtccctcgggggtccctgcttacgcttgttttactgatatgggatatagcagaacagagaaagaggagggtgatattacaatattaggaccggtggagtatttgaattcgctctctcgagatgtttaaggttacagatatcaaaacaaagtaccaagaaatttaagatttttggtatcaaattaggtgtcccctgtcattgtttatcaaataagaaatacttaaatgaactgggcagtccgctcagtgaacatgaccagcaaaatcatagtaaaaccatttggaggagtggtaaataaaaagaagcatacgtttcatattaatttagatctgattcccactataatataaaaacttagggaagactattcaagaaactaagaagataaaacataactggggaatagaaacatgcagacaaattagaaaaatcttcttaaattccaggaaagcccattgtttctacatgtgaaaatctaaatgaaaagtacattcctctgaagatatgtagattgttaaaaactgataagataaccatttaagcaaataaaaacttttgtgcaactgcagtctaaaaagatactgaacctaaaggatctctctctgggcagattctaataaccttcaaataatagtaattgctgtgtcacttaatctcctctaaagcatagaaaaaggttgaaattttcttagtttatttggtaattctagcataatcccggtatcaaaagctacaacaaaggtattccaatgaatacagattattattatttctggaatataatttctgaataaaatattagcaaatcaacttccagtgccttaaaaatattatatatgatggccagtaatttactgatgaaaaataagcagagcaaactaaaactttcttagcattataaaggatactttctccgtattataaagaccatctatctttactgatagtctaacctacatataacatgtaaaatatgagtggtattcctactaaaatacataacgagtcacagatttccttatctctgttattcagaatcgttctaagtgattagtaagacaattaaaaatgatgacaaattataaatattggtgaagaggaggcaaaataatgacaatctgtgggaacccaagggaatcggttgataagagaaataaatgcattcagaaaaatgatttgtgggggacatgtacacacacacacacttttccaacatgttttctaaataacagtggaatatatgctagggggaaaaatcattcacaatcataataagatctatataattcctttttgtttgtttttgagacggagtttcactgtcacccaggctggagtgcaatggcatgatctcagctcaccgcaacctccacctcctgggttcaagtgattctcctgcctcagcctccaaagtagctgggattacaggcacatgccaccacgcccggctaattcttttgtattttcagtagaaacggggtttcaccatgttggccaggctgatatcgaatgcctgacctcaggtgatcagcacgcctcagcctccgcatgagtcaccgtgcccggccgttggatctatatagttcctaagagtaaacttaagatatataaaggatgcgtaagaataaatctatgaatcttttctgacagatgaaaggaaaaactttttaagaggaggcgcatgctatgtcagaattgaaagacaatattatgtctatttcttccaaaagctaaatgtacatctaaacaaaaaagtataggtttgttgtggaggtgggactctttacaaaatgttccctcccaaacataaaaatgcattataaaaatacaataattaagacagcatggagtagtgttaaagtccataaatactctaagtattaaattcctatttacactttaattttaaaacgtattcattttttattattaaaaaatgatttttttaaagtagggaaagtgcagattatttagtaaatgtgttgagacatttgttctcatagttaggaaaaaatggtagatacttgagatttacatgtggaaagtgaaactataaaattgaaacaaaatgaggtgattatttctatcaccttgaaggaccttttaggcatgacccccaaggcagaaacatttgaccgcatgcaaacgtgaaattcatccttaataaacaacaaaaatggagaagcaaacacacacacacaaagttaaaaagcagaggttgagctggaaagaactatttgaaacacatgtgacaaagtatgaatatcctcaccaaaggcaaatcagaaaccaggcagaggagagagcctgggaatcctacacatgcctgcggctgtagcatgtttgacttgaagagaaacctaccgtccaggatgtcatcagttcttgccgattctgataaaggcggtgggggagcaggtggaaacacatgtgcaaggtggggacccccactgggctctgcgcagggtcctaagtggccctgtgggcttctggtcagggaggggcagctacttgtaaagatgccccagctgcggaaactctgagataaccccaccccattccctccctttgccccagggagtattcaagacatgctccaggggaacagaaaaggagggagggtggctctgaggtccctgccaggaatcaccagcagcaaggggtgggggcggggtggggggttccaagctgctaacagcagttggctctagaaaaaaggtaagggagaagtcctaaaatctgtggggttttaggtttttgttttgttttgtttttgcttatttgtatttcttccttttcctaaaatttatttttgacctatacagttaagtaatctagaaacttaaattgttttgtaaatggttgggtggcaaccatttaaaaaattagaatattaatggatttggtttggttaccgggcatattccttgaaaacactagtattagcaaggaagaaacaatgaagttcacagtcccaactttctagattatctataactcagcaaagttctataactcagccaattaagcaaagctatcagcaggcgtatgacgttcatgcccaattttaagagaaggaacggactagcaaaacaaaacacacaaaataaatgaaaatacaaaaatcaaatggtacttcttgatatttcaaaaacttacataataaaatccatcttcatcaatttcaccaaaaactgtaataatatctcctgtgcaaaatgtaagttcggcctgtggagatgaaacataaaattaatcgtatttttctacacaacagtagtagttttttaaaaataagttctctatgctttcccttactatttgagaatttctggtattaatctactctttcagtcaaataaaggtagaagctaatgaatggctctgtccacagtcttctagaaagtaagaacaaaccaagataatgtgcacctaaaaggaaaatgctgcagtgctttgattttggccaaaattcaagattattaccatgttctactgataatacatttttaaagctagtgaaatggttaattgtaaaaacctggaatattagggaaatgttctctgcagtataaggaccattacgtaaatatcctttcactgagtattttaaaacctactcaattattaatgaaacatctatttatttattgagacagaatctcactgtgttgcccaggctggagtgcagcagtgcaacctctgcccactgcaacctctgcctctcgggttcaagcaattgttctgcctcagccttctgagcagctgggactacaggtgtgtgccaccaagcctggttaatttttatattttttatagagatgtggttttgccatgttgcccaggctggtcttgaactcttgatctcaagcagtctgcccacctcccaaagtgctgggattacaggcgtaagccaccgcacccagcctaaacatctctttattcagtgtctacgatgggccgggctgcagccccaaagcaggcggtgtcaaacacgccccactgccctcaggggtccaactgacccagcacatttcagttcccagtcacccagcagaacatggaagcagaaatctagacaatattcacaaccaaacacattttctttctaaatgtcaaaatgagggaatatagttggtgagccagtggcttgtcagagcaaagtactgtgtaacatgggttcacatacatcttgtcatctcagctagtagctgcagagactggagaccccacctctcatttctgaaggcagtggtttcagccttcaagacaccaggcatcccaagctgtgccaggcgacacaacctcacctatcactggtttcctctctactgttctatgtgtggggcctgactgctttgcttttgtttgctgaccacatgtgatgggcttttatttctctcctaaagatggccctcaggtggcatcaccattagatgtggatgacagattgttctttctgtcatggcacaggaaaatctgggccatggggacagggcttgtcaggggctggccatgtccctgggaatcccatgatttctctcctgcgtggccatgtctgtatcagccatccctcggatcggcagcccttcttacggatggttcggagagaaggaatgaggaggtgaacacacgtggcctcagtgtggtgtaccacgagggaagggaagggtgtggttgtgtccgtcatgaagtgcagtgtttggctggtacctcgacatcgacgttgggcgagctttctctggggtcgtagtcatacagggccaccattctccgcgtcgataccgaatgacgcctgccacttctcctgcttctctctgttcagatcacaagggggaaagaaatccatcatgaggttatttcaaacttagcggtgttcccctccttccgggtcacacatggccaatacagccgagacctggcactgctaacagggccacgtgctcctgggcactcacatcagcaaacgtctctactttgggtcagtggtctgggactccatattcttatatttttgctgtagtatggtttctcccccttagactaacatgaaccttttccttcctccagtctgtccattaaaccagtgagactcacatgaagcacggggctctcgaacagcaaatttagacggctttggccagcacggggaggccgtggcttgggaggccctgcagagtgcacggttgtgacattgctctgggaaggccccatagacacagttttaaaagtgcctgtttgtgtaactatggtggcgctacaaaatcaagtcatgctcccctaagcataggcaaaactaaggcactgtcctcaggagaagcacgaacataaacagggatgccttctccacccagcccagtggcttccctcatgctgcttccctggcatccttccattgtggtttagcagcggccgtagagaagatcccagctctgcacagtcgacttaaaggtgcattcccacggcctggctctgtctctgccacagatcggggcctggggcatcatccccagcacactcagaagcataacaaggggctgcagaggaattgcccctaggctctgcccagcgtgagcgctccacacagataacaggtgaacactctcaggacgtaaggaggcctcagtgcagagccgcagaacttggcccaatcacgaaacccctgtcagactgaaggggtggggctgtgaagtactttcctcctggcgaaagttggcatttatgtgtttcttctaaacacagccactttttgcttacatttgatttggggaattccaaacatacagatgaaaactatcaaaggcaaatatctcaacggcaactaaagtcagcgatgtggcttttcagtggttttcagcaggtacaggggccagctgtgtagccctgcaacattccagcgattactctccccttgggttctggttaggagccactgctgtagtttacaggacgcacacacgcctctgtgcacatgtgtcctctgcaggacctgcacatgtgtgtctcctccagaggttcgtgtttctcagcattattcatgttacagggaatgttacaagtatgacttttgaaaggtggcataacaacatacatgtacttctcactgaagtcaaacttacatacacgaaggctcactcttcccagcgtgcagtactttacgttgtgataagcacacacagtccagaaaccccacaacaatcaagatatagaccggccatagtcctctgtagtcacttcagcccagatgaccacagatctgtttcctgtcccagaccttgaccctttccagaatgtcactaaaagggactcatacaaaatgtagcttttttttttttttttttttttttttttgagatggactctcgctctgtcgcccaggctggagtgcagtggcgcgatcccggctcactgcaagctccgcctcccgggttcatgcgattctcctgcttcggcctcctgagtagctgggactgcaggcgcccgccaccacgcccggctaatttttttgtatttttttgtatagacggggtttcaccgtgttagccaggatgtttcaatctcctgacctcatgatccgcccacctcggcctcccaaagtgctgggattacaggcgtgagccactgcgcccggcccagaatgtagcttttgagacaggcttctttcatctggatgacgcctctgagattcacccctgtcactggctgtattagcagtggctctgttccattgctgagtaggccccattgtgtggggcgccttcgttctgtttctgtcaccagctaaaagcacctgagttgtttccagattttgatgaccgttggtcaaaccactattaacaaacattcatgtacagtttttttgtgtgtgaacgtaagtttccctttcttctgagtaagtgtataagagggaagttgttggattgtattgtaagtgcacatataactttacaagaaaccagcgaactgttttgcagagcggtgatgccattttccactttcaccagcatgcacaggcccacctggcacactttgtgcccacacctgcgacggccagccgttttaatcttagccattctcagtgtgtgtgcattggtttctcagggtggttttaatttgtgtttcactgatgatgttaaagatctttgtcttcaccacggggcctcaagaatcagcgctggctccacgcgggcgtcat

SEQ ID NO: 890 - DNA, 9763 bp, Homo sapiens
  misc_feature (1)...(9763): n = A,T,C or G
gaagacactgggatgagggagttgaaggaactgtcaatgcttggatgggaactgggatgagggagttgaaggaactgtcaatgcttggatgggaactgggatgagggatttgaaggaactgtcaatgtttggatgggaactgggatgagggagttgaaggaactgtcaatgcttggatgggaactgggatgagggaattgaaggaactgtcaatgcttggatgggaactgggatgagggagttgaaggaactgtcaatgcttggatgggaattgggatgagggagttgaaggaactgtcaaggaagcatttaggtttattcaatgtggtttgaatttcaataagaaaaaaatttgtacaattcttttatttgacaaatgtgtgagtgtctgctatgtgccaaataaattttaaaagaatgaagaaaaaaggcattatttatagataccagtaccaggtacaaatgaagtcaactgccaaacttacattaaagtaagtctatctcaccctacagcgaattaaacagctaaggaagatacttttttccaaatactattccaaatattatttagtaaacactgcaagtcagaatacaaatcaagaactttggcagccttttttgacaattacattttcaaccatgcatgaagcacatcgaagagtaggaagtgttaagtcctcaccagatggttctcccccatcagtggactttgaaatccagttgtacaaacatcttctcttcgaatgatacttaagaaagcaaaacagcaagccagaaactggaaggaaatattcacagtgcatgtctacaacaaaagatttgtatccagaatacataaacaacttttacaactcaataaaatacttttaaaatgtgcaagagatttgaacagacatttcataaaagaagatgtaagaacggccaacatgtaaacaaaaagatgctcagcaacattacttaccagggaaatgcaaacaataaccaaaataaggtaagattacatacccacaagatgactaaaattaaaaaggcatcatcaaatactggtgaggatgtggagcaatgaaatctcacgcattgtaaagaaaaagggaaaagggcataaatacttagaagacagcttgttagcttttcatgaagttgcagacatgcttcccatataaatccagcaattcctcatctatgtatccgccagagaaatgaaaacatacatccccacacaaaatcctcaacagtgtttttcatggtagtctactatactagccaaagattggaaacatccaaaacacccactgattgatgatgaataaacaaatggtgaactcatcacgcggtcgaataccacccagcaaacaacccacttacacagatacacagactctgctttaaaacaccaggcagaccaaaagaagccagacacaagagtgcatgctacccggttctccaggtgagattccagaggcaggtcactgctgcatctggtcccggtggggaggactgcttgcaaagaggcaagatggaacctttgtgggaggaagggtataggcattctctaaaacttgatggtggcagtagatccagaggtatagacatttgtccaaactcattacactgtattcatttactttatgtaaataaactagacctcagtacagttgatttaaatcagaagcaatggcatgtaagttgggtcagggagaatagcattaaagtgtttaaagattcttgcgctgtccagaaagaaggtacatgtactactcccgctctccacttcacagggcctgggaccaaatgggaagggttggcctccgatggaaggtgagagcgagcaaatcatgaggccagatgcagcccccaggccccagaccaagggcaaagtgcccgcttgtgctaaggtacctcaggccctgccacagctgaggccacagggccacaccaaagggctcctttcgtgcctccagatcacaccctggcattgcatttatgccacatgggtggggacatggccaggatggactggacctactcctccaggcacccatgaagaaaaccacccaatgccagcagagcatctggtgttcagatacagccggaagctgagatttagaatccaggtttctcaaaagccgggttgctttttcgcctgtctggacggccccacctctctgcctggtgtaacttacttcccaggggagatttctaacatatccacgtccaggtctccagctgagattgttccgtgaactgcgtgcgcaccgacattaggggttgctagagctccctggtgaccgccatgtgcacccaaggatcaaggaccactgttggggcagagcccttcaactttaacatgcccaggaaatactaagggctgtttttctgaattatgggcggcactagttattcacctatccgttcaataatatctgagaacctgctttacaactggggatcatcgaaactgggaagacaaaagtgaacaaaacactcaagaatcctgccccttatgggctcaacatctaacgggagaagaataagaaaaaaggtaagctgggccctaccttgctaaggatcccatgaaactggggagaagaggcgaagggtaggtgtctaggctgcacgctcacagggggtggtcacagagggcttccctgtgctggtgccatttcagcccagacctgaaggaacacacgggaacttgggctccgagcacagcaggcagaggaaaccaggcagaggccctaaggcaggaggagaaccgagtctcctgtgagcagctgggatgacacaacatgggaacctggcaacgactctgtgttcctgagatggggatccatagtgggactgtaagcagatgtgtgacttcatcactgtgactactttgctgaaaatggaccaaagtcggggcaaaggcaagagcagagacatgggttaggaaggctaggctgacaggattagtggacaggtactcgtattttgaaagtgaagctgataaacttcactgaggaatctgaggtgtgatgtaagagatgactccaggatggctcccaggtttctggcctgaatgaacatttggaaggatgaagtcctgatttacggagctggaacagggcttcaagaaatcacagtttaactttgagcatactgaaacaccagttcaaccagaggttgtcaaatgcggtctggaggcccctggaaatctcagactcctttggagttctgcgaaatcaaaattatctgtatgatactgagaggtcacttttcctttgcactctaacgcgccctcaggcatatacagtgttttccagaggctacacgtcatgtgctgacagtatcattctgacaatggaatatgggcacgcatatttttagatgttttaatttttaatatggtaattatcaacagatataattcacataaacaaaatctctgtgtcctcagtaattgaagagtgtcaggcagttccgagaccaagaagtctgagcagcattgtgttggacagcctaagggagacgtctaggagacagctgatgatgtgagtgtggagttcagggaggaaactgggcctggagatgtggtctgggaagcatcttcatacaaatgagtcatgggtgaaatcaccaacagaggaagagcagaaagaaaggggatcctggcagagtctgaaggcacatttaggccttagagacaagaaccagcaagagactgagaaggaacagtcaggtgtggggagccaagagagcatggcatcgtggaagccaggcagagcatgtttccaggagaaaggggacaccatgccaggcgtgcagcaggtctggctggaggatggccaggaattgaacagctggcactggattcaagagaggatggggaggaaagaagtccagacaacacaggagttttgagggaaagagagaaatggaacagtagttaagggtcaatggggcccaaaaggcttttattttttaacataaaaaaaaaatgacaccagttttgcaagctgttgggaatgaataggaaaagaaaaatactaaagcagggaaacaaggagagacgagattccaaaacaacatcctccaaaaatgaatgtcttgtgcccaagcaggtggggtgtgctctggccgagtgcacagaccgtgcgtgccgccacaacaccgggctgcagagcaaacgcggttcaggtgggagcttgtgaagctctgcctggatttttagcaaaatagacagtagttgagaatgcggatggaggtggtggtggtggtggtgtaaggagacaaggtatgaaaaacatcagagagctgtggagccaatggctagacatacatgtattgacagcattaaatacctgcttgtgatcatgaattgaaatacaacaattacacagggttgcgtgcttttctccagccgtgtttatttgcaaaggaacaggcaagtaggcaaaaagctggacttcaccggtgtgttttagccaagaattagaaggaaagcaccacaggacaatgtgagcaagccaggagctaccatctgcaaggaggaatcggagctcggggagcataaagtggcaaagggagggggagcggctgacatgatctgatcaaagtagattcaaagccgagtggtttcttttttgcgggggtcggggtgtctggaaatatcagtgaggagcaagagggacacctacctcaccctccagaccttggcagacgagaagtgtaggagagacaacagcagcactgtgagtgacccgggagaaagccgagtttgttaaagggagatgtaaagaaaccgcccctaagaggctgttgagaatgagctccagaggacacaggaaaagttgaggagcaggggatggtgtcaaaaaagagactgcaaagagctcctcagagatgagcctgaaatacgagggatcacctggagctttgggcttgtgggaagagcccagggatggggcatgccactggtcgtggggttcccaggcatgagagtgggaaggctgcgatggacgagggcagagcgctggactccgcagtgcagagttctaggtgcccacttgagttctggcagcacagggtgcttgcaagggcagcttaactcagagtgtaaaggccatgcagcctcctttgaatggtggcttagagagaatagtcatcttactccaagtgcagggactccctcctgactactcttgaaaattttacagtttctctattgtacacaatggatttttaaaatcattgggtagtaataatgaaggtaaagaaaattaaacctagcttttgaaatcttgtatctgaatgacaataccaattacacaaactttaagcttttacttagaaatgtacgaaatatctgaagactcgtatcatagtatcagaatgaaactgctgttgaaaatactttctatttgactctgaggagagagccagagccgtcactgtgtgtaagcagcaggttcaggagattactccaaaaaactcctgtaggacttagggaatgcgtgtaaaattgctaaatagaatgcttcaatgagtgtcacatttttgaattttgaaggaaaatgtacccagaaaagagtggacagacttcctacaggcatgcacttttggggaaccacccaccaaatccctggggttccttcaggaaccaccaggtagactggtcagacgaagctttgggaagggacagcctgaggtcagtgtgtttaacactaaagcttttggacatcccactcagatacgcacatcccacgtgaaaggagaaattgggatttcacggagtctttgctttgttctttgtgagtgcggcagtgaattctctgacagtgctccgtgtactcggtgtggctcagacatcaacctagtctctgtcgccgcatgcaacaggtttgtctgatgaaaaccacagcagaggcataaccaagacgatgttaaggagacccctttcaactagcatttgccaaaagtccctggcaaatcacctgggacttgtttaatagactgttcacctggcctctcccctgagagtcccgattcctaggtacagtttggaacccagtctgtgttatcacaaacccaaccaggtgatgtctaacagattagtaaatttgggaagtgttacctaggatgatgacaaaaccaagcaatacccttttttggcttaaaataacttcagccagttttctgtccctttcaactaagtctttcttgatatagtggggtctctggacacctgcaacttttccacaattatcacatttaccaatttttcacggttctaaagacattaaattcaactttcactttgaggcagagctgagacctgctaagaatgagcttttcatgacttaactaactgactagccaccaaaatccataaataaattaatattttccagtcgtatgattagacttccttatattccttaatgctaggacaaccttaagcaacttctaccattgaaatgtttgtctctggcctccttttgaaggtcacactgttctgtgtttcttgtcttctcatgcttagaaatcgaacaggttaaggaacctgggctgcttgcccagaacaatgttaacaacaattattagctctaagaactaaaaggaaaataaaatggttttcattcataatatgttaatgaggctaaattcagaatgagaccgtgtgccacaaaggtaagacaaatgacttgagtgatctgcgttagtttaaattacagttccagggacttgtgtattgtcattaaagcttacactcatcacatttgtaagcaatgtttaaaggtgttcccgggatttacaataattcattaattttaagccttctctttgcaaacgttcctgagaattcctataaatatgtagatataaaaaactacaattaccaacttcacaacaccacagacttcttagtctgtgcttccttataagctgtggatacccgttcttatactacaaatattggaggtggcagcatttccttaaaaaattttactctgacattagagttcgtaagagacactaattgagcctttttttttttttttttttttttttttttttttttttttttgagacggagtctcactctgttgcccaggctggagtgcagtggcgtgatctctgctcactgcaacctccgcctctcaggttcaagtgattctcctgcctcagcctcctggcaccacatctggctaattttgtatttttagtagagatggggtttcaccatgttggtcaggctaatttagcttttatgaatggaattgtatgcacttttaaaaattaaatgaaaagaaaacgcacatactttcagtaaaacaagaattacagttattcaaataaggtgacaatcacatcaattttattttataacaaatagaatcatgtcccagttccaaaacaaaataaatagtaatgttaatatagagatttactcatggcttttttgttaaagagtcttaaaatgtttttttggacaatttaaaaattttcaatgttttttttactcccatacaacctagcccccctgccaaataaaaatcaagcatattttctcctgtatcttgtgtataggttatataatagtaccttttatctntaagatatgagctgaaaccccacctatggttgtagtgagcatcctactttacgcctcttatctcctttaaattcaaaacaggtatctcaaaaataaagttaatataggtttataagtaggacttgctcactcctgaaagtacgtttaagtaaatctccaaacacatttcaaatactctcagagagtctgttttatactaccaagtatcttatccacatttcttcaaaataaacaaaaaaatgctcacaaaatatctatgagaaacaagaagataaaatataaaatcttaatttttacgtataaaataaggaagccggtgaatagcaatgctagaaataaaatgctagatctcctaatccccttcccaagtttcatccagaaagataacagttaaaaaaaaagtaaataaaagcttaaaaaaatcccaaagtcatttcaaaaagaaaagcggctgcatcgtcttctgcaggttagaggtagtaaaggcggtttgacagtgacagatttggctctctgtgaatactctggccaacaagaaaagccagcttgtgggcgtactggcaaggagcaggaacacgaatgacaccctttagtggaaggaaaaaaaggttctattactctagacttagcctctttcaattgcaaatctcagtattaaccctaaaagccttttaaaccacagctatttcattttgaaaagtgaatgtcctttatttgctaaacatcaacaagtagaagcacttactggccagttgtaatagatgtggcacagcttgtaggtcaagcgctgtatgtggtctggcttcaggccgctgttgtcatagatgacattgtaatgtgtgggagaaacactaccacttctcacagcctggctcacgataaaaaagtcatacctggaattacagaaaacacacggatgtgctgaaaactaaaattagggtgattccagtttcttacagtgaaaagctctgtaccactcttcactgtaagttactacagtaacctcatctcttctcacgctgtaacgtgcttccttgaagtccaggagcctgttattcatgaaccatttgggactgcttatgtgtgaaagatgtttatcattaaggaagaggaattttgattttaaatatctgtcatgatgcctcccagcagaaccaagcatttgttacgggcgctaaaaacgatggcatacttggccagttcctgttttccaccccgacccccgaaccatgtgactgagccttcagactctggaagcacgacctgtgggggcagcgagtgggtcgagcttcagggactgttactccccaaacatgcttttaccacggaatcttttcccctcttgctgttcccattgttatttaacaaaagtagaattcattttaatccccaggaatttaatgcaaatctttaagtggaagggaacatgaaagaatataaactagtatgggaccaaatggaagaacaaaaaccaagtatagccatccattgggaattggttccaggacctcctgaggataccaaaatcctcggatgcccaggtccctaatataaaatgatgttgtctttctataacctcccatatacttgaaagtatcatctttagattataatacctaatacaatgcaaatgctatgtaaatagttgttttactgtattgtttaaggaataatgacaagaaaaagtctgcacatgcttagtacagactttattccaagtatttttgatccgaggttggttgaatctatggttgcaggacctacagataaagagagccgcctgtagtacaaatatgaaagaatacgcattaggttttttcttttttcattttcttggtcccagcaaaatttcattccagaaaaattggtattggaccccgctttagaattaagggaaataaaccgttggaattattatccccctcaaaacctataaaatgtcgaaagcggaactggtctcaccccaaaggggttagcttcctttttaaaaaagagagggagttaaaaaaattttacttgcattggttcaaaaagaacccagcgaatctttgcccgggccttgaatccaaatcccggtttccccaattttagggcaaaaaccctttttaaagggttggaaaaaaacaaagagatttttgggggccctaaaaaaccgggggtttgacg

SEQ ID NO: 891 - DNA, 6708 bp, Homo sapiens
  misc_feature (1)...(6708): n = A,T,C or G
ttgaagcccagcattgacgccagcgctgatacttgcggccccgtggtgaagacctcttactgaaaagcaattttacaatgtgcaaagggtcatgaaaatgaacattttgctgagatggagcaccatgctctggggaatttgtcctcaagatattttcaaaagaaaaaaaaaagcacatgtgaaatatagcatcgattataatgttgaaaatctggaatcaatataaaaatccaatcgaaaggagacagtttttcaacattgggtaaattcagttaatagttaagtcatcaaaatggtaatttgaaagttatataacaattagtatatgataagaggaaaagtgggttataaaattgtatggataagctaagactgaaaatatgtaaaaatatagggaaaaatcacagataagaatacataaatgaagcttgaaggcattatcagcttttggaaattataggtgagctttttcctctatttcccaaactttgtatagtatcattatttgttttgactattttaaaaggcataaagtgtaactaatcaggattaaatgaaagggcaactgatttttttttttttaatccttttggaatgttttctctaaaaagcaattggactgattntaaatatacgtggcaacaaggataaactgctaatgatgggtttgcaaatacagatcctgctgaaacagataaaagtaactcacgatgagcagttcctgtgcgatccaatacgccgtttcttcgagaacagtcgttctcttaagttggttaaatctgtctctgcaatcttgtttggaggattgatttgcatctgaaaccttccttgaagtacaaagataaacttcaactcaattaagattgcattatccagcattctcattgacgacatttaacatagtacaatttccccatgcaccatcgttcatcacatgaataacgttttgtgttcattgtgatcaataaagccaaagtaactgtcactttctctacctataatgcaggcttataaacccattcgtagcttgacctgtaaagtgtgttgtgtacacacgacattctaggaatagttttgggcgctttatgtaccttatctcatttaattttcatgatcctactgatctcgcagactcaatccaagtttcgtctcacactagagtctgacctctgctcaccacactgtacctgtcatcccaaagttccgttttcagtgtaaatttctaggacacttctgatctgcgcaggaagaaaacccataccctgtgcagtgatgcatcctgtcaaacagctccacatgatttatagcaaccaaaactgcaggcactttcctttagctcttggtgtttaaagaattgaagtgatgatgggtgaaatttcaaaggcaccaataggtgactaattaaatagtaatgtagatgaggttggcatatcacatcccaaatcagttccacctctgctaccggtcggttcatacactcaacaatttccagaagaaatatattttacaccagtgcaaaatccagggtacctgtgtgactaaacatggggagaaatggaaatctatatcaacaattttaattctatgtatgtgatttcagtattaccaattgaggcaatatgagtcttaatctgataatttttcaaagtaatctcttatgtgaattatctgcatgctgcagatactgaaactttgtgattatttctactaacagttaaagtaatttggacaaggtagagtttggctttgtacagattagaggccgatgagtgatggatggataaatacaacagaattgctcattttaaggcatttgtttaccgcaaaacagtcacccctgaagttcaccaaggtaaactgcatatttgcccaaactgaatgtgtccccaactgaattccgaatttcatttctgcttcgaaacacattactctgaaaacataatttggcagtgtttctcaaagtttgatcttgaccaactgatatcagaatcaaccggagagcctcttaaaccttcagatggctgtctctggggactggttcagttgtttgggcttgggtccagagatcctcatatttaattagctcccgggcagccctgctgcacatcctgaggtgggacccgctgcgtcttccgttaaggtgtcctgggttgcaccatcagaaagcccaagtgtaactggcatgaccaataaagaaaatttatctcttggaattttggtcatggtcccaggaggtctagagcagctctgggcaccacatacttcaaagtccagaggcaggaagagaccatctctttgttacgtcctgttttttccttttttttttttttttcctttaatgaccccagacaaaatcctcttatatgtctttggccaggattgtttcacatgctgaggtctaaaatacaccatttactggcaaaggttttggagctgccacatttgtttagaataatttcaaagcaaccctgagttactcaaggcagtggtagccaccccacaatatgctgagttctgagagcagaggaggcagtgaacgattgtgtgaggcgagggacagcccagttaccccgatttgatccgtagacatcgcacgaacctatgaaatattgtaagtacccccaaaatgtgtacaactatgacatgtcaatttaaaaaaaaggtagtaaacagtctttgggtgtctctggtgccaggaaactgtgttcaaactaatttgggcataacagccagtagttatggccactccaaaacaaaactacacagctcttggggaggaaatggtcagagagaaggatgcaatatttgaagaagaaatgaacacaacaggtatataaaaattaagaatgccaaaggccagtgactttgcccttggcctgagttctgagaggtacacaagaatggaaatggacaaagtgtgaatactttgtcgtgcaaaggtgttgcataaagctgaacactattatgtacattcaagtattcaagaaatatttcctgagaccctcggaatgccaggaaccagacgcaatgttgagtaagaccaggattctgtcctcaacgtgttttcccaataatgaaggaaacgggttaagtacgtgtttacttacaattgtggtgtgataaatgctattggagagacatagaaaggctggtaaggtaaaaccacagaggagaggccctcactgcagggatgctgatccacagagagggaaatgaaggaaagaaaacctcatggaggaagcgcccaggagctgaatttcgaagctctctatggcaggagcttggaatccagatttggggagagcctgggaaaggagcaaagtcggacaggccgatggaggggggccaagccacaccacagaacgtgggtttgacctggcagcctagcaatccccaaatacttctgatcatgcaaccagaacagaaagttttgagcatgagcatccaatatatttatatttagttgcagtatgccactatacctatttgcaacatgccacagtattaggcacataataaaatacaccactaattaaagattaaaaataaaataacagtgaattaaataaacattttcatttggtaagaactttttctcactaccataattatgagtgatacttatttcttttccgtttaactgtgtgaaatgaaaataactcagcctttccatctgccgaaagcttgcaggaggagtagaaagaaatgcaggtatcagctctaaccatttcttggggtttgctgatgtttgcattttccgtatgtccccccacccgttatttctttgcagaggaatcttttccaaccatttctttttgtgaaggttggtctagagagagttgggttagtaatcccagccgctgctgacggggcccaccaggccacagcaggtcaccagaggctggctacgagtcagagatgggggctaccaaccccgccatgcggtggggctcccaccctccaccctggacacagccattatgcacaagacgcaggaaccaaaggagggtacgggcgtcccccgcatcttacatatattacagctcaacttattttcttatttttagaatcaactttgttctaagaagctctccctttgcctcctgcggtgaccttccatgtcttgctctagaggccactggcaaagcaaccgggcctagtgctaggaggggagggccagggccgctgggagatgcgcatataaactgcaggggctaacacgggccagagtcgtccagggccgctcagctgcagaggcctgagaatcctgacagcgggaggatgttgagtgtcactcctgagctccgagggtgagctcgcttagcccagtggttctcgactgcagggtgaacccgaatggactggaaccaacgtggttggcaacacacacggctggctcagccccagggttttggattcagcaggtcagggctgggaggcaaggagttgcatgtccaacaggtctcggtgctgctggagctccaagccacacttggacttggagagccgctttgtcagtgcgtatgcatgaggaggcgggagaagggcaaactcctgtgggtagctgcaatgactggctatagctggaggaagaaagccgtatcacagagggcaagggggatggtgctgagatggatagggcaggctgagcaacactcatgtgtcccagggaagacaggttgtctgaaaggagccactgggattagaaaccaagagggttctggagcccacggaggcctctgagaatcaaaaccacactgtgggagggcaagatgtggacgtggggcctaagaaaccattctttcaaggagatggactctggagggaaaagaggaaaggaggagccgtagggattcatttttgttttacttctttttctcccccccaactgtttttatggtggcaaaatacacagaacataaaatttgccattttaatcctttttatgtgtacagcgcaatggtatgaaatacattcataatgtcgtaatgtcagacaaccaccaccaacaccagagctccttccatcttgcaaaactgaaacactgtccccatcaaacaccaaccccgttcccctcccccagccccagcaaccctgctttactgtctgtccttgactttgacaacactaagtgcctcttagaagtggaatgatatttgtctgttcgtcactggcttacttcgctgagcttaatgtcctctaggttcatccatgttgcagggtgcgtcgggattcccgtcctttctaaggctggtaatacccactgcacggatgaccccgttctgctcattattcatcaatggaaacacacttgggttgggtccacatattaactctttaacaatgctgctatgaacagtgggtacaaatatctcttcgagacccttgttttgcttcgttcttaaagacgaggatgactagtaagaccctgtctcttaaaaagtaaaaagaaaatattagccagctgtagtagcccatgcctgttgtcccagctactcaagagacaggagcccaggaggtcgcggctgcagtgagctatgactgcaccactgaactccaggctggctgacacagcaagactctgtcttaaaataaaatacaatatatacaaataaaataataaagaaaattgatgaagacagctagacaacattgacgtgtcaaggaggaagccccagaagagagaagtattgagaagaagaagaggaacttgggagagaggaggatctttgaggaagcaagaagggggaccctagagctgagctaaagggactccacatgatgaggcaggcacaggtgtggcatgggcagctcacaaaccctggcctcattttctcagggggaacaccagggtcagaggctctggggcctgtgaagatcaggaatcgccatgagaggcgtggaaaatggaattaactgggaaggagaggagaaaaggatgactgtggactgtgtcccctcaggcaacactctgcagtctggtgcaggcccctgggtgtgggtggttgggatccccaagtcggttgggggtggcagaaaggccacaatgcagaggtgctgacagtatggaggggcatgtggggggagaggcaatggccccagggtctggctagcattggagtagagggctgtggattgaactcagttcacagatactctgagcaagctcgtgacatgcagatccctgggctccaccaccaagagatccggatacagcaggcctgggcagggcctgggaatctgcatttctatcaggcttccaggcgaggccgatgctgatacattccatagggtgcacttggacacgtgcccatctggtccaacatgctcatcgtctagcgtggaaaaaagaatgcagagagcttaagcgaacagaacagaacccacttcctggggagccaagtcaggaccccctgcctccgtcaccctgcccaccccaaaacatcccccttgtggccagactgtgatattcaggatttgttcacattttgtatataagagaacagacgaacttcagcctcacccattgctctttccctctggatgaatattcctggataaacctccgggcatgctgtcttgggtacacttgccattgccatgccgtccctctagttagtccctctaggtcaggggtctcagggccaggggagaggctgggcagctcttcaattgtcttcaccacggggctgcaagaggccgcgccat

SEQ ID NO: 892 - DNA, 7096 bp, Homo sapiens
  misc_feature (1)...(7096): n = A,T,C or G
attgagcggccattgagacactcgcggatcattcagaccccgtggtgaagactacccttgtccatgagaaccacaggatcacaggacttgtttccctgtctactggtgcacccccggcccagaacagtctctgacacatggtgaggcagaatcaatgacagcaaaggtgaggcctctcgcctaaaacatctgtcccacgcccccagcccacactcccctctccatccctcacagcctcccacatgactctgcagcaatgctgtaacctgcttggtaccgttctaattccatgtaattctcactttctcaactggactagaaatggctccatttccgtgtgtgcactccacaggcaacaggagtctaattaacattttctaagtggaattaaagcaatgattttgagtggaggattcatcctgtggctgtctagaaactagactttaacacttgaggagcctagagaagattggatcctcactaccaaagattccacatttcaccaaacccacagtcaaaactgtgaaccagagacataagctggttctcctggaggccatcacactggcggagttagtcacgcagctataataaaacatctctcggagatgggctttgagactgatgagggtagagtgaagtggatggcgaaaaaaaagtttaagccaaaaataggagagatattggctgcaaaggctgaaattcgtggtgttaggtggatggtaggggaaaagatagctcagtcagggggtggtgggggccgtaagtttaatattagtgaggtctacgaaccagccaaaaaaaagagaaatggacaaggctcacaaacacacggacatgctaaatatatccatccatcctggcatgaggacatactgattcattctgcacagcgttacttttctaaatgtagccagtgtgcatgtctctgttgaaacatctatagaaaaatcagtgttgcaaggctgagatattaatcaatgtttctttctatcactaaccctctatttctcctccattcccctcccacttcccatcctgagggctccattccatgctcactgcctcagggaggatgagagatgggtcagggaagagcagaaactggggactcccctgggctttggtctgcagagataaggggaatcaagaagacagcatacagaggggttactgtgagaaactgagactagatttcccttctaatctgcagaaatatattgcttcaccagaggcagacaaattagctgagaagaaccgatgcatgtatagacactggtggatgggctcttggctctgctttctggaaagttccagagagctgactcctacagaattcacggctagcatggggagttgagaaaatggagcttaaacagcctggcagggatttctgaacgaccctgggatagctaagagcccacgtgaatgcatacaactaaacaattaaattctttcatgtcttatattttacaatgtcttcaagtaacttttacccttgtctctgaaataatggaaacaactggtagacggtggcttgtctacttttacagcctacatataagcaatacgcatcggatagaatggtgggaatctgtgtgtgtacgcctggatgagggcaggatggaatcccacaacatcttggctttgggtcaccctgcaccccagcctagatctcaccttggtgtgccaatcaactgcctcaggtctctcagatctactctctctccttctcttgttttgctctgtatcagaaagagctacacttcccagacgccctcgccctctgcttctgggtggtcagtcaacaggcagcatcggcgggagggaagccagggatttctacccctctctctgcctctcgagctgtctcctgtagaggctccgtctcctgtagaggctccatctcctgtctctaacccacggtctctgctcctgactctgagatcatcatcacccccactgtcccttcagccttagaggtgatgccaggttcacaatgcagccatctggcttcttagttcttccaccctgtgtgtcacaatcccctgtattaatgtccctccatttgaaataccttggctggctcctgctttttgactgaagtctgaccggtagactgaaggaaaaggatgaagccaactccaaattgatgacacatttctatcactctttcaaaatgcgtgtcttaaaagtgaattaagcactttgggaggccaaggagggtggatcacaaggtcaggagatcgagaccatcctggccaacatggtgaaaccccgtctctactaaaatacaaaaaattagccaggcatggtggcaggcacctgtagttccagctattcgggaggctgaggcaagagaatcgcttgaacccgggaggcggaggttgcagtgagccgagactgcaccactgcactccagcctgggtgacagagcgagactctgtctcaaaaaaaaaaaaaaaaaaagataaaaaagaaaagtgaattaagtaatgttgagggggttgttctgtttctttcacttgagttgttgcaactggactcaaacctgcttcacagacttactgtgacaattctaagttaaaaaaaaaactcacggaaatgttgattttgctgaccacctacaaagcagaaaataaatctgtccaggaaaatgtacaatctgataatgtttttgtttacttatctacaatttagcttggattttttactatcccttagtttgcttgaaattttcctattaaaaaataaatggttttgatgcttcttcccaactaggaaagcttgttctggtcccagctgtcagacaatcccgggctgatagctactttaatgaatcagcagcagaagtataaatcggggtacagggagatgggggtgaagatagaggtgcttggtttacctcaagagttataacatcacggggcaaaggcaggttcggtaagttccagctgccatttctctccaagggccaggaaacaacatcttaagataaaagtcactggccataaacaaccttattcaaggaaaataatctcgtctgcagggcacctgtggtgtgaaggctgagacctgtgagttcagcaacagaatcggccaagtgggggctgcagtaaacccctcggcttaccggccagtccacaggactaaaagagaggccaaatgccaactcaccccggaactcagccacaccataaaagagggagatgtggtcagagttcagtgggagggtggggagcgaagtgggaagcggtctacacagcagctcccgagccccctgtgtgtagcaacaatcaaaacccacgttagtgtttatcacagatcaccacctacaaatggtgggaaaatggtgttcttattccggtatgcacattgctggcacagttttcccagagaacctgcctgagacccagcccagctccagacatcagcctccacatgctcacctaaacacatctgaggattactaagttctagaagtactgttatgctaagtactgaacacacatcacccatttaatcggcacaacaacgcttgaagcaggtgatatttttattcccatttacagagaaggaaaccaaggcccagagcggttaagcaacgtgttcaagtttgcccagctaggccaggctcaagccaggatttgcacctagcgagcccagctcactctccctccactgtctctgctctctgctgtctaagaggcctcctccaggacctctctcatatttgcgggatgtgctgatgtttgctgggactctcttcaaggcagtacacatgagaaccttttctgcagtgccctgaagtcactccgcctccttccttccagagttctcaggccaccacgcacactgttcgtgcctctgtcacagagccatctgcacttctggggggcaatcgcactttccttctcacaacttccacaagcagctaggagtctctcggttcctgggagtgcaaggggcccaaggattcccaaagggagtctgaaaacctcgggtttcgcccagagacagaatcccaccacaccctgacaccgggcttccgcctccccgcgcagagaccttcccagggcacgtgctgtcattcatgggaaggcttcacatctgaaaagtactcaggattatgcgccacggccaaaactgcctgtctgaaacgctctgcctgtggcaggatttatttttaaagcagcgatatttatagctgactgtcgacattcacgccagcacttaagctgcctacaaatgtcagggtgccgctatcccagggaaaagctcggatgtgacacggaacgaacgaacctgaagcaaactgaattatctcctcaacgtcagatcaaacgtggacttgtcctgtgcttggatgctgccttgcctgagcgaagaaattaaggaaaaaccaatttccccaaataggagctaacggtgacactttgaatgtcacattagtgggatctgctacgcgtggtagaaataatgaagcatttatgtacacacgatttgctttcacccagcacctggcagaaggaatgcaagcactcacagaacccacgtcttcaaaagcaagaaagacaaggtctttaaagctgtttgttttcatggcatcacgactgtctgtcctagtcacagaagtcacactcattaagaatgagaatgtgtgtgaaaaacattcatgtgaattcagtgaggtctatttcagcccaagtattttagtttctcaaactgggaaaaaaaatggatccttaggagttcctttgggggaaaaaaaaagagagagagagagagaaagattttcctgagtgttgattggtctttgatcctaaagcctccttccttctcctctggccctgatgaatcctagagatgcaggggtggcaacattcatccatgctgctttgggagggttatttttctcacacacagtttctgtcctgccccagtggctcccggctgtgagcccgggattttggccagccaagtagaggggatcttatcagctggacctgtgttcaatgccatttccaacacgtacaggctgtgtgccctggggtgagttaggtacctctctgaacctcaggttccacgtttattgaatggcaacaaaaaataccgtccttcctaggttgtcgcaagaatgagattaaatgttagattcaaagggatctgcacagaaccaggtgcggcagctcacgcctgtaatcccagcactttgggaggccgaggcgggtggattgcttgagtccagaagtttgagaccagcctaggcaatatggcaaaaccccatatctgctaaaaatacaaaaaattagccaaatgtggtggcaaacacctgtagtcccagctattcaggggactggggctcaggcaggaggatggcttgggcgcaggaggcggaggctgcagtgagcctagataacgcactgcactccagcctgggtgagagagtgagatcgtagctcaaaaaaccaaaacaaaacaaaaaaacaaagtgacctgcacaggaattaagtttcatgtaaatatcactaagttttatttaggtctgccactcgatttggcttctgttagttccctcccattttcattatttgatctcccctttcctgccttctttttgttttttgttgtttctttttgttcgttttgttttgtttttgagatggaatctcgctctgtcacccaggctggagtgcagtggcacgatctcggctcactgcaacctccgcctcccgggttcaagcacttctctgcctcagcctcctgagtagctgggattataggcacctgccgccacgctcggctaatttttgtatttttagtagagacagggtttcaccatgttggtcaggctcgtctcaaactcttgacctcgtgatctgcctgcctcagcctctcaaagtgtcggaattacaggcacaagcctctaagcatgcatacgtggcttgtataaaagagatgcagtttcatcacagaagctattttcgccgcgatgtgaactccagtgttcttttctgctatctccgctcaaacagggagtgtgatgtgcccccttcctttcctggggagatggtagggaggtggggtgagtgtggacactttcttcgtcttcttgctctccgactcgccagggtcccagtgctgctgagttactgggcagccagcacccccacctccggaagcctccactgcccgctctgatattcatgaaacctttggtcagctagagcctgacagagcagtggtgtcaggggtaggtgggacagacgctgcctgagggggacagcacgtccaggtagcagctaacgtaggcagggtcagttcatctgttacacgacgacattttatttcctccccaactgcccggagttgatcaagaatgctgggataatgaggccacccacttttcactgacgcctcccgcgatgccttctgatgagtgcgggggtgaagaacgagaaacaccagacacgggcactccgtggggagtcaggaggtgaagggcacctctctcggggccttcaggagaggctcccctggacactaactttgagatggagagattcaggtagaggaggggcccttagcacagaggtgggtccccaggctcaccccagtgactgggaatgaggtctcagagtgggaagtaaactggagggacgtgtctgtgttggaggaagaaggtgtagttgggacaatcacatgtaggtcagcatttctcagaattcatgcttcaaccacaccccatgtatcatccccccatggtcttgggtatggccagggttagccatgcccggggatggtggtgcaggtacggccagggttagccatgcccggggacggtggtgcaggtacggccagggttagccatgcccggggacggtggtgcaggtacggccagggttagccatgcccggggacggtggtgcaggtacggccagggttagccatgcccggggacggtggtgcaggtacggccagggttagccatgcccggggatggtggtgcaaggttggtgttcttcagagtaacacagctggtgggagtcttcatcatggggctggaagaatccgcgctggcgtannnaatccccca

SEQ ID NO: 893 - DNA, 9522 bp, Homo sapiens
ctttccttgcgggcccatggtgaagactgtgaaaatactagaaaacaatattttagaaatctatatttcaaaggattacttatctttttcagaggaaattaagtctgtaaaccatacacttcctatttttaataagcagtggacctacaatgaaaaataatataaattttaatattttctggatttccaaaatttaaaaaatgtccttcatgattaaaaaacaaaattatgtggcttcaaatatatacttaattaggtttgatttttatcctttataacttttggtctttgcatttatctagttgttgacctgtcagacagaaggcctgtagcttcactcttctaaaaccgaagcaccacgttcaagaggattctgttcttaggaatcaactctgaatatctcctctgtattctcccattttttgttattttggctactgagcctacaaagtgaggaaagtccagcgtgttttctttgtgtccagggaggaaaaataaaaacattagtaactctattgacaaagctttgccccttaaaaaggggagctcttttcttcaggtttccctgcaataaaaaaaatcaaaagctgtcaactctgtttaatagatgattccctttatctccatagaaattacaacggacagtagcagtgagggcagtcggtctgggccaggtagtgagggaaacctctctcctgtagaagacggtgcttattcttatggcaccagtggatttgggagcccacccaggcgtccaggcatgagccctgatctcccacacgatatgcacacccttcctcctaacaaagaccccttgggccagcacacttcctcagcaggatgggaggcagtgcccactccccccagggtcagacagacagctgtaggtaagtgcttctttcagtctcgcctgccatcaccaaggacaagggacccccaactgcccagtccagtctgcagtgaagccaagtttccatggacacattccagggaggctgctactctttccctgtcgaggtttggtgctcataacacatccagtgcatcctctctggaagaacatacggtggagtcaccgcatacgctgattttattcacatacgttcaactccaagtgctccacccacctctaccccacacctgtcttccccccaaaacaacgtgacattgtgggcagttctctggaaggagccttcgttgggggactggcctcaggcagctctgtgttggggtgtctgcctaaatgcctcccgtggtgtggccagttgcatggtccatgtgagtttggacttgaagacacaaagatgttttcacagatcatggtccttgagtataagccacctactgagaaaatgcactcttacgtaggctataggagggacctgaaagattttcaaggggtatgttgaccacacccaactctctctagaatctgaccttagcccctgacccctctgcacgttttgatgccacaaacttgccacataaactcagctgggaagtgctgagaacttgcttggaaaatggtgtagccagaggttctcctccactggcatttttccgtacctggaactgcattcactagatcacactgacatggtcattaagttcctccagcagatctccagcagaatggaaagcaggcgtccttctcatgcagccacagctgttctccaccatcatccctgggtgtgagcaggggctgcacagctgtgcctgttgtagaggccatggagcgcttcacattctattgaactcagataccacttgaaactagaaaaaagtcaggttttttcatggactatcaacaaaatcataacagcctggagaaattaatgaaggctgctgtggaaaaggtttgttccctggcagaaattactgacattttagattaggcattcaaaaaagactctgaatctcaataatgtaaacaattcattgcattttaaaattcaacctttcctgcagccaaagtgcttttgttagactgcgtgttttattttttctggtgaaagaggccaaacggtttggttctttctccaccacctgtcctgtctcttctgcatacctgtgtcatctcgtcccaccacctgtgttcctcgtgctgggacagaagctcacactgggctgcttctcccaatgctgctctctctgctgccagctggcgtgtttctcacttgcttccctgatggtgttgtgagaccacctcccatgatcagaccaatattatctgtcagttccctctcccctcccattctctctccatacatatatacacatatgtacacatctatctaatgatgtttagtgatccacatgtatatatatgcatatgtattaggatttccaaaataattgttttgatttcttaaaataaactttcaacttttattttggattcactgggggacatgtgcaggtcttgttacatgggtatagtgcagaatgctgatgtttgggttacaaatgatgccatcatccaggtagtgagcatagcgcccgttcaggagtttttcggcctttgccccccctcctccttcacattttagtgttcccaagtttctgtgttccccatcttcgtgtctatgtggaacccaatgtttagctcccacttataagtgagagtatgaggtatctggtgttctgttcttgtgttaattttcttgggatgatggcctccagtggctgcagaggacgtgattttgttcatttctctggctgcatagcattccatgtggtatacgcaccacatctttattcaatccactgttgatgagcatctaggttgattccatgtccctgctattgtgaacagtgctgcgatcaccatattgagtgcctgtgtctttttggtgaaacgacttcttttcctttgggtatatacccagtaatggcactggtgtgtcaaatggtagttctaagttctccaagaaatctccaaactgctttccacagtggctgaactaatttccgttccctccaatggtatatacatttttaagtgtttcttttctttgcagtcaccccaacgtctattttttgactttttaatcgtcattctgactggtgtgagatggtatctcattgtgattttgtcttggatttctctaatgattagtgatgtggagcatttttatttatttttatacattttttaaatatattttttatttatattttattatctgcttgtatgtgatcttttgagaagtctattcatgtcctttgctctttttaatggagtcattttttgcttgttgatttaagttccttgcagattccggacactagacctttgtcagatgcacaatttgcaaatattttctcccattctgtagggtgttgttcactctgttgatagtttcttttgctgtgcagaagttctttaattaggtcatgcatgttaatttttgtttgtgtggcaattgtttttgtggtcttagtcataattctttgccaaggctgatgtccagaatggtatttcctaggttttcttgcagtatttgtgtaatttgaggtcttacgttcaaatctttgatccaccttgagttaatgtttgtatatggtaaaaggtaggagtccagtttcaatcttctgcatgtgactagccagttatcccagcagcatttattgaatggggagtcctttccccactgcttatttttctcagctttgtcaaatatcagagggttgtaggcatgtggttttatttctggttctctattctgttccattagtctgtgtgtctgtttttgtaccagtgccatgctattatagtgactgtagccttatagtatagtttgaagtcaggtaatgtgatgcctccggatttgttccttttgcttaagaccacttcggctatttgggctcttttttggttccatatgaattttagagtagtttttcctaattctatataaaatgacaatggaagtttgatagaaatagcattgaatctgtaggttgcattgggcaatatggctactttaatgatattctaacccatgagcatggaatattttagcattcatgtgatctatgacttctctcagcagtgttctgtcgttctccttgtagagatctttcacctccttggttaggtacattctgtgtgtcttggttagatgtattctgtatattttgtgtgtgtgtgtgtgtgtggctattgtcaatgggattgcattcatgatttggctctcagcttgaacaatttattggtgtatagaaatgctactgatttttatacattgattttgtatcctgaaattttattgaaattgtctattggtttaggagccttttagcagagtcttcagggttttctaggtttagaatcatatcatcagtgaagagagataatttgacttcttatttcctatatggatgccttatcatcagtgaagagagataatttgacttcttatttcctatatggatgccttgtcatcagtgaagagagagaatttgacttcttggttcctatatggatgccgtatcatcagtgaagagagataatttgacttcttatttcctatatggatgccttttatttctttctcttgcctgactgctctggctatagcactccagtgttgaacaggaatggtgagagcaggcatccttgccttgctccagttcttaaggtgaaggcttccagcctttgcctgttcaatatgatattggctgtgggtttgtcacagatgcctcttactatttttgaggtacatctttcaatgcctagattgttgagggtttttttaatcatgaagggatgttggattttattgcaagctttttctgcactattgagataatcatatggtttttgttttagttctgtttctgtggtgaatcatatttattgatttgcatatgttgaaccaatcttgcatctgagggataaagcctacttgatcatggtgaattgtctttttgatgtgctgctggattcagtttgctagtattttattgaggatttttgcatctgtgttcatcagggatattagcctgtagttttctctttttgttgtgtctgtcagatttgggtatcagggtgatgttggcttcatagaatgagttagggtggagtcctttctcctcaattttttggaatagtttcagtagaattggtaccagctcttctttgtatgttggtagaattcagcagtgaattcatttcatcaatattggtctattcagggtttcgatttcttcctgattcaatcctgggaggttgtgtgtgtctaggaatgtatccatttcctctagtccaaaagaaccacttttggaagctgggtggtatatggagttgaaacccaattcaccaggaaattattaattcactgtaataaggatgcatttgttgccagttacatatttacgtaagtgaacagttggtcacctctatggactttgactaacatacaaacattttaaacgtgggctgtgcttagctttccattttgcagagtgtgtgggtcctgggaaggctccccagcatgggccatcctgcccctggcacggccgcagcccctgccccagcctgtgctctctgaggaggcccccgaggcccagccctgtctcaatgctttcacatgcagtgtggccaggtacagagtgtggctgtggttatgtgcttctccaattcatctgacctagacctcccgatctatttccacctacatgttaagacacaaaaaagacaaaagtcaaggaaccgctgccatcctcactgctttccaaagctgcatttcccgtgcacgctcctcagttaggctcactgccgctctgttcttcacccccacttgctcgcagacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtgcgggatggctgcctgcgggcggcttcatcagcccctgaggcgggtctgggtcatgggggcagagactggcaacagggtatcgacttagagatggccttctcctgcaggccatgggcgaggcacgggaggaggtggcatggtgctgtgacggcaagggccctgccctctgcaaagtgccttctccagcatctgcccggtttgtgtgcacacaaacacacccaaatatgtcctgtgaactctggattctattagggcctacgttgttgagaaaaataacacaggctccaaattttaaaacaacacttgtcagtcagcagacaggcagggaagagaggaaggagggagagggaaagggagggaaaaagggaagaagggagcatcagcagctagaggctggagttccatgccttagttctttaatacacctgatggaggttgtttcctatccctttggtacccagttccttttttttttttttttttttttttgagacagagtcttgctctgtcacccaggctggagtacagtggcaccatctcagctcactgcaacctctgtttcccaggttcaagtgattctcctgcctcagcctcccgagtagctgggaacacagatgcgcgccatcacacccagctaaatttttttgcatttttagtagagacagggattcaccatgatagccaggctggtcccaaactcctgatcttaagtgatctgcccgccttggcctcccaaagtgctgggattacaggccgtgagatccagccttctgagaggagaggagccttgtgagtctcaagtagggaaaatgagagaaagtgtgctgttcagtaggagaggggaaagaaagagggccttgaaccctgtttgcagtttcagcaagggtcctgacagttggcatttgagaacggtcggaatgcctgctatgtggcactatcttgttacgtaggaacccatttcaggcagacagaaacaccactttgtgcagcctacctggtccttcttggtagagtggggtctcatcacacacccttttaatgtgcgtgaatttaaataacatgcattcatccaagcaaacaccctgcctgatgagaagaatggcaggttgtccaaacactagatgaaaaactggctcttaagtcagagtcatagagcgagggttacatgtacacatccacagcacacacgtgggtgacctatgcaggtgatttatggtatttttaaactatatttaaaatatattttcgactacactcacttaccgtcagtgggactattgtatttctgaaccaatcaattacagtgcttgatttattttcccccttggctctaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaataggtaagcgcaaacccctattcgaccttccctgtgcattttatcccacaaaacacctgccgctcagagaggcaggcggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagatgatctaatgggcgatgaagtaccgtcttgcttgcaaacaatttatcgcatctagaaaacacatgattagctgctttctggtaatacggtttgaacatcagcctgtctacaataaatttcagtgggtggttggggggccgctatgcctttcattctttaggtgacctttgcttatccaagaggcacaagctcttttctctttagtttgggtagacatgaaactccttcatttatcttaagccagtctgcaagcaccagtgagaatgcagcaaaactattttcagtgattttttaagcaacattacatttatgagttttaaatttttttccacgtgcaataacaatgtcctcattaaaaaaagcctctgtagtctcaaaaaaagcctctgctttttctaaaaagctgtagagagatatcagttttatatcattcatatttaaggtttaatacttcaaaacttgattagcttctaaatcagacttcaaagacaaaattctgtgcttcaaagaatatacataattttaaggataatcacaaaatcaaaacatttcaaccttttttggcattaataaacgcattgtttcaagacagaatccacatctaatagtcgaagtttagtgtgaatatatcgcccacattaaatccatgagatcgaagatctttgagccctttatcccctctactcacttttgttaagatctcctttcccgaagttgactaagactctttcaaagagagcacaggccctgtacaccacagacccagaaagtatacaagaatttctgttaaggaacggtaacttgatttatcagttagattaaaattttttatgctatttttctaaatgtcgatggccaagggaacctagcctgatatatctatgtgccccctgccgcattgccagaaactatcatccttaatggtgaaaggctgaatgtgatcctcctaataccaggcacagacaaggatgtcggccctcaccactccttttccacatcatactggaggtcataaccagggcgacatggtgaggggaagtcacacctggtgtacagactggaaatgaaggaatacaactttttctgttcacagatgacatggaaatctacttagaaaatctcaaggaatctcaaaggataaaaaagttcctagaactaacaaatggagtgtagcaacatcaatggatacaaggtcaatatacaaaaatcagttctatttccatatgtgagcaatgaaaatttagaaattaaaatttttaaaagtagtgccgtttacaatgacacaacaaaacatgaactacttagcattaagtctaacaaaacacgtgcagtatttgtatgccgaaaatcagaaaacactgaggaaagaaatcagatacctaaatacatggacagagagatcatattcatggacttaatattggtatgtcagctgccccaagtgagcctacagatgcagtgcaagaccattcgaaatctgtgctgggatttatgtagaatcaacaagctaattctaaaatgtatatggagaggcaaaggaactagagtagccaaaactatttttaacaagaacaagaagcttggaagattcacataagctaattgcaagcttactactatagaggtatgctaatcgagacaacgtggtattggagaaaggatagaaacatagattaatggggcagaatgaagtccagaaacagaccaacacatatggagtccactgattttggacaaaggtaaaaacgcaagtcttcaccacggggctggaaggagccgcgccat

SEQ ID NO: 894 - DNA, 7595 bp, Homo sapiens
  misc_feature (1)...(7595): n = A,T,C or G
attggcatgttggcccaaccaacttcctttgcagtttcatcagaagaatggaagcccttgggaggtcagagctgtgtttctcccgctgtgtttctactcttctctagaaaagtcatctcttgtagcaggtgtggtcatccagagctgggcgtcagcactggtggccaccagccacgtgtggctgtttacatgtaaactaattagaatgtaaactaatctggaactaattttatagaagtaaaaattcagggcctcagtcacactcagccccaggtggccacatgtcaagggctctggggccacctggggctgtggctgccataagacagcgctgaatgccgatctcaaaaaccagtgggggtatgggtccttcacccagagaacaagtgctccagcctttcctccgggtttgtaatctgagcagattgcagggaaggtgatgattcactcctggataggtgaggagaacgtggcacatggggaaaggcgtggaaacaggtcttcttcaggcctcggttcaatctaattccagctctgttaggagaccatctgcgtaatcatggacaaaaattctcaattctgtgggcctcagtttccctgtatacataaaataagagcttacgtttactgagcacttactacttgccagttgtgttttgcgtgtcatgtaatacacagaaagcctcataaaacctgtgctatcgtggcaggtgttgctggctcgacatttgctatggactaagttgtatttccccaccccaccctattcagaagttgaaaccttaacccccagtgtgactttatttggagatgagctatttaaagaagtgattaagattaaatgacatcatgatggtagggtcctaatccaataggactattttccttataaaaagaggacaagatactagggatgtacagagaaaaggccacgtgaggactcagggagaaggcaccatctgcaggcctcggggaggcctcaggggaaagaaaccagccctgctggtgcctcggccctggacttccagcccccagcactgtgagaaacagacttctgttgtttgagccacctgatctatggtattctgtgacggcagccccagcagacgagtacaacagtcaacagaaatcctatctccagaactcacccagggcccagcaccaagaaaaggaatcatctgtgacccaagagaccaaaacagatacctctttctcaactgagatggcccctaaggttagggaaataaaaggtacctggggccgaggggtcaaggcctggctggcatggctgctctgtaaattcctacgctgcaagaaaacccacactcttgctaaactccagaacaacaggcgctatgggactcctcctaactctcatttacaacccagaccacgcaactccaactgggcagaggaccggccttacacacactcttttctgataagcgactgtagacattaagccggtttcagcttaaagaggcttaagcccattttagcttaggctttgagtcgtggggtttaccttttggtggaaagagccaattccacctcattctaacactaaaacccgccccatgtgcggtgcacacagaggatgctacagatatgtctactcactgcatgtgcgtgtgactcctctcggatggatgcacagcctttccccaacctgaatgcatatggttctgtgtaatgtggaccctgtgaggcataaaaatcaccctgcccttccctcttcagagagagcaccctcagcacatgccagagcctctctcttcctggtctgcaaactgatgtcaccaataaagctctcctttctacctctgagccttcctggtgggctttcggatgacacatcactgataagccattcattggaagccagttcctgcctgggtggtggccatgtgacctcagtctgctcagcgagatgtcatagaaagtctgactggaaggaagtctggcttccgtccatcccttttttccttcttggggtgttctcataggacggtgtgattattggagctatggcagccactttgtaaccacgagagaaaggccaagagaatggacgagacagaactcagacccctgacacactgagagccaaaaatccacctcgcagcctctactgcagactccctgtgatgtggggtaattaaacgactttgttgtcttagccgtgattagttgggcattccgtttctgaacgatttggatcttccagatgaagaacgtcatggccggaggagtcgggggacttgttcacctgtggtctgtaaccagccgggacataaacccaggcctgagagatgccagtccccctctccgggtatggggctgttttgctgtgggagtgggttcagaggatactgtgtgatctgataactgcagcgtcttcgagctcccactatttagcattccccaggccctcggttatttccagtccctcctgttgtccaagttttgttctttacagcatctgagggcatttccattagaatatgcacgatcggaaattagacagaaaccccaaactggctgaatgtcttcctcatgagcccagctctgccgttttgctgttctgaaggacgaacactgactgtgttatttttggctcccatgatgcctccctagcacacagatggccaacaaacatctgcccagttaacggaggtgaatgagcgaatggcaggttctgcctgaactgagcctaaccctacccggacctgcaaaaccacccctatgaccgaataccaggatggtgcagcgggggagggtggaagccctgcacttcgactttttcaattatccccaatgagggtatgtgacaggcattaaatataaacttcagaaacctagcacgacttaggaccccagctgggcgtctccatctctctcagggacccaagggtagcggggaaagtgcccatgtctcttgatctccacggggcccgctccgagcccgcgcccaccaggaggatggtgtggggcccggcccgctctcacctgcttgccaagttcagagcctttcaggaagtcgtccaccgaggcgcccctcctcttgaagtctggagagtcataggcgtcctcctcgtctgaggcggcgtactgccccgcgctgcttctctctaggaagacgctccttttctctaacttggaaagaaaaaggaggcacacgggtgaggcagggccaccttcagctacgctcagccccacctgcattcaccaaaccttcagcccctcagagcctggccaggcaccccccacacagtgctttgggcccagctctgccgccctctcgctgccccagacccaccagaatctttttttttttttgagacagagtctcactctgtcgcccaggctggagtgcagtggcatgatcatagctcactgaaacctctgtctcccaggttcaagcaattctcctgccacagcctcccgagtagctgagactacaagcatgcaccaccatgcctggctaagttttgtatttttagtagagacagagtttcactgttggtcaggctggtctcaaactcctgagctcaggtgatctgcccacctcggcctcccaaactactgggattacaggcatgagccaccgcgtccagcctctttttaacctttgaggtaacatttggatacacagatgactcctcattccctccattggtctcctctgcccagcttttattaataatttgatcaattcacatttgtctgaaacataggacttggaagtatttgctttctctcccgccccaggcttccctgccttcacagccttcttggggacctggagcagaagtggagccgcatcccacagggcagctgctaccccgtcctgcccacggcctccccagaagcaccacctcccaagctcagggcttgggctcctgcctgtgaaccaatcagagccatggtgaattcacatattctgaagggcttcctttatagaaaggccacaaattcatgtttagtatttttattagtggccaatgtcgaacgaattagcaaatttcacagaaaatttccagtttttcaggaggtgctgaggtgctgccggggcagccccactcaggaggacggggtgggggcggaaggtagctccctgcccagtgtcaccatcgtcctttctgtcctcctagacacacctgagctgctcagcattgacctctcacagtgcgtgccccgcctcggtttccctggcccggcccccagcccagaggaacactcacaggaggacagtgtagggtcccggtgagaccccacaggctgacccagcagggccgagggtcctgaccagggctgtgctgccacctcaggtggaaacgggctcaacacaacaggagagatgagagcgggttctgggtggggatgcgggcacacgttctggctcccagccccacatctcttcccctagccctgcacggggggcattgctctgcaggtgatttctcaaaaacgcacgtcccgttgtgtgtatcatccggaacatgccctaccacaatccacatgctctctcctggacccagaaaagttcagttagcaggcatgcaaatatgtatgcaggggtctatatgtccgtatgcgtttctacacataggtacagatgtatgtatatacatgagggtgcatacagatacgtgtatctatgggtgcatgtccatatatgtatagacacatatgtgcatgtgtgtgtatatatttacatgcacacacacacagaacctaggactctgcagccagcaaaaccaggaagagcctggttcaggaaagtgggtcctggccaacttccaccgggcaactctcagaccccttgtcgcacaccaaggccatgtctggattcttctgagcctgctttctaagccaggcaagtgcctggcatttccttagttatgtggctacatattagcaaataaaaaacaccatttaactcagtcaggatcaggcacatgacagagtccaccagcaaagcggtgggctgagcgcggcccccctccctgcaagctgggatgcgggtccccctccatgggctggggagattacagggccccgtcccgtggggtttggggactgaggagccaccgaggcgggagccccagccttaccctgctgctctcggccaccctctgcgcggcctcccgggccatggccttggcgacggtggtggacaccggggtgccctgtggctgtggcaggatgcggctgggtgagggcgaccgccttccggggcccacgggcggctccagcatgtgcccatgcacagggccaggtgcacggctctgctcccaggcctcatccatcctggcgtggggacccaggtgctcgtctttggtttcggggactccagaacttgcttatggctttgattggggtgcaggtctcgggtggggggtaggaggcaccaggagctcggggggaacggcagcaactgcagagtccacggactcgccctgggcggagagggtccgcacggtcacgcccttggcctccaggctccgcagccgcacaagctccacggccgtgctgtctgccgtggggaagatgacttcagccacctgtggacaagcagagctggctcgcgggctgcccgaggtgagcccccgcggtcctgcaatggggagccgaccagtcctctgcccagaggccaggtgcaaaggatcatgcccagcgacctccgactccaaccacccgccaggtatggaagctccaggaagtcttgcggggagggggcggggcaggttcacagacctcaggccccaggacccaatcagtggtagagggttccgtcaggccagtgacgtcaaccatttatctcccatcctctggacccattctgagtagatgcaggggccagagaggggagtgagtgtcaggtttattaccaccacagctggagggaagagaggggctcaggcagaggccaacgtgggcttccgactgctgggagagaacagggctgagggcctcctctgcaggggccagggcccatgctggggacttcccgcctcagagcacaggagtctgcaggaagcggctcaggcagacgcactgcctctgttcccaagtcacccctgctcctgcagggcggagctggggacggtgaggagcagctgctttcccaagccctccctgagggcagatgcttctacttcaccccaggcagggatagggggctggtgtccttggttccccacaccaggcaccagggatatacccatttcttggagtcaaggcctggtcacctgttcacgtgcagacccagcagtatcttaagccggaacgcgccttcggccatgggtatcatcgtgctaagactcagtttgttgaaattaataagccagtcatcaatcaagaatgttctgacactaggggtcccctctctggcccctgcatttttaatccagagcagagcagggcaggggatgagtgaggggagcgagatggggggagtgctggaagtgaggaaggggtcctggggttcacgctgatggagtcttcggggttgagggtgcctccagtgatcagggctggaagagcagaccctgcctcctccactgagcaaataccgggccggtccctgctgcgttagggcctaacaaaccctccccacccacccaacgaaaactcaccctctgccctttggcatacacgccgtagccggtaacgtttgcgccattggacagcccggtgggcgtcagcacaggtggtctccaggagacccggatggtggcgggggtcaccccagcctggacggtaacatcttgtgggggtgctgggggtcctgggaggggacagaagggaacggaggcgttcagggaccagccctggcaggtgagccgtgactgggctctgcccatctcacctggaaacgagatcattcggtaaagtcgccagggaaaaagagaagacagtgttgaaagcacatcagaaactgtggtgaggtgggagggtggggccggggtacagtcaggtaccaggatgcacagctgcccttttcctttaaattcggcatttagtcaccatcttctgggaaatgcaaacctaaactgtctgtggaaccacctccttacctgtcctcagtctctgtgacccggcagagctacctctgtccaggggtctcaggcctggccaggcagccacacgattagctcagagaggggccaacgagacgccggcgtttggcagatcgaatggaagagagatcttggcagaaggcaatcccctcatccccccgcccgcccctcatcctctcaccttttcttctctcttttctctccctctaccctctgcccggaccgcatattccccatcttaccaccccatgaaactgagcaaaactgaaagatgaagagaccaggtctgatgacatcgttgaacctgagaatccatttctgcgtgtgtgtgtatatgtgtgtatgtgtgtgtaaatgtgtatgtatgggtgtatgtgtgtaatgtgtgcatatatgtgtatatgtggatgtgtttgtgtgtagatgtatatgtatgtatgtatatgtacatgtgtatgcggtcttcaccaggggctcaagagcccgcatnnnnnnnccccttnnntcccc

SEQ ID NO: 895 - DNA, 9158 bp, Homo sapiens
  misc_feature (1)...(9158): n = A,T,C or G
gcctggccgtcgacatttaggtgacactatagaaggatccgcggaattccaagaactgtagaactgtatgtattacccccgtcccaataagactgcataacaaaccgtcccgaagcctggggcttgaagcggtcacagtccatcattgctcccaaacctctgattggctgcatggagcttctcagcttgaccggactggactgaacagctcctccggtccagccggggcttcatgcacctgggtggccactggagggtcttggttggttgggctggggtgactgccttgctccttgctctcccctcctccatcaggcaagacagggcttctggccagggtacagttgggccgtgaatgaggcagaggcatggaagacctcataaggcccaggcttgaatggggcaaggcacttctcgaattccgttggccaaagcaaggctcagagtctgcctggtttgaggggatggggaagctgactctgtctccagctatgaggagccaagaaattacgtcagcaagaatgtagatgtggtgcggggcagggagcccccaaatcagggcttaggatgggagggttcttggctttgcccagggaagaattcaagggcaagctggtggggttagctgcttttactgaagtgtctgtgcatagcagcagcagaggtcctgctccttgcagagcaaggctacctcacaggctgtgcgcctagagttgtggctcaaaggcagctccgaagtcgtatttaaaccaggttttaattacatgcaaattaaggggcaggttatgcagaaaattattggaaaatggtggtaacttctggatggctgggtcactgacatggaaaggggcgataacttctggacgttgccatggcaatggtaaactgacatggcactgcggtgcgtctcatgggaaggtgcttctacctgggacctaatttagctagtgctgtgtggtccagagtccaacccccatctcttaccctcctacctcagatgcagggagtgactgtggcatagttttcaatcagtttatgtcagatgccactggaattgagagaggaggtgcatctggctttggtttgtagagggtcactccagtggccgcacagaaaaaaaacaggagtggaagcagggaccccactgggagccatgtcctgatgcgagatgatgggggcttccagcaaggcagggtggggagaagtgcacaggctcggggtgtgtcttcaaggtggaatcaacagggtttgctgatagactggacgtggagtgtgagaggcaggaaggagtcaggacgttaatttctggggcagcaatggtgtcatctgctgtgacagggaagcctggggatgtgcggttcagggtcagggcgtcaccacgtgtgggagatggagtgtgtcgtgacccctggatgctcgggtgggagagctccgggttcccactctacggacctccctgctgatcctcaagaaacccatgttgttccattattagatgacgcgtgtggtagagtgatagaagcggctcacttgggttaaagcatgaagctcaggcagccatcaccacggcctttgttcccaaatcctgtggccaccgttctcatctagcacctgacgcgtcttgtgtcttccatgtcctaaagtgactgaggggtaagaggggacatgcggcctgtgaattaagactgcccgtcctgtgttaacgggggtagttacagctgtggagctgtgccaatgtgcattcagggcctgtctgaactgaaaattagcccactggtcacattcatatgctggcttttttgtttccaaatatcactgatgtgccgcctgtcttaatagtgatcattcaatttagctaaagacaacgtgccctgcttccctgcagcctgtgattggttatgcacagcaacacatggcttatttatttattttttgttgttggttttttctttgagaaggagtctcgctcagtcacccaggctggagtgcagtggcgtgatctgggctcactgcaacctccgcctgccaggttcaagcgatactcctgcctcagcttcctgagtagctgggattacaggggcctgccaccacgcccagctaatttttgtatttttagtagagatggggtttccccgtgttggtcaggctggtctcgaactcctgaccttgtgatctgcctgtcttagcctcccaaagtgctgggattacaagtatgagccactgcatccagcccacatggttctttacagagccctttttgaccgtattatgggggctgccaagtaattttcacttgaagagtcagaagagtatgtccagatatacagattttaaagggaaatggatttgtttacctcaggcactggcttcctgaagaatttcaaagcctacagtccttgccctgattaaaacctatataacaaacttgcacatgtgcccctgaacctaaaataaaagttaaaaataaagaaatctaattgaacccacacctaaagatatattcattcaaaaatattgagcaaccactttgcatcaaacgctttctagtttctggaaaaagtgatctaaatccatgcccttggttctggtagagagttgataaattaatgtgcaggtcaggtggggaagtgaaaagaggcgaagagtgatagtcatggaagagctggtttacatttagtggttggggagacctcactgtgggtgagtcctttgaaaagagacctggatgaagccagggagggagctgtgcagaggtgcaaaggtcctggggcagagggtgaatgcctgctgtgtctgagaagtgtgtggaagcccgaggtgcaggagtagaatgaacacggggaaatagttagaagatgaggtcagatgagggagatgacttggagcagatcacttaaagcttttgaaggccaagataaggactttggctctttccttcctgagcgagatgggaagccattagagggttttcaacagtagaatgatgtgatctaacctgaatttttaaggaattatatctgcaactctgtagagacgtagtacgcaagaggagatgcagggagaccgcacagaggtatacaagttagctattgctgtatcacaaagcaccctgatatggtttggctctatgtccccacccaaatctcatgttgaattgtagttctcaatgttggggaagagacctggtgggagatgattggatcatgggggcagatttctcccttgctgttgtgatggtgagtgagttctcacaagatctgttggtttaaaagtgtgtagcccctcctgcttcatgctctttcctgttgccatgtgaagatgtgcctgcgtttcctttgccttccactgtaattgtaagtttcctgaggtttccccagccatgcctcctgtacagcttgaggaactgtgagtcagttaaacctcttttcttcacaaattactcagttttaggtatgtctttatagcagtgtgagaatggactaatgcaaccccaaaattgagtggctgagattagtgatttgtgttgatgtctcatggctgtgtgggttgactgggcagctacatggttctcacgtggggcctccacttgggtagttacgctcagatggcaactgaagttgcaatcatctgcagccttggctggctctttgcctgcatgttgtcctctcctgggatggctggaagagagggggcaggccagacatttctctcctcatgtggcctctccacaggctagctcggatttcctgcactgagtgttttttttttttttttttgaatgctgtttccctcagcactttgtatttctgattcctggcttattgggtctcagtttcatgttgctttcgtggccacctggtctaaaggaccagaggcccccttgctggtcacttgcacatcactgggttccatttcttcagcgcactcatcttgtctgctttaactgtctgcctgtgtatttgtcttccctaccaaaatgtaacatcctcaagacagcctttgttctagtgcccagcacaaaatctggcatatagtagacactcgataaatactgattgattgatgaattagtaacggagcaagtgcacgcatgaatgagtgaggggttgacagattgcctcgctgaaccgaccggcactgcagacacttgctgccttcatggagaatgactaagcagccagaggcctggagtcagtgctgccttcatggagaatgactgggcagccggaggcctggagtcagtgctgccttcatggagaatgacggggcagccggaggcctggagtcagtgctgccttcatggagaatgaccgagcagcaggaggcctggagtcagggtgcttctctgcagaggtgcttctctggggctcacaggtgactgtataaagtcacatctacagatcaatctgcagttcctttctggaatagacagagactctccaaggggaataaacacaggagagttggtgatttccggcatctcctcagcccaggctggtgtcagacaaggatctccccaccgcgcactccttgttgcatttaacccagagtcagtcctcctcttaggtcctggcacaggagtctgatcaaaacacccagcactcctctgaagcagggtgcctgtcagaagtgagtgcattgtgataaaataaacaaaatgctttttattctccagcttctcagattcaaataaaaaacgcattgggcttttttactcactgcaaaaaaacaaaacaaaaaaagcctcatgtgtttttcatgtgagtttctactgcctgatacacaagacattctgggtcctcagcctctccccagctcctgggtaaagggactgcaaccggtggtgcttcgctcacagccacggccagaacgcatctctccagccccttctcccatggcccgtgagacagttctgttcgtcggatgcggtagagcgacagctgcttttattttagagtcctggcagggaaggacggtttaacttcacactcacaaggtttctagattcagagagctcaatctagaagcagttagaggcagggactggtggacccaccagaggctgtgagcagaatcagtgattacggagcccagggagcagaaggcaggtgagaagcttctggacagaggggtagattcaatcagcctccccacagtcatgtccacccagaactggggcgcggggcctaatttggaaatagtgtgtttggagatgtaactaggtgaaggtgcggtcgcacatcagggagggccctcgttcagtgacaggctttggaaagaaaggagaggggagtttggatagagacacagacgctcagggaggaagccacgtgtggatggaggcagagatcagagccatggagcgcccaggagcctggcaagatggggaagagcctgccctggagctttcggagggtacatggccctgtccacacctcgactgaagacttccggcctccagggcatgagaggatgggttgctgttgttttaagcccccagtgtatacacatcccagtctctctgtactctgctcagtgacatcggggcagtcatggtctgatggcctgggcagaacaacttgagggtcccactcctcagggagaggacagcagtcccagtgtgcaaaaaagtgtgcgggccttcttggcttctttgggtggccttgcagtttaaagaaggtgtgccttgaaggaggccatcacagggcaggaaaccctcatgtggtcctttttgggggagcgggcctgccccagcgccatagctgctgggggccggacatagaagggggctcagggtgatgggaacgtggcctttcatgaggtatcactgtgtgctggtctcccgtggacagaagcatccctcctgcaggaagtggatggagcctcacccctngcagcctcctctaccccagagctgctcagcagggctgctgagaccggagtgaggacagtgagatggtggtttagtcctttttcatgctgctaataaagacatactcgagactgggtaatttatacaggaaagaggtttaatggactcaccattctatgtggctggggaggcctcacaatcatggtggtaggtgaaagtcatgtgtcacgtgggagcaggcaagagaagagaagggaatgagaatcaagagaaaggggtttccactgataaaaccttcagatcttgtgagatttattaactaccacagaacagtgtgggggacaccgcccccatgatccaattatctcccaccaggtccctcccacaagacatgggaattactggagttactattcaagatgagatttgggtggggcacagccaaaccgtatcacatggctacaggcacggacgtactctctgccgtggtccacaatgctttacagtttaggtccaatgagtcagcggcagaatcatcacccaccctagggggacgttcccgttgatctcagtagcatgacctaattcaaagactttgggcttttagttagaccagtctgagttcaaatttgaatttgatgattaactagttgtttacgtgtgatcaagctaactaatttctgagaaccggggtgttctctcatctttaaagtggccataaagtacctttctagatgtaagggttcaaagcatagaatgtgcccagtgatctaacatagtggctggtgctggagaggttagtgatcaagaattgctaataccgtgagcaatttcattgatatacaccctcaaaggaatctactagaatagacagaaggatagccaggtaccatgccagatgcttggagtaaaacgaggagcaagtccaaggttatttttgttttcatgaaacttaccttctactggggtgggaggagctcagaaaaaaaatcaggtcatccagcaaatagataagaatttcagagacggaggaagacggtgatgagccagggtgacctggagggagaggggagcgcagggcaccctgcacatgtctgttagggggtgacacttcagctgaggcccacgtgatgacagtggcctgaccaagcaacatccctggggaaatctcacaggggcaagaggagacaacgggcagcactgaggcgggagccactagggcatgtaccagcgtggctgatggcttggtctggggcaggtgtccagaggcatgaatccaggcagatggggagcaagtgaagcagcccccctcatcatttcagggcatgtagagggccagctgtgttcccccaaatgacgcccaagtcctaaatctatgtatctgtgaatatgaccttatttgaaaatgagtctgtccagatgtcattaatataaggtcatcttggagtagggcaggccctaaacccaaggactgttgtccttataagaagaagaggcacagagacacccaaggggatgggagtgaggtgtcttctggtcaaagatcaccaagcatcgtggccacgccagcagctggagcggggcatggggcggcttctccctcagaggttccacgagaggatccggccctgccgacacctggatttcagccttctgtgctccagggctgtgagaggacactttccattgtcttaagcagaagtgccagttgtggtactttgtgacccagcggtcacaaatgcatccttttcccacataaggccaagtgctctggacagcagggaagagggtgtgtcctgagtaaccagcacacagggctggagtgcagggtcctggaggcctccgtgggttacctgactcctactttgctctttcttttcttttctttctttttttttttttgagacagggtttcactctgttgcccaggctggagtgcagtggggcaatctcagttcactgcaaactctgcctcctgggttcaagcgattctccctcttcagcttcctgagtagctgggattacaggtgcctgccaccatgcctggctaatttttgtattttgagtagagacggggtttcagcatgttggccaggctggtctcgaactcttgacctcgggtgatctgcctgccttggcctcctaaagtgctgggattacaggtatgagccactgtgctttgcatctttcaaagcacgtttgcatccaccatcttaccgtgagactgtggaggcgggggcagagcagtgcagggagaaccgtggtggcggggaggtgccaacttctaggcctgatgcttgctggggtgtggagtgggctccaggagggccagggcggggtctgtccttctgaaccgctctgtccctgtccccagcgcagtgatacagaatgagcgctctgtcccagagtgtgggatgtactcacaaggggctgagtcatctccgtgagcctcagtttacccatgcatcacaagcttgcatttttatatcctcacccgatcaacgcttgtctttcccactgggatgtcagccccacacaagccagggcctctcagctttgtgtccactgtgtctccagtgcctgtcgggccacctggacgtagttggtgctcaggaaacactggacagaggagagaaacagaaagggcggatatccgggtaaatgtaacaggctagaccaggctgtttttctcctggtagactctttcatgtacataaatgacacttcaacgaaaatgtagaacactgtgatggggtttcaggtatatagatggagcatgtaagaattccacttggaatggcaagttttaattctgagtagattgtttaaatttaaatatgtatattgagttccctggggcaaccactaggagtgacataaaaacatacagaacagcactccatggagacattaaaattgaaaaccaagctgggcatggtggctcccggctggaatcccagcacttttggaggttgaggcatgcttatcaccctgagttaggaatttgtaaccatcgtggctcacatgctggaaacccgctattttctcaaaatatcacatttagaccagcggttgtgtgtacgcctctaatcgcacctcacgcggaactataacttaagaatttccttgaattaagaagcgcttgatgtgtgcgggcctgatttattgagtctgagcttgattgtgaccaaacatgggtgctgtttctcatttatcttagtggtgaataagagtatagactgtctgttcgaattagagacgcttcacgacggatatataaaatact

SEQ ID NO: 896 - DNA, 8959 bp, Homo sapiens
ttttccgtcctttcgccccgggtgaatacacattaactttcatttccaaaatattaaaaaatgcgtggtcttttaatctgaaacacaactatttcaaaaaagataaaaacactcctgactttctctgagaccttcacggcatcacatgtcattttaagaaacgtctgggataaacacttattgtgtggggccttttagcattggccaaagatgactcagaagcccgttagtagaaataaggaatgacctcttggtgcttgtccttttcctacgcaccagataaaatcaagccccagatgtggccagtggctttcagaatccctcctttctataatgatacaaaatgctaaaatacaagaataatgggtgtgtaatatgtatgtgcaagcacacgaaacaggatccaagatcttccaaatatcctgaaaagttcaatctttaaatctgtaatgtattatgcacttagcccttaatacaacagtccctgatttcaaatcactcacagatctgataaagaggactagttaacgtaactgattagaatggctctcttgcgatggtacacattttattgactcataatggcactgacggaaatgtctgtaggagagcagaggaagacaaaaaccaatatgggtttcaaaggaaaacaagtgcagcatctggataccatcctcggctgtccacattccttaaaaggacaaagtagaggctgggagttgtggctcatgcctgtcatcccagcactttaggaggccaagatgggtggatcacctgaggatgggagtttgagaccagcttggcaaacgtggtgaaaccccgtctctactaaaaatacataaattagccaggtgtggtggtgcacgcctgtaatcccagctactcaggaggctggggcaggagaatcacttgaacctgggaggcggaggttgcagtgagccgagattgtgccactgcactgcagcctgggcaacagagcgagactccatctcaaaaaaaaaaaaaaaaaaaaaaagggagaaagtagaactacccctgccccatgagactagatgctcgccaaatcaccttactgatcaaacactagtcaagtccacaaggaaatgaaacaagtattcagtaagctaagactgtcaggaacacttatttcaataatgaatcctgtggacgcctttggatgtacagaattatcagatacttgcactccaaggccttaggtaagaaagaaagctgatcaatgattggtaatggtgtcttactgtcccattctgtgaaggaatgaccctctatactacccctcaacacagccttcttgtgaaaaatttccaatagaaacttccctctgcccttcccatcacctcaaaggccctacagtccctatcaagttaggttctccctcatcctttcatcttgtgatgctaatttcaaagatacaaaggtgcagttttataaaaagaaaatgctttacaatttgcatgcttacttgtaacctctaccaatggattttagacaatccaaaaactgtggcacttcgtagttcaccagtgttttcagctggccgtctcctacgccatcgcggtacacgatgatccggctgggcatgtactcattgcagctattccaagccctcagagccgctgaaacaggccagagaagttttatgtcaattcatgcctacgacacaactcgtctgttcttcccaaagtctgggcccatcaataacacagttcagggtaatttctggaagaccccagtttagagagtagaatggcaaccccacaggtgactaaccttgcaggcagactttgagcccatctaccagctcctgtcctctatcctgaaatatgcagcgtgagaaccagctattcagagaaaaacacagctagaataagaatgcaattgtctatcaatttttcctttctgaattattctatatttatttcactcttagcaatctgtcatctttgtaactgccttaaagacatctgttaacatctccaaatactttataaaaaccttacacagaaggagcaggatacaagagatcccgtatcagcatcacaaactgtgtctgttttcattacaaatcagtaccatgattccagctgctggggagaaaacagaatttagctataatacccagaggcgctgtccaggtttattacacctaaatacgcacagaagcacactcatggctgtgctcttgagaaactattcattgtaagtttcactcttctaaaagatgaaagaccttcagctccatccgttacctctagcaaactaatgcaggaacagaaaaccaaataccacctgttttcacttataagcggcagctaaatgatgagaactcatggacgcaaagaagacaacagacaccagggcctacttgggggtggaaggtgggaggagggagaagagcagaaaaaataactactgggtactaggcttagtacctgagtgatgaaataatctgaaccacaaaccccatgacacgagtttacctatgtaacaaacctgcacatgcactcctgaaactaaaagttaaaaatgataagaccttgaaatatatccattactaatgtcaacaactaacatgccttcagttttcatatattactattcttggcaattcccttagttccaagaaaagcactgaaaaataatgctattatgttgaaatacaagtgactgggtaaactgaagtggtttttctacatcaaaatgtgaaactacatttcagtggccagtaaatattattaaacaaatacatttttagagagagtcacatttaacaagatgtactcgccaatacatatgattaaaaaaaatctgaaatgcagtttgacgaatacaggatgaaagtcattcaagagctagggtaggtcattatttttctttcctaaattcgttgctgtatatgattgagaaactggaaggataacaacgaagaatgaacactactcctgaacctccagaaccctgctttatgtcctcactgccacccacagtagcccagtctcactcaccgggtcatcccttcattgatgctggcaacaaatcctgcgattgacctccgcccagctgtcatgtcatggtaacaatcgatgccaacgatcatcacgagcttcagcttcaatacaaatatggtaattttagatacaatggagtaccagcaacatttaaaaagtaaatccatgttcttaaataccaattttaaaacggcatctaccaattaaatcaaactcacggggatgtccaccctccagagctctcctcccatcttgcagttcatctgtagggcaatctttgtagcaatggccatgacagtttgctgtttgcctaaggttcgggccaccacacactgacttggggtagggcaatctgtacacaggtattttttaatagcatcgtatttgtccttccgattacttgacaacagacagacaacctgaaaacaaagtgcccttgttacaaagaattaggagacagatgattaagagcaagggagaggacaggaaactaaactcacctgtgaagtatcaatgtcaagaacatgatcatttattttactattcatttcagccacacagctaatcagtaggacattaacaaatactgctcatcatgttcaactaaatgataattgcacgtgaaggaaataaatcatgttaagcaaactatgagtcaaaactgaatactgtttaaacttgagaacttaaatatgctctatgtaaccagcacagaaaaatttagtgacaagtgacaggtagacagattaaagatttcccacagtcttaatttactcatgattcatctacaattgtaacttgtaagctttaaagctctggattgagaatctgatcaaactatgaacttccacaggaggtccatggacaattctggggacaaaacagagcgcctgatctcaacatgcccctgccccaattctgggcatccaagtttaactttcgggagtttggtttgttttgtttttgagatggagttttgctcttgttgcccaggctggaatgcagtggtgcgatctcggctcactgcaacctccgcctcccaggttcaactgattctcctgcctcagcccccagagtagctgggactacaggttcgcaccaccatgcctggctaatttttgtatttttagtagagatggggtttcattgtgtcggccaagatgttctcaatctcctgacttgtgatccgcctgcctcggcctcccaaagtgctgggattacaggtgtgagccaccacgcctggcctgaatccagcttgtaactcattgccatgttctccaatttatattcccagattcttctcttccctttttatagtgcccagcaaaataattttcccaccttgggtgtttccattacccagataacataatagctatctgcctgtgggatctaaagtgtgacatgaagggctaaaataatgaacacattagaagaagccaattcatttcttaggcttatggcaacacagatgtattgtttatcactaaatctgtctttgccaactcattgcaatgtggctgtatgaaaactcaacggggcagaagaaactcatcctagcactcgataccccacaatgtgctgctgtcttcagaatgtttcctgtgaactagatatgtactttcaacttgtttttaaaatagccaaggatataaatgcctaataatcagtgaaatcgctgaactaattattgttcacatgcatgtcatttttcccttcctactttacaatcataatgacataatagtagaacctatcataattttccttaccacttacatcttaatctcatattgtcattctatcttttgcaagttccatgttccctcagcagatctctggcaattttatgctacaggtataaaaagcaataggaattgactgaacttctatgtatcacccactacagtcccaggctactatgacctttgtatgtcagttttctaacaataaccaaccaactctgctaaaaataaggagagctgaagtacttgtcttggagattttatcaggcagggccccaataaaatagatggaatattcaaactggacaagttgagagaacctgaataaaaggactacttgtgagacaccctccccaacacccaggggctcatggcagcaagagcagggcagggaatggttatgggaacagggcatgggggtgtagagtgcaaagaaagctcttcaggggtcatggtctttggctcggctgtgctttcacttctgcaaagtaaatgtctaagccctactttcttccactatggaccaggaagtcttgaggccacaattccaagttcttggacaaagactgaatgcaaaggagattctagaccaaatgtgattaagacttggacaactccggagttccctgacaatgagtctggctctattttgctacattaggctgggtgtgtggacttacaagaaaactatggcactgctatcatgtttataaaggctacactctagatacagaccaaaaacaaccatatcaatgttgatagaatttcaggggtgggaggagtgttagagaagaaatataacttagaaagctttcaagttgaaaactttgctggaaaacacaaaggcaagtttgagaaaagtgtgtcagaagtgtgtgcaggggtgtgtgcatgagagagaggatgagcaggatggcagcctgaccacgcctaaagcacaccatggtgaacaacgacaggccatagtcgtacaacatgctggtgcctggaatatagaaggccctgttctcagtgctggggacgcgacaggaacgaggcagatggccttgtactagagagcagtgtgcgagagtgacggacagtttctaaccaacaatttatagaaagctggacaaacagtgaagtcaagacatacctgacagcctaaaaaactagcttgagaaaaggggggtaattttcccctgaataattcaaaacactgatgggattgggaaaatgaagagttaactcagactcgctgagtttgaggagctgactggtggcggcagcagcaacagtgattaacatgtcctgggctactagggaggggccgggcatgacaccgccattaaacttcagaagtgctgtgagggttcactactattattactaccacctaaatctgttcagaaaaggaaataaagccagaagcacttgatgaagatcaggcaaatggctgagccgggatgtgaacccaggggtttgatttcagagtttaccctcttaataactgcgctacagattacaacaaaaatgaaaccacaacacacacttgctgcatgtccccacaatttcagatcaccaatgaaaaccacccgtcattaagtggctgccatcatctaacgtccctgtctccaattcctaaccctctgcacctcccacacacccacgctaggtagcgagactctggcaaacaggcatatgggctcttcgggactcagtcctcccctcctgagtcatcactcactcacctggatgggtgggtgaagcacacacaacaacaacacgtttgcaggtaaaaggggaaagagcttaggagagtggttgcatccctatcccgacccctcggggtgatgtggatgcatgcggaagctgacaagctgctgagtgtcactcagggctccctgctctctgcgaccctactcttcccatacctggcactaggctgtctggggagcttccatgtaattacgcaatcatacgtctacgtgtgccgaacaacagctgatttttacctctgtgcttttctgtattttccaaattttctagactaagtaaagcctttgggtctgaataaattgaagatggctttgtttttctccaccccttcctcaccttttgcagtatgtaaaccaaactcctaggtgcacaactaaagctagcattagcttagctactttatggttacaaaacatattttgtgcctagtttgagaacctattaacatttgaaaaaagaactccaagttccaaaatgtacacatgccccctttgaaaaagctctttcaccgaaaactgcctatatgtcaattagttacttactatctgggtgtctgctgtgaccttttgctgtaagactcttaagtaggcttcagttctgtcatccacttcaatcctagaatgaaagtacacaatccaacactcagacacagtagcgacaaatggaccgtgcataaacaccttcctgtgtaacacaggaaacgtttccgtataaaacatgaaatcaaacaccgagactagccattcatgccaagggctgtttctaatacaaacgagcaatattttaagcacgcaggtttcagaaactgtcttacttggttgcttctcccacccattcttagttattaaaatatgtttctgtttatctgcattacagggagccacatcaaacctttcaattaagataacgtagtttgtatgtttaatagttcccacccctccaaatgactgccaagcaattttcagagcagaaatgacttgattaacttacattattgcttttctcatttgcatgcccatggctggtgtaactttaaatagattttgtatcaatgaattggctgcttcataatttcttcgcgtatagatcaacagccagttatctagtggcttaacactaattaatggtgcacctcttgtttctttggaccaatctgcaaattgtggattgtaatcaaactagaagagagttcagacacactgtaaattccattgtaagttctcagtgatcaagccaaacagtcttcaataattctaccatggcatattttgaaacttagtgtactacttttatgcttgaattaaagggacagagaaaatgtcctcaatgggggtagactctaaaatatatccaaaggatgatggcaattttacttaaaatacactcatactgacagctgccacacaaatgcttacttggaccaggtacttccctaagtgctttagtcgcattctccttaatcttttaaaaaatcttacaagtatagctactctttcttcataatgaaaatattaaaaaataaggctttgagagtaaaacaacttgactgaggtgttatatgccgcaagcaagctacaaaaacatctgacagcaagacagaaagtgaaataaacgcgaggcacagcacccgagtgctggtcatcacagggagcagcccggtgtcttctgcgtgtcctggccacctccctgcctggcctcacgcaggggatagcgtaaacaatgcaaccagaatattaaattacattgtgagatcactgttcacaggacatttcaaaggcaggaaggacattttcttaaaaaaaaaaaaaaatgaaaatgttggcactttacagtgctttaattacactaaaaatatttttagaatacttttccttttctgaaaatgaaacataaaaggtttcataataattaatttattatctctataaacaaatgatccaggccaaatcaaatcaggaattttccatcattttaatggcagtcaaaatatcaacccaagcagatggttagggattctacactttaactcaagtttttgaaaaaaaaaaaaaatcgagcctcttgttagttaagtctcacagatgatttttgaggacccaggtacaggctccacattctctagggcttccacgttttctcctcctggggtgtacctatttctgaggtcccgggctgttcatgtgggttgatagagagtggatgtgcaaggggataagagaaaggtgaggaaaagatcattttggcatggaactcagttcttcccacttgctttattgtgatctgacccaagcctcacttgattgtcaactttaaaaactgccttactcggagcttgcagtgagctgagattgcaccactgtactcctgcctggggggtcttcaccacgggccctcaagtatccgcgctggcgctaaagggcgcgccat

SEQ ID NO: 897 - DNA, 13237 bp, Homo sapiens
  misc_feature (1)...(13237): n = A,T,C or G
gaagacacccgttcctgtctcctgacctctctgctgccaaagtggatgctgttgaaattatcattcccttgcctgttgaaaaagttttaacaaatgtacatgggtcagtattaattactatttatttttagttggttttgaacttaataaaatttacagcatatccttgtccaaatttgccagtttttcttttatagacagagttttctgtgttttaaaacttttgctctaacccaaagtcagaaatatgttcatctgtattttcctagaagtttataactttaaatctctagagtagagcgagttgatttttgcatggtctaaaataagggaacaatttcccttttctccatatggaatgcatagtcgttttccacctccatgtccctttcctgaagaatgtcttcttttcattttggtttttctttttgagtctcgctctgtcacccaggctgaactgcaatggcacaatcatagtttgctgcagcctcaaactcctgggctcaggtgatcctcctgcctcagcctcccgagtagctgggactccaggcatgcaccaccttgcctggcttctttttttccactgatcttccatttaaacctcactcacacatcacagccccataaatgtgaagggccatttgtcattgatcagttagttgatctatcccagtatcagcatcccattgttttaattactatacttacctacatcctgatgtctggtaggacactttcctttatgattccaaatggattttagaatatatttgtaacattcatgaaaagtttaagattttattaaattgcatagaatcaataggaatatgtagggagagtaaacaatctttacgattttaggttttaccatcctccaaatggcttattatcccatttacttgagttttaaaatgtctttcatcataaagtttcataattttctgtgtactgatattgtacatttttgtttgatttattcctaagtgcttttagagttgccattgtaaatgttttaaggattatattttctaatttttacaagtatatgtaattgagctttttaatattgatcttacatctagctgctttaatacacttttatttctaatgatttgcctgtagtattttgtgttttctatgtaggcagttgtatcctctgcaaacaatgataattctgttttcttctttccaatctttatgctttcactttattaaattttctccatttaagattacatccattataggatttttataaacaccttttaccaggttaacaatttattcatagctttctaagagctttcaaaggcatttctgttgagtttttttagtttttctatatctattgagatgataatatggtttttatcttttattctgttaacatagttcatgttagtttaagattttctcagattcaatcattcttgcattcctgagataaactaacttggttcttttttttaaatataccattggcttttgtttgctaacattttgtttagagtgtttacacttacattcatgatgaaatgggcttataattttttcatttccttactatctttggttttgtatccaggtatacacttctcttaaaatgtcttgaagggtgttgtctttttattttttggaagggtttatataagattggggtgatctgagtatttggtaggattctttttgttaaactctctaggcctgaagtttttcttatggaaaaaaatttaactattactttggtttcatttgtacttatcatttttttaagctttcaattttttattaatcagtgtcattattttacactttttccaggcatttgtctatttttttctgggttttctaatttattaatagagagttgataatacttcatctttataaaatcggctgtatgattatgttctttttaatttaaaagtattattaacatcttctgtttgttgtgatcagcctttccagctgtatttcctttagtctagttcaaagttagttcacatcaacttcgtattgttgttttctgtgtcactggcttctactctttatctcttttcttcagttatcttttcttcctatctaacatcttaagttcattagtgtgtcttttctcgtataaagttataaatttcccttgaagcattgctttccctgcatcctgcaagcttgtcgtgctttcattgtaatccagctctctctctctatagctgatacacgggttctttagaagtgtattttataaaatttctaagttagtgccatttgataatttaacttccacttagtagccagggttaatttaccatgttgttggaaaccagagctcctaacatgaaccccaagtttttaaaaaatagtaaccaagcttagttgtgattttctggtgtattgttcaatctaatcagcactgtgattagtattttagttttgtaacaagtttttttctgttactcagcttcgtactcttagtactgcagatagaataggtattttaatcttttctgatgtcttcatttccaggttttggaatgtaatacatttgaaaatagtgctgtgagacagtggtccactgtcttgtgtttctacctgtctggtgagaagcagtactgactacctttgtccagatgatgtttgtgaggttgtttgtacagcagactgccccagaaggtagagatggtgtctcccttcagagcagagggcaggcatgcttacaggccagcgtcataaaaataatatcttgcttcagggcaaaagtcagacaaggttactgcccattataaaggactccggggtccctcagcccaggtttcccctgctccaattcagccacctgtgtgtgtgtggcatcactggtcccgttcactttgctcctttggaattagagcttgggcaatgggtaccagttatactctttttgcttctgaccacatcttctgtctctgactcaaggatctcatgtcttgtttcctaccccttactctgaagtcatttgtcatagaccttgtttggtttgttccctctctttctgctcctcttcccctccctccctttcaccctttctttttgttgttttctttctctcctctcaaacaggtgagggctgtatgcggcccacccatcactgggctagacggtgggctggcttggcctggtcgttgtctctcacctgctgggcagcttcttctccaggaccggtgcctgcacaacttacctggtccctgtctcactgctttgaagcctcctgccttccccacatagttctctgtgcactggcacatatggaaaatcagagtcccagcaggtgctgtccccggggccctcgccctctttcccctcttctgtcgtgtggatcgcactccagggctgtgtccctagaatggctgtgggcgtctcactgttctctccctgcttcctactaagttcctcaggagttgctgatttggatgagggacaaccagcagcacatgggcctgaggaagaggaagggctgctgagccccggcttctcgccaaggtgaggccgcctgccttctcaccgtctccgcttcggaaacaatgtcttcaggaacaacgcgggtgagacagcgctggaaattctcgctggggccgtgctctctctccttttccctcacagtgtgtggagattacgccccaaatctgacgcaagtccagccatctctacaaggattttattggaaaattagaggcagctgttttggtgactgctcatcaaatgctatcagaaagcagcattgttggtttaaccctttcctccccccttcccttttccttctactctatccccaaaaaagtcttttaagaagggactagaaaaaagctttattattttcaatttgtatggttacttacatgtgtcttcttcttctggtaactaaatggaatagggattgtgaagtgcggaatggtcacgaggctggaggcaaagaccccagcagaatggtagggaggctggaggcagacaccagctgtggtagatgaggccaagccagcagagagggtctgagtgtcagagaaaatggagaagggccagagaggggtgaggatgcagacaggccacctgcgacacccatgggggcatgcgtaaggggtccttgaaccttaacagagatgctgctcctgataagggcctgtgaccacgagagcctttccccctagtcaccgtcctcacatgcgtgcgtcagtgacctggtgaatattcaatgtgatgacccggtcactgtcatcacgtgtgtccatcagttacctggtgaatactgaatgttgtgatgacccagtcaccgtcatcacgtgtgtgcgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaacgttgtgatgacccggtcaccgtcatcatgtgtccgtcagttacctggtgaatattgaatgttgtgatgacccggtcaccgtcatcacatgtgtccgtcagttacctggtgaatattgaatgttgtgaggacccggtcaccgtcatcacgtgtctgtcagttacctggtgaatattgaatgttgtgatgacccggtcaccgtcatcacgtgtccgtcagttacctgttgaatattgaatattgtgatgacccagtcaccatcatcacgtgtgtctgtcagttacctggtgaatattgaatgttgtgaggacccggtcaccgtcatcacgtgtctgtcagttacctggtgaatattgaatgttgtgatgacccggtcaccgtcatcacgtgtctgtcagttacctggtgaatattgaatgttgtgatgacccggtcaccgtcatcacgtgtgtccgtcagttacctggtgaatattgaatgttgtgaggacccagtcaccgtcatcacgtgtgtccgtcagttacctggtgagtattgaatgttgtgatgacccggtcaccgtcatcacgtgtgtccgtcagttacctggtgagtattgaatgttgtgatgacccggtcaccgtcatcacgtgtctgtcagttacctggtgagtattgaatgttgtgatgacccagtcaccgtcatcacgtgtgtgcgtcagttacctggtgagtattgaatgttgtgatgacccggtcaccgtcatcacgtgtgtccgtcagttacctggtgcatattgaatgttgtgatgacccagtcaccgtcatcacgtgtgtccgtcagttacctggtgaatattgaatgttgtgatgacccggtcaccatcatcacgtgtgtccgtcagttacctggtgagtattgaatgttgtgatgacccggtcaccgtcatcatgtgtgtctgtcagttacctggtgagtattgaatgttgtgatgacccggtcaccgtcatcacatgtgtgcgtcagttacctggtgaatattgaatgttgtgatgacccggtcaccatcatcacgtgtgtccgtcagttacctggtgcatattgaatgttgtgatgacccagtcaccgtcatcacgtgggtgcgtcagttacctggtgaatactgaatgttgtgatgacccggtcactgtcatcacgtgtccgtcagttacctggtgaatactgaatgtggtgatgacccagtcaccgtcatcacgtgggtgcatcagttctggtgaatactgaatgttgtgatgacccagtcaccatcctcacgtgtgtgtgtcagttacctggtgaatgttgaatcctgtgatgaatagctatgatttcactagaccggtattggatttttttgtgaatttaccacttttcactattataataatgtgatacatttcttagttcttaaatccttgcctagatatctcttttcagttggattcctagaaatgagattcagttaaaggacataaacacacacgttcaaggctttagaaagtcacttggccaagtgcgtaagacacacgatagagactgcagcccccacggcaggagctcccatcctccccaatatcagcggtttcatgtttggcttttgggtaactttggagcagaaaaattttgcattattagtttttatttcttcagctagtgaagttgggcattttgtgtttgctgtatgtattttacggattccttattgacgtctttggggtaaggttctaaaggtagagaaggcccctaccatgcatgtgggtggaaagcctgtacctgggccttctcggcactctctctgcatagctcctcctgctccatggagtatttccacatagggtcggatttctttcgtattcttaatttcactttgacacttgattcatcctcttttttagagactttggttattgttgttctaccataagctccatatactgtttggtagtcccaggcatcagttctctgtgatgagaggggctgcaggaaggggctgcgccagctggcagcacaagggcctggagtccgactgcaacagtgagcttgcacgcggaggtgcacggagccagccaggggatagctaggtattttttctttacccatatgaaagagcacttcacataaaacggttttcttttcaaaattaaaaatgtttagaagtatatcttttttcttttaatatgaatgaggctttcaatgtagttttctttcttttcccaaaagcttccaatatacctgcaaacaagctttatttagcagaacttttcccaagaacccagttcgtcactgccagactgcctctacctcggggccacagaaaaaagtaccgtagaaatttctggaaggttggggatttttgcatttttttttttttttctgagtgcagctttaaataattttcaagaataagaaaatacagtaaagctcacttggtggaacacaggagttttgtgttctagtttaagcaaatagtttatttgaaaagtgttagcgagaggatagaaaaatgtttatgtgcatgagaagtaactgcaaaacgaaatttggcaaaagtttctcattttgaatatacataggaaagtcataacagaaaatgaaattaagaatttaggtatagttgtttgttgttcaatgaaaattgtgcctttacaggtcaggatgagaatgggagggtcattctgaatcgaaagaatcacttgttttatttggcaggggagggggagcagcagaggcaaatggatggtaatgtggggaggcgctcatgggtcagggctgcagccacttccttagaagcagcgggaggaagggttggagccatttaactgcaagaggaaatggtttctgttctttgagtactctgtacagtttgggcttccacttttagactaacctgtgaagacagaaaattacactcacactggtaatggagagcttcctaacttgtttggtacaattttcggtcataaaacaaaagcaaaacatggtttttctcttatcatcaccagaaaagggagattgctgaagtgactctcagctcagtctgggagggagttggggctggaatgagtaattaaatgtgacttaagcactttcttgtcctcagggtgggtgctttggttttaggaaaattgtacttacttataaaataggggggaagaaaagctaagaccagctcattattacttcaggtttgcctacattttcatactttggggaattggtaaatattttcaaaagatttagagaaacattagttctggatactttttgttagcaactcttcaacttttcctgtaaatactgtaggtaaaaagatattatggtagcaattatgagataaattataggttcatgaaattatgtacttgaactatattttcatcttgccgtaagtgtgttggttttacctctttctttgaaaagacatcatctggttacttggagaattctaaaataaggcttttaggaaaattgtatgtatttgggaagttatattttgttgtattatgttgctgtagccgttcattaatttcacttgaattctaaagctgccagagggaattaacaatttgtgtttgaattcatcctggtagtgcttatactgactccgtgcgaatgaccttttgtcactgactggactgttactggtagtatgagagtgtcacaacattgtcaatggctcccaaaacatagaccaaaattatttttggaaaaaaaaaaaaatactcccagaaacggtaaggttatggtgctttttgtaaacattaagagaaaggaagtcagttatcccgctatgataaaatatttaaaacaaagagaataaacagtgttgtataaaataacaaattttatttctagaaaatattttacactaactgtgcacatgcacacacccacacagagcttaaccacacatggatttcctttaataataaatctaccacatactattatattacaatttataatagcgtttttgaagacacaatggggaaagctttgtcattcatttataaaccgtccataaattacaaaagaaaggcagtctgaaaagtatgtataaagagtaaaaacaatttacaagtggacaagaattacaaaagagtaaccatcaaatacatctgccagcaactttgtaagtaagtcttttgttcaaatgccaatgatgaagatgggtatggactcatttggagcagatttaaattgagtctggttttggtgtggcttatgcattatgtggattacttgtgtgccattcattgctgtgtatttgggtatggcattttgacaacgaaagtaacagaaaaccatatgccacagaatagaacattaaaagcaatgaagataatcggctttctggaaggttggagtactggtgctttaccaaacaaagttactttctctccttttctcttttttgaatgattgagtaaacattttctgtgtgtagcctggctggctttgaaagactgaaactagtatcttaaaatgcacagcctgtacaacttgatctcaaaccactgtgtcaggatgaagaccactgaatgcacgacacatacaaagtatacactgtttttattagacagtacaaatcattgtgcatttataaggcagaacatcaaggcgaattaaactaggaatttcaagaccagagtcaaagtgaaagttatgcattatgaggcaagcattttgagaagggagaaaggttgaaaatcattcctttaagggcagatgacaaatgcacaaagactggaattacaggtagggagggagctacaggtgatagctatgcgcccccgtttgttaataagacgtcccctcccacctcccaaatcagagcttggacaatgagagcagactgccagcggtgacagagagcaaccgctcctctttgttctcgtggttggtttaaagtggttggtagtgcaaaagtgcatttctctactggtgtcaggggagaagattgggtttttttaggaagtacttgagtcatgaaagccctagtttggaattaaagaaaattacatagatttggcagttgtccggaagcacatgaatcatttcactgcacccagctttttcagcagtttcttgcctttggaaagcagcccctttttctttttcgaggacatttccctgcctctcccaggactaccagaacccatagatgacgtaggtgaccccgaatggagatggactgtgggggatggagctctccttgctgtacctgaaccctcaggaggaacctagtaggtacagtgttacagtttattgagtgtgtgagcgccaacaacagaattcacttggtaacatcgtactgtccccgtttcccaccaggaaaggtcaggggggttcatttgttctttcagttgttgaagtatgccatgagaagcaaaggtcctctcccacagcacgccagagagaggccccagacataaatgtgtgggttccgtttctctgtctcgagggagtgcggggtggccgttgctttggcaaagctaaggcaggtaataattcacttcataaatgaagactaagggcaggggagacatgatctgaaattaggttgatagtaaagttggccgagtacccatcagtagtcttaaaaagcgaaagttcataaagggaattttgttgtatttgaaactatttggttatataaaatcctgatattgttaaagtgcattcctggggtggttggtatactatagaaatattggagatggcacactggttgaaagaaaaaaaaaaactaaaatgaaccttaattataatcaaagaaagcttaaaggcccttagtggatgcttgcattatttccaaataattgaacatgaatcttcctcagtagatagcacatggtagtatttaaatatacgttaagcgcttaatagtgcttcagaggggtagacttttactctaatacgctgcaggacgacttcacctcgcttccctttacagctaagcatgtgcctgagttggcagtgcagcagcattcctctggccctacctctccagagcaactcttgccatgtgagtgtttagtattcagcaggcaaatgctgtaagccaaggggcttcaagcttgcttggatttaaaatcaaggtctaattctaatggaaaacacctagtaaagcatcccaaagtacacctgaagataccatctattccatctaatgtgatcatttgagctgcgtgcttcatcaacttagtattgcattggtataccaacaacaaacgcgtgttgcagcaacttctgtcacaggatgattgtgctttgaggaggagcatagctctctcgtaaggtagaggcagggttacttaaggaaaacacgttctggccactcgagccagtgtttggagtgttcagagccaacactcgatcacctgtgttcactactcatctgcttgaccttgggttaagtttctaaagtaaagcttcctatagtaaacatgtttgttaggttgtgctttttccaagagtggctaacaatgcaatatgcagctctctctatgtaaacacacagttagcttgttaagaaatatgttcccaatgttggcctttcaaatattcttaatgcaaatagtaggaaatgattattaaagatgatttgcttcactataaattcagttgctttacaactgagaccaagtaatattctaattatttaggtccaatagttttttgagacatatttctttgtatctttttttttttttaaccccacaatgaagccttaagtctaccacactggcccggttaaggtagcttaagttggtatctttatcggtatcttcagttgctcacttacgtgaaggctacattgcctgattaaggtgtgaaatgaacactcttcttctgtttccaagcagatgagcaaagaaataaaaatatatatataaaaatataatatagaaaaacttgcagtgatgaaataaaataaaaatgagatactaaacatgaatgtagtctaatagttcaatatgcttgagaagcccttggatccttgtgaagagactaaagtcctaacagagggcaaataacctccattgcccaccaaatctgaagaggagccatccccttttcactcttgatcaaactgaaatgtgcttctataatgtaggatgggacatttctttgtgagtaaaggcagattgattgattagaattgaaagggtctttttttgtaaaatgagtaagatttagaattaagaatttttaggtacaactcccatggcttcagggcagagaaaaaaaattcagggtgtatttacgcttttcggcccaagatataaaaatatcagtgcaaagattgtattagaccacatatggcagaacgggacagagattaaaaaggctaaataggtttgcttaccctttttgcctttgagcgcattggcgtatcttgagagtagtgggatggagcatcagaaagatagacttctacgtcatcaggcacttcttccaagaagtttgagggcacaaggcctttctgcccattcagctccccctaaaacaccaggggtgaggcagaagaactatttatttttctagaaacccacatcttgctttggctaaaggaatacagctcagagtacaggtacatggtgagtttattctggttcaaaagtggcaggacttgaaaggactctaaatcagggtttccaaattttcctcagcaacatgcagagtcctaagcccctttcctggggtcttgatttctcctgttcagtgaggagctgaggaatctgccttttggccaaagagcccctgggattcttaggatcaggcttctgaaggaaacactccttggcagatctcatttagtggttctcgggcctggctgatctgaggcactagggagctgctaaaaacacatcgctcagcacaccagcccagaccaatgatggacaccttcagacggtggggacctggtggtcctaacatgccagcaagcttgagcgctactggtctactcagccttaagactgtcctccctcttactcatggataggttattatcgtaaacattcaaacaatatggagaaaatgaaagtgtctgttgataacctcctcagacattactgcttcaggttggtatatatccttccagatctttctactcatttacatatctatgccttgtctaaagtcgagatccatgagtccatctgcctgctggtcatctgcaccaagtggctcacaggcctaccacgtcacttcttccccaaactcatctgcccataaagtgcctaaaccaagttcaaaattggctggctctgggcaacacggaatcctgtttctctgtttatatggtctaggaaatgacataaagagcctactacatcaaaacacctgtgcagtgaaggacacagcagagtgatgagtacctgtggaatgggagaaaatgtctgcaagtcatctatctngctaagggttaatatccagaacatatanagaacatcannaaacccaattaaagacatttctccaaaaatgagaatcaagtggccagccagcacatgaaaagatgccagtccccacgatctccagggaaatgccgttcaaaaccctgagtaccacctccacttctttcaaaaccaaatggaaaaaaccggtactggtgagatattaagaat

SEQ ID NO: 898 - DNA, 18259 bp, Homo sapiens
cgcctcccagaggggtaaaaaaaaatctgtccaggggccctattatttaaatccgagatttctacccgtcccccccttttaaaatatcaaaaccaaatatttttccgcttcacaggtttggaaaaaaagggaaaaggccacctttatgacttccaaaaacggaaaatggcctggcacctgggattaaggactcttgttccgggcttttcaccctaaatgtggacagatttttaagtccagggttgacccttcaattttaagaaagcacgttccgggtaatccataaccgaatggtaatccaacggttgaaaatcacatgcagatggcagaatacttgacggtagcttccccacgggtaaaaactggatccattcgaatgaaactcctaaatccattgcagatggtcatcattaccttcgatgttatatttagcatgtgctggttatattcttttgagcatttcttgagagcacattcagctgagcatggtgtcgcatgtcagcaagatgatcaagttcatgtcctatcgccctttgtgatattgcatttcagtaagagggatggtgatccactctgcctctggccaatatagcagttagactgcatcctgtctagctataggtatgtccgtttagcaatatgtgtaatcccgctgaaggacgcaagacatcatgcgatccaaggtaagtagatatcgagttcttggctgggaaggtgactatctgaaacgttatctcttgtgtatcatcttacagattaacagttattccaattaaatgttgtactgggcagatttttacaattatatatatatggaaaataaattagaatacttatttaaataaaggaaaaagatgataagcgctagctttcttatcgagtatgcacatcaggttcaacctaatacaaaagttacgctggaatagatagcccagaagagaataatagggagataagaaatagacactggcataaatgggactttgatatagcataagccatgtttcaattcagtgggaacaagatagattttttgataaaggactggtgcaactaacatagcatctagagaaaaatcacattgtatttctagcttccactgtatacaaaatctaacttttggtggattaagatttacatgcaaggaataaacaacataagcatttgaagaaaagttgggagagtatcaattgcaacataggaattaaggaggtttttgtgacttagaaaacctagaaattataagagaaagtataaacacatttacaaatttaaaaattttgtatggcaccaggtaccatgaataaaatacatgaaaaaatgatgttttgaggcaaatacctgcagcacagaagacagacaaagggttcatgtctataatatacaaagagttcttgcagttcaataggacagccagacaaggatataaacagacatctcataaaggagcataagaaaacggccaatgtggagtcttgctctgttgcccaggctggagtgcagtggggcgatcttggctcactgaaacctccacctccaaggttgaagtgattctcctgtctcagcctcctgagtagctgggactacaggtgcccatcaccacacacagctaatttttgtatttttagtagagatggggtttcaccgtgttgtccaagctggtctcaaactcctgacttcaggtgatgcacccgccttggcatcccaaagtgctgggattatatgtgtgagccatgacacctggccctccagtatgatattaaacctctcaaatagtctgtaggatacaaaagacagtgacctcagggataaaacgaagactgcatgttagaaaagaggtcacaatcaaagactgccaatcaaaatgacattagattactcaacatcaacattgaaagctagaattcaggggaggatatattccacttcctgaggaaaatgatttccaccacagattgccctaccaaaccccattcatcaatcaagcccagggtagaataaagacattttgaaacatgcaagtaattaatcacttacttccctttctcagaaagccattgcagggtgtgttttacataggctaatagataaaagaatttccaggaagatagttaaaagaagacttgagatgagagaaaccccatctctactaaacagtaaacagtcttagaaagccagtgattctgggaatagtagcaagcctcttctcatgtctcaatggccagaaatgtgtattgtatctttgtatgagctaatcactagcaagggagtgacatattcctaaaaccagtgagggccagcctcaggtccatggttgaatgggaaatggattcaataaagtcaggttctcctaggaaggaggaagaggatattggatgttggttgggccatggacaatactgcgacaagcactccaatcatatgttgatatgtacgtgtgtgtgtgtgtatttattttccagttattgattctcttgtaatgaactgtctatctagctttgtgtcagtgctacactgttttaattattattgttttataatgtgttttaatatctgatagaacttgtcatccactttaaaaatttttctttccagaatattgttttatattgttgttctttcttctagataagacatagaattatttcatcaagtgggtaaagctgcacatattggattcaaacagacctgagtttgagattggcataagataggactgtttattagctttattcctggggaaagtttcttatctgtgtaagcctaagttttttcatttataaaatgaaaataatactagctaaattagataaaatgaacaaattcatagaaagacaagaactactaaaactgattcaagaagaaatagaaaattgggtagacttataacaagtaaaaactttgagttaataatttaaaaactacctacaagaaaaaaactcaggtccagatggcttcacttgtaaatataactgcaaattaaaaagagaattaacataaactttcacaaatgtttaccaaaaaaagaataggaaggactatttcccaagttttttaatgaggctagtattaccatgacagtaaaaccagtcaaatattttacaagaaactgtagaccaatattcttatgaatacaggtgcaaaaatcttcaccaaaatattagcaagctgaattcagaaacatataaaaaagatcacacaccatgaccaagtggaatttatccaaggaatgaaaggttgatttaacatctacaaatcgactaatgtaatacattgtatgaatagattaaagtacccaaatcacatggtcatttctatgaagaaaaagtatttgacaaaattcaacattctttcatgataaaaaacactcaacaaactagcattggaagggaacttcttcaatctcaaaaaggaaatctataaaaaaaatccacagctaatatcatactcagtggcaaaagactgaatgttctcttcttaagatctagaaggagagaaagttgtctgctctcaccattcctattcaacaatgtcctagaggttctagccaggctaattaggcaagaaagttgaacaaaaggcatccagattggaaagacagtagtaaaactatttctgcttgcagataatgtgatatatatggaaaatcctcaaaattacagtaaaaatctattagaactagaaacaagttcatcacacagtatacaacatcagttccgaaaatcaactatacttcttctaaacactagtaatgaacaaatcagaaatgaaattaagaacacaattttgtttatgagcacattagaaagcataaaataattaggaataaatttaccaaatgaaccacaaaacttatactctgaaaatgaagaaatatggttgaaagaaattaaggaagacctaaagaaatggaaggatattcaatattcatgagtcagaggcttactatagttaaaatggaaatatctgaaattgacctacacattcaataaatctctgttgaaatacaagctggcctcttggcataaactgacaagctgattctaaaatttataagaaaatgcaagagatcaagaagagccaaaacaatttttaaaaagtagatcaagttggcaggttcataattctcaatttcaaaatttaccacaaagcaacaataaccaaaacattgtagttctgccattaggatagatatagatcaataaaatttaattgaagattcaacagttaattctcacattcacagtcaaataacttttgacaagtgtgccaagaccatttagtggggaaagaataggtttttcaacaaacaatgatggaaaaactgaatatccacatgcaaaaggatgcagttgaatatctacctcacaccgcatacaaaaattcactcaaaatagatcaaaacctagaagcaagagctgaaactataaaactcttagaagaaaacataggattgtatcttcctgaccttggattaagaaatgattttctagatatgacaattaaaacacaaacaaaataaaaaaagataaattgaagttcatcaacattaaaaattgtgtgcttaaacaagaaagtgaaagaatgggagaaaatacttataaataatctgatgacggaatagcatctaaaagatataaagaattcatacaattcaataataaaaagacaatccaatgagcgaaggatctgaacagagaaagaaggtacacaaatgctgataagcacaccaaaaaatgctcagtatcattattatcaagaaaaataaaataaaaagtacaatgagataccacttcatatccattaacatgattatgataaaaagaacaagtgtgagtgaggacatggagaaactggttcttctgtacactgctagtgggaatgtaaaatgatgcagctattttggaaaatagtccagaagtttctcagtggttaaacatagcgataccacaggacccagcaattctgctcctggatttatatccaagagaaataaaaacatatatccaagcaaaaatgtgtacattaatattcataacaatatcataaataatccacccaagtggaagcaacccaaacattcatcaactggatgatgaagaaagtgtggtggacccatacaatgcaatattattcagcagtacacaagatgaaggactgctatatgtcacatcacagatgcgtcttgaacacattatgccaggtgaaagaagccagtcacagagaaccacatattgaaagtttccagtgatatgaaatgtccagagtaggctaaccgatagggacaggaattagattagtgattgcttagggctaggcagattgagttgaaatgagaagtgacttttaatgtgtacgtggttccttttgagggtgatgaaaatgttctaaaatagtggtgatgattgcacaactctgaatatactaagtcatttgttttataccttaaattatacccttgatgagtgaattgtatgatatatataataaaactactataaaaatggaaataattgtccatagggttgttatgaagataaaatgagataaaatttaaagaaatgctgaacaccatatctgttgcaccctggacactctttaaagtatagctgttactgttaatgctactgtgacaccaccgttaagctccaagaaaagttctgttgtaattggtcatgtcagaaacctgtatgttgatttgggaaaaatggacatcttcatgaattttcattgttccatccaaaacgatggtgtttcattccaatatctgttttactttagctcatgtagatcatctacactggatcctggcactcgatagaaaatcctcctatgatctccgcatgggccccaaggctcagcctgtcctgggcgctgtcaccttccttacctttctccattgtccccagccacagcaaaccggactcggctcctttccccactatgagctctctctcatatcaggattgctgcaggtgccattccttctgcctggaacactcttcctgcctcccacttgccctcagatccaatgatatcattgatcagctataaactttgcttccatgtccagcattgttcatcatcattagcttcagcttaaacgatgcctttcttctttcatcattgccatcaccatcataaccaatgtgtactgaatatttgcaggtatcaggcaccgggctgagtggttaagaatgttactcctgggagctaagtgctgcactcatccttgcttcacagatgaagaaactgagacttgcatggattaaggaacttgttcaagggcaccacacacttagaatcaacagcttgtgagtccagttctctttggagcctcaatgcatgttcttaatagctaaatgattaataaatgattaagcccaaagaccccgtccacgtgtttgtatttctctacctaaatcaatacacatatatttcagtgcatagtaaattgatgcattgcaatcatgttgacacaattctctatagtcgatgagtctgtttgagtctatcaatataatgatatgatatttgtagattcatataaagtaattcatgtggctgacatgtattctttggttctaaagacagatggccagatttttggtttggtgtagtttaaaaatacacccttgatgagtgtaataccataatgaagaaggcacctcattgtttgaaagtcaaggttattaatgtatgcaaatataccaattttacagatatatatctaacttttttttttacatttacatttgggatcttagaatatttcccgaatgtagcctcattctcataattattcttttcatttggattaggtttatttcttctctatgccaatccgttttgttcctcaaggagatctgacatatttaaatcaagggaatattaatacattcctaaaaactgagttgataacagttgagagctagataactgataatactgttcaaatttggcttttattaatgcactctagggacagttgtgtttgagtcaacctccagctaaaatgatagaaaacagatgtccttaaaacaggctatgtgaaaacaacagaaatgtccattcggaggagaatgttggaataaattacagtatgtacagcagtaatatctgcagccactaaaaattatgtgtaggtctatgtttactggcatcaaaaaatacacaatttattgttattggtaaaagctagttgtgaacttgcttgtattatatgacctcttcttagaatatatgtcctctccccttccctcccctctcatcccctctcctctcctcccattcctgtccctctctggccctcccatttgctctccttccttcccctcctgtctcctgccttattcttggctcctctactttttctctcctgtatttcattctgtctctccacgtatttagaactactccccgtgtgtgtgtgtgtgtgtgtgtgtgtgtgtgtgcatgtggcatgcatgtgcatgcatattgcagtgaatctatagatctggaaggtcggatattctggagagtggcagtattcatgcttattttccactgaatgcgttttgtatcatttttttgtgaaaatacattccttttaaaatgataaaaataaaagaacaacagtttatttccattaaaagataatcaagcagtagctgttgatgtcagcttaggggatcagaggttttaattgtgttttcattttcattgtaaagggcgggaatccagccaccaaatcaaaatcacggtgaccctttgaaagaatgacatttaacatgtcgagactgagctcacaaagaggttacagagcttttcaaccataatttgattgctccaatatcaatatagatgaatatttcatcaaaacggagcacagatatgcacagcatggtccctcctgatagtactgaacttgccctgggcggtttccctacagtgagaatttattatatagtagcctgccgagctctcctgggggtcagggggttaaagctacagaaatatgatttgagaatcatctgagctcagctttgttggaaaggtaaagagagggattcacaaagcctttttacgatgttatttaaatgccctgcgatgggggtggggttgggggagcagggataggaagtctaatcacaaccaaacctgtcaacaccagtgttgtgttcacgaaatactcaggatgccacgtgcccaccccagccccaactccgcaaagttctatttccagatatggattgtttttagtttgaaatagttgaaggcctctccctggcctctcccacttcattaaatgctacaaattaaaacaaatgtccatgaatactgtcctcccttggtgtttcatttgtcacagcgttgggcaacggtgccagctccggagttttcacgataagaccggggtggccatggattttggggcagtggcgttacctctgtgcatatcaagaagctgtttatacttcaattttatgctcatctggggcgactctggtgggaactaagctatatcccatccccaggtgctctgtcttggagtccccttgctgcctgttccaaagagtggagcctgtatcttgagggcagtgctaggtgccagcaacaggcactggtgtttaggtatagctggtgacattccagagaagctggtgacgtgccattttttttttttttttgagacagggtcttgctctgtttcccagactggagtgcaatggcatgatcacggctcactgcagccccaacctcccgggttcaaccagttcttccacctcagccttccaagtagccgggactacaggtgcgcaccacccctcacaactaatttttttttttgagatggagtcttgctctgtcacccagggtagagtgcagtggtgcgatcttggttcactgcaacctctgcctcctgggttcaagcgattctcctgtctcagcctcccaagtagctgggattacacacacacaccgccacacctggctaatttttgtagttttactagagatggggttttgccacgttggccaggatggtcttgaactcctgaccttgggccccccttggcctcccaaagtgctgggattataggcataagccaccattcccagcttcctcccaactaatttttgtgctttttattgagatggggtttcaccatattgctcaggctgatctcaaactcgtgggttcaagtgatcctcccatcttggcctcccaaagtgctgggattacaggcgtaaaccactgtgcccagcctacctgccattttatatacagttttccccaaacaaatccacagttcacctcactggatcctaccagatgagccgtggccggtggttacttgggaaggcttggctttgagatttactttcttgcagcctgtggttttctgtttctggcttgtgtgtgtgtgtgtgtgtgtgtgtgtgtgcatagtttggttcactttcctatcacttccctgttgctacaataagttgtttcccttatatgtcatctcaaaatagaaatagaacaaagaaaacaggacacaagaaatcagggaattttccaaaggcacatttgatgtgcaagtgtaaacaggaatgagatgccaggggagatcggaattgtcagcatagacagctgttagtgggtgttgtcggtggcactcagggagatggagctgtctgcgaacttgcaaaggaagaggacacaggaaaggagagggtgcaaggaaaattccgcctttccgttgctgcttcaagttacatttgtacttgcagacttgagtaaatgtctgatttattcaactttaccagtaggagttagttcaaatacatggggcaggacatttacaaaagtctggacacttcatctctgagtgattttcaaggtgtgaagacttggactcaactctaactgcaggcagaggagtgggagacgttcccaggccactgaggataaggttcaagtgttggaggttgcagtgtctttgcatgctgctgagtcaagctggattttgacacagcctggttttatttaagaaaagctggaataaataacagggtcaggggtgcattcgggtgtcaggagttatggataaacaaccacaatcctggtattcactcgatttttatcaggagaccacagcatctcctatgctgtgttaaatatactctagaagatcttgggccagaagccagaaacaaacatttctggtgagagcaaatggtgtaaaaatgggaggggaataaaggaaaaggaaagggaaattctcatgacacctttgaacttgaatttcctgctttattcagccgatgtaattgaaaccgatgtctcctttctccctaaaggttccacatgtgtggaaccagggcattttctttttctaagagggtaagactgcacgtcctcctctcctttctaaggaacatctaaggtaactttttaccttagtgacaataaagttagcagcagcacattgaagtatgaagcacgggggggggtctatggaatacaattcaataagtaagatcagggcgctagaggttgcaaatcacttgatatttaccatctcgctttgttttcacagcaagtctgccgagtccgtagtcttgtgactagttgacagatggaaacagtgaaggcccagagagattcagtcacttgctcaaggccacaggctggtaagttatggaaccgggattcacatccacacacgaatccacgctcatgaagattctgcctggcatcacgaagtacagtgtgagcgtcagcaccatttgctgggcttccctccatgcctgtatcattttaatgtctgtagtagagtcaaactaaggtgatatagatgaaaaccaaggaattcacaaagctaggcaaatccacaaagcagtatatcaaattaagacaaaagtggattcaattgagaaaaacagagttaggtgttcctggcatgcaaacttttttttttaagttaaatagttgacaagaaggatattacctgccacttctcttctaagttattttatttgacatgaagctctctaaagggcacagaggttgagttgtgtcattaagctatgcattcttcaagtgtcagattttcagatgccatagcttaacctttgcaatgctgtagaaccttgttcccagtcagctaagttcttttttaactttcttttcttttttcctgatgttgttcacaggcagctgcaggcctagagcccttctcatgaagagcaggaagtacccaaagccacagccaggattaaagagttgatctaaaccttagatcttagctttaagattgtaatgtacagtgaatctggttacatggaaaaggaaacagtaattgttgaagtatgttttcttaagctacagaataatttttgaaatgtttgcctttaatccgcagacaggctcgcgtttgagaaaatattttcttgctgctcaagatgaatgtgagtgtctgaagtactggatctttgagctacattttgtcattttttcaaaaaataaaaagatgactagtgtcatacaatagagtttaaaagattgctttttctagctaccataactttggtgccctggttgtggaatgttggaatggtttagtttctcgtgcttcttacttaaaatttgagacagtgcctgattaaagaaaaatagtagggcacccgtgagctcattatacccagactagaacgttatctcaccatgcttaggtcagagggtggaaagtatcagggctctgagcaccacacttgattctagctttgcttctttccagatctgagcatctgtgctattgattcaactttctcagtctccatttgttgctgccaacgctgggtaccacaagtgattccctcatatgggaagtgcctgactcacaattatgaggtttgcatgctgtagctatatagtgtaaccaaaacattagattgtggatctaataatagaagcctgcaacttcttatctaccgagaaagcatggaagaactgctaactcatgcccccatgcctaacaacatgggtttctcaacttttaaaggattagagtcatctgttgatcttaggaaccaaaaactttggtgcaactccaaataaaagtaacaaacatatatttttccactgctatactagcataattcccacatgtcgggggaggaacccagtgggaggtgatgaattatgggggtgggtctttccatgctgtccttgtgatagaacaatccacacaatcctcttttaccgtcctaggattcacaggtgattttcttctcttgacactgtctcaaggatgactgtaggatgctcaagtttctggacagatgatgctgctctaaagcagtgcttcccacactgtcagtggaaataccaactttgttgttatttacttcccatatgctacaaactgctacttttataaaatacaacaaagataaatttctagggaaaaaagtgaaatgagaaaacacaaagatatgcaaaatacaagttcatgactaaagccagtgtcaattaccaacaccatcaaattgctctggtgcctcctctggccttctgtaccaatttctctccaatgtgtgacaagcagtgcatgggctgtcttgagtgtgtggaccacactttgactggcacagtgatacggcctcatagccctgggtattaatcccaactgtagtaccaaccaacaaagcattctatcactttcaaggaacagcagtggcacctgccttggagtcagacattcctgctcagaatgaagtgtcttgtgtacccaagattatgtgttctggatgcgcacagatcttgggggataatatagtttggctgtgtccccagctgagtctcatcttgaattgtaactcccacaattcccaagtgtcatgggaggaacccagtgggaggtgattgaattacaggagtgggtctttcctgtgctgttcttgtgatagagaatgagtctcaccagatctgattgttttaaaaatgggagtttccttgcacaagctcctctttttgcctgctgccatccatgtaagacatgacttgctcctccttgccttctgccatgattgtgaggcttccccagccatgtggaactgtgagtccaataaaacctctttcttttgtaagttgtccagtctcaggtatgtctttatcagcagtgtgaaaatggactaatacaggggagccgaggaaactggactctcatcccatcctcaaagtttcgggtctggtttgacagtcagagaagaaataaccccaggatgagtattataaagaagacatgagcaagataccagatactccagagaagtcaggagagccttcaccaagaaggggatatttgaaaaaggtttttccttccttcattccttcctccctctttcttctttccttctttctttctttctttctttctttctttctttctttctttctttctttctttcactttctttctttctttctttctctctctctctttctttttcttttcttttcttttttctttcttttctttcctttttttttttttgacagagttttgctcttgttgcccaggctggagtgcaatggtgcgactgcaacctctgcctcccaggatcaagtgattctcctgcctcagcctcccgagtagctgggattacaggtgctcaccaccacacccagctaattcttgtatttttagtggaaatggggttttgccatgatggccaggctggtctcgaactcctgacctcaggtgatccacccaccttggcctcctgaagtgctgggaatacaggcatgagccaccacacctggccttgagaaaggttttcaaaatggttagacatccactggatggatgctgggggaagggggtcagtggatggagctgagagttggaaaaagataccctagtgacgcaagatgggggagccccaaaactggggcttagcctggaagggttcttgactttgcccaggaaagaactcaagggggagacggtggtgctggacagcaactgttatggaagtggctgtgcacagcggcagaggtgctgctcctctcagagcagggctccccacaggcagtgtgcccagagcagcagctcagaggcagggctgcagtcgtatttatgcccacttttaattacatgaaaataaaggggcaggttttgcaaaaatttctaggaaaagggtggtaacttccaggttttgccatggcaatggtaaactgacatggcacactggtgggcgtgtcttatggaaagctgcttatgccttggccctgttttagctagtcctcaatttgttccagtatccaagccccacctatagagtcaagtcccacgtgctacctcagtaggcagggcaaacagtgggtaaaatgtccgtaaacttgggcaataattaagaccctcgaggtcaaaatttcctcccctgtgaaatggagccgacaatgcttgctttgtgtggatattagaagtgatgatgtgcaaagcatccacatctgtgcctacgctgtattcacacaaataaatgctagtttgtgtctctacccccgcgttggtccagaggcaaggaccatgggtgagcagtcatcccctactcttgggaatgtgatgcaggctcagagatcactgggcatcgggagaattcagtgaggggacccctaacagacaaatgggcagggtaaggacaccttcaagggacaacagggcactccaggatggttccccagtgatggggaagccctcacctcccacagacctgaagaagcaatggcttccaaggcatgcaggggatggaaagtgctaaaggcgcctgtggagaatggcaagcgtgccgggtttaatgagagatgtggggggggggggcgggggggctgtgggggagtgagtattaagggattgtattttagttatgccttgtgatgagcaagtaacacaaaaactataacaaaaggccaaatgtgttcatttctctaccagagtcaaaagtaaaagctactcgagaacagcaggagaggttctgtctggccggagccaggagagatgctttctgaaggaagagacattcaatatagtccttgaataaccacaaaacaacaacagctggcacttctgagcacttactagttgccaggcactattctaagtaattggtacatatgagctcattcatcctcacagccctattaaggggcactagggattggatttgacctctccaaatttatctgtggaagtcccaaccccagaaactccaaatgtgaccttctttgaaaatagggtctgtgcaactgtaactggttaaggtgaggtcattagggcgggtccctcctccgttgtgatgagggtccttctaagaagggggaaacttgggcacaggcttgcatacaggaagaatgtgaggatggaggcagagatcagggtgaagcctcacactctcgggattgccaaagatggccagcagccatgggaagcgaggagagaggcctggagcagaagaaaccaacctaacccacatctcaatctcagacctggcctccagaactgtgagacaacacattcctgttgtttaagctgctcagtgtgacactttgttacagcagcccccagaaactaatacaaaggggtcattatcattgttctcttacagatcaggaaacaggcacagaaagcttatatgcctaggacagtgatccagggcatggggtctggggccagactgcaggggggagccatgaacctgccatgtgttttccaggggcagagactgcaggcagggataccagctaggaatctgcaaggatgaggccagaaacaagggcaggagagggactggggggcagcgtggatgggaaagattgtagagctctgatcgccaagacttgaagacacatttgcttatacacagaaagatggaatccttcccagtgttttacagagccagcctaatcctcattccaaaacctaacaattcaagaaagaaaatagagattattctctttcacaattaaagatctctaaatcctaaacaggctactaggaaatcaaattcagtactatgctgaaaagataacgcaccatagcaaatgagcggttttatttcgggtgatgcaaggatagctcattatttagaaacttactaataccattcacatgaattggctaaagaaggaaaccaatgatcctcttgatacatctgtggaggcattcgataaaacacagagatagctgagaataaatagaaagaccctgacttaatgtgagggtgaatatccaccttcagctaatagtcaatgctgtcctgaaggtacagagaagaggcatccccataagagtaagaatcaaggattttaaatatcattactcatatttgataaccttctagctaatgctagaaggcaaggaacagaaataagaggtggaaataacaaaaaggaagagactaaaataaatgagcagaatgcataagaagaaatcctaaaacattgctatgacaataaaaataaatggagagaaatatgtattcctgggcaacaatgttgagtattgcaaaggcatcattttctccaaaatcataaatatactgaattcagttcccgtagtatgaattttggaactagataaagatgattctaacctgcatatagaagaataagcatgacagccagtgtgggtgaccaggtagcagggggtgcctgcctcagtcatgcacccagaaaacatggttcctcagcaaccttcaaccctggcccaaccctcgacatgaggccccgtggtccaggcttctgcatgtcatgtactgggacaccagctgtggctcacttgtgccccagagggggacttcctgtggcccagaaactaggaccctgctggcctgagcaaaccagcagacttctctgccattccaaaaggggcaaggacagccttctccaatgaggtctgagcccagcctggggaggggccttccagcttgtccttccttattttttctatcccagtcctagagtagcctatattttatagttaatctcttatcatcatcatcatttacattaaactttccttgtttaaatcactgtgcaatttgtgtctcccgattgtacccaaactagtacaacaggtaagtgtgttttgaaaacgaacaaggaatgactttacacaacaaaatttgtgtataatctatctatatgtatagattcaaattatatttgaataaaatactttcagaagtcaaatgtgtgtgtgtgtgtgtgtggtaattaagatagaggggattcgcaaggatatgaacagacaggtcattggaacaagatataaagtcaaggagaagaccaaataagaagaaagataacatttcaaatcagagttgaagggtgaattgtttattataacaatttgttttgagacaactagatagccatttacatagccatttaaaataaaattaattaacttaaatccctaacatatgactttctctgaatacattttaggcagtttaaatatgtaagtgtaaaaaatgaaactaaggaaatgctagaccacaatattacatggctacatgtctgtttccatggtaaaaaatgcctttccaaggatgaaaatgaaatatcttccttaaaagagactaaggaaaagattgatattcatgactacagaaacatttaaacttttccataaaattaaaaaatttcaaaagctaacttaaaatgcaaataacaaactacaaaaagtattgtggataaagttttaaaatttcaaatatctaaagaattcttataaatcaatcaagtatagctaatgtacccagtggaaaaatgggcaaagaatagatagtcacttcaatagctagtaattttttaaaaaacaaaaacagcataatctcattattcatcaaacaaatgcaacaacaaaggaatttcattttatgcttatcccataagcaaacctagaaaacaatagctggtgtgttggctcatatctgtaatcccagctctttgggaagctgaggcaggaggattgcttgagcccagaagttcaagcccagcctgggcaacaaagtgagactttgtctctacaaaaaatcaaaaataaatcagccaggtgtggtggctctcgcctatggtcccagcgacttaggaggttgagctgggagaatcacttgcgcccggaaggttgaagttgcagtgagctgtgatggtaccactgaattccgcggatcctctccctatagtgagtcgtattaacggccgcaaatttattagagc

SEQ ID NO: 899 - DNA, 29341 bp, Homo sapiens
  misc_feature (1)...(29341): n = A,T,C or G
acgattatttcacaattgatttatgttacatcggatcaagttgtataccttaaatatgtatgatttctaattatccactatacctcaaagttggaaaaaatgtacaaaaataagtaaacacattcagagagtgggggaagaaagaataaaacaagaggagaccctaagcagaggcctggaagaggggcctgcgctgtctgcagggaggagtgtcctggtgggatcggggtgctgtggggcagctctctggaggcactggtgtccaccgccgtcataagcgacatgcactgtgaggggagtgccagggcaatgccaggggatatgggcatgggccatgccaggcgacccctggtgggtgaggaaactgtgattaaatgaactggattcattaggagggtgcgtcttccagacagttgttaaacagaagccgtggtgcaaaccttcttctctgccaggcggccctggcttagtaaaggcatggtaccactttgtttttttggttttatgcagtgtgcattttccacagtggttaatcagattcctttttccatgctggccaatccctgttcccgcctccctgtcccgggagctttgcagcgggttccacattcacatgctgtgggcctcggactcaccgggcaggcctgggactgctgtttacagaagggccagcttgcaaggtgggtcactggctagtgtctggaactcagcttctgaaatgtcccctacactggatggaaacatcccctgactgataaaggcaggcctagcttgtgcacaccacacagctcacactgaacacctgctttccttccaggagtctggagcttcggtgggcacggtgcccgcgcaagcagcccccaggaaaagctctggacccaagtctcagtgggtttcccagagcagaagccgtgcgtttcttgtcgcacggagtggggctctgtgtggcccttcacgggagggagagagacagcatggagacacgtgcattctgttttcccctgtgaagaacggaaacccgtcttgttttcctccactcttcaggtgtcacagctcaaatgtggtttcttggcagccgccttccaggaccatctagaagagcccaagtcactgtccacctcatcacctggtcttcatgcagcgtctggatcagaggctccccacgtatcgtctgcccgccagcgggagctccgcacggtgccctgtctgtctctcagcgttgcaacctaggcagggcatgcagcctgggtgtcgtgagtgcctggagatgagcggcagagcgctcggaccctggtccctgcctgctggcctcccacagccacgaccacttaccccacccggcattctctctgatgcgtggaccaaaaggaaagggcatgggaaggcgtgggacgagcggagaggcaggagaatgttttttagcaagacacaagtggcatctccttattttaatgataaaaagcacccaaggtacttatatattctgataagaactaggggaaatttgcaaattatcttttttacagaattccaaagtgaggttcagacgctcatctcccctaatttttttttaaaccaacttcttaaacaggtgggcagacctggccatgaaacctgtctaacctctgcatcccacttaaccttcagccaggacgtagcacctccaccgaggtctgattaaaggacatctgtgatcgctctgcctgcgaccaagactaaatcccccagcacacacacagggggcttctccccacccggcctctaagcaggactgtgatgggcgagggctcatgttcaccactgcctttgctagaacagaggttccaagcacgtcccaacatcaccaacaagttactgagatgagaaggaaggaaaaacaacgaacacagagaaatgagcttcacagagctttggagtacccagccaagaaatccttgtggagtcgttgccagtgcagactctgcagccagactcctgggttcaaatcccagactgagcctccatcagcatctgtgtgacccacactagtgctttggtttttctcgcctgtaaaatgggcccattttacaggtgagaaaatgtgtgggtcccacatttgtggatgcccgtgaggtgctgagtgtaccgtgtgccccacggctgtgagcagccctgttctcatccttcccattgcagtggcgggtccctgtaccctctgccaggtgtcaccaaaccgatttcacctgtgcacaccctcgcaggcagccaacggccattctctccccaccacagccaaggcggaaggtccaggcgcttacctttgccgagggaggtggctaggccattcatgaactgtgggaaaggcttgctgggggccgtggagatgtccaggggggccaccgcgctgccacccagcaggtcaatcttgccagcgtgctgccggaacttctccaggtcccgggacagcaggttgaactgctcactttgagtccggcatttctcttccagctctcgaaccttggactgcacggcagaagcaggacagggggtcagcggtggcatttggtggtggaaatgtgtgtgcgcctgttcacatgtgttgtacgtgtgcacatgtgcactgtgtgcacgtgtgtacacacgtgttgtgtctgtgaaaatgcatgtgtggttgagtgtgtgcatatgagcatgtatcctgtgtgcacgtgtctgtgtgtgacatgtgcagcaggggccgcctcccactttcacgggagagcagtgcctgataaacccagcttctcctgccacctggctactggccaatgtgagaaaccacaggtgccaagaaatcctgcaaacactcagctcccagccaaccgtagattgttctgggctgtgcgtgcagcccgggcactttgcagttggcaggctttgctagagctgtttggaacttggagtatgaggctgtgatgcggcccagactcaggggagcagctcaggtgctgtcccatggatgcaaggatgcaattcttctcatccagggcgcccgccccctcggactgtagaacccttaagagcaccacttggagcaataaggactctctatctgctatgttcagttagcaacactgctgcatttgcagacaacacgaagccacgtcgggagccctggggaaggcaagcgtctcccccagggacacgcacaggaaaggggtagcccagcaaactccttcctcgggtcaggacaggcctgggctgtgtccagtctcgggacatctctgacccttgtgggcttcctcccaggtcagaggtgcatgggcaaagccccgctccctgctcccctgggacttgagctctacataagacatggcctcctgacataggtttctggcacccatcacagaaggtgcaggacagaggggtctacagaggacccactctaccttctcaccccgcgttcctttctccactgtgctgaccgccccccggcactgcagtagctcctgggctattcgtttcttgtcggtgtccacggctacactctcggccccaagcctctgctttctggctcaaggacacaccttcgatactctgcatggactcagcacccagcaggtgctcaaagagcgtttgctgaatcagtgaaaaaggcgagccctgagctgtgggcaccgtgctcctcgtggggatggcttgtcaggtctgcatgcaaagccgctttcttgccactccttactttaggatggccgggaacatcccatttatggggttattcatgtcatctgtggggctgacgacactgacgtttcccccagtgaaatgtcagccccatgagggcagggctttgtctgcctgtttcctgctgcgtcccggacctgagcaaagggctcagcaacggccccccacctccccctcccctcctccgcccctccttttcatccatcctctcccccactatccctccacaggcagcaggcttctcagctccttagtccagaatgaagcactatttatggctgagatcatggatttctaaaataaacctaacaaatccaaagcctataattaatttctttgattcattaaaagaaatcagcagtattcttctttaaaaagctgaatgggcttggccaagccggctgtgtctaccaagataggcatagagctaaaaacccaggggctctggggcctgacatggaaagcatcggagggaacccaagcccagggacagctccgaccccaaatgtggggtctgcaggtgggatgacgacttggcttcgcagggcttgcaggggctctgactctgctggttcagcccttaagacagagtgacgggccctgcagggcagccagggtcctggccagggaacagctgccactgcccgctgcaggcaaggccggaccccggaaggccctgagctcaactgtgtgagccaacgaacccccaggcacccatggggcactcgcggagccttcccagggtgtggagaaacaggagacatttaatagtcatgcattcattctaacatgtgacagggaacatgtaactggcacacccattccctaatgtcgtgtctatgaaaatgacctaactaaaataggccaggcacggtggctcacgcctgcaatcccagcactttgagaggccgaggtgggcggatcacctgagctcaggagttcgagaccagcctggccaacatggtgaaactcagtctctactaaaaatacaaaattagccgggcagggagacacgcgcctgtagtcccagctatttgggaggctgaggcaggagaatcacttgaacccgggaggcagaggttgtagtgagctgagatcgagcctctgcactccagcctgggcaacaagagtgacactctgtctcaaaaaaaaaaaaaaacaaaaaaaaagtgaatagacttttcatacaaaaatcttgaaatgataaaattatagcaataaagaacagatcagcggttgtcagggttttgggttaggggagggtgtgacgagggacggtgccatgagggagtttctctgggtgacagagccgtctgtacagctgatggtggtggtggtggtggttacgagaatctgtatataccaccaaatgccatacagctatatacgaaaaaaaaaaaagagtggatataaacactcgagaaagcaagtaaattccccagcatgctacagtgctgctcccacgccagcttcccggctttgagaacacactctggctacagagacaccaccaccgggaagcaggaagaggggccacgggaactccccctgctgtctttgtaaattcccgtgaccctaaaattacttcaaaataaagttttcagaaatgaagagattttaaacaataggaactaagaatacaggtggcatacagagatggtgaagataatgaaaggtaccaccccatcaagggggctaagggcggctgaggtcacaggagcctaaagcgggttctgcatctgatacacacctgccagcagcctgcaggctgcgggctgcctgcttttgtttgcaggaggacaggtcgtcgcaatacagagggaacagggcaggctgtctgctctcacatggttccatgggactcccagaaatgacggggggtggggggccaaggacgagggtgagccgagcagcagctgcatactctctgtggtttggtccccagggcctggcagggccactcccacgcctgtgtcctatgggggccatagtggcgcttcccaaggtcagccccttgccctggcccatcagtccatcctcaaccgttagttcacgacttggcacagggtggacatttaacagatatttgatggatcacaataagctgcgggtaaactaatctacgcacaggaactgtggagtacccttcagttagagatgaaccaggtcacctctgtccaagggagacagaaaacgggtggagaagcagccaccaggtggctcaccaaggaaccctgagacccctgcacaggggccgctgtgtcatcacaggcctgggtgttcatcagggccgggttccctctcccacggggaaccctcagctctaggtatcctgtgagtctgtgctccaggccccactctgtgcacagaggacgcaggcccctcggtaggctggaagtgccgtcagcagcagcaaagcggcgctcgcaggagcagccgtaatcatggtggcagtattggtattgatgagcagtactagtatcagtagtactggtattttcatcacctgcagtagtagaagtcttgctttggtattagagcattaacagcagtggtagcaatagcagtgttttttgtaggaatagcattggtatgagtagtggtatagtaacagtgctgttggtattagtattaatagcagcctagtattagcagcagcagcagcagcaatattggtattatttgtactagtagcaacagtatcattattactacctgcaagcgtactggcgttatccttcacagtcacagtttggtgttagtattagtagcagcagcagatgcaatattagcagcagcaacagcagggatattggtgttcttagagtggcagccagccactgtccttgcttcccccgcagattccccagggcctggcgccggggacatccaccgcgttctgagggggtgtcgggagcaggaggcccacgggcagcagtgacgggggagagccagctcgccttgagccccgtcccacagtcccctcacccaactgggctcactgcacaggagattccatgccctcctgtgacacaaagtcactcccttcttgaagcctgagaaacgcccccaggctcccagctgtcacctcctcccggagggtgtttctcctccaaggggccaccagatagggccagtggttcgccatccacaagggacccatccgcacgacccagctacttcctgccaggctccacccgtgacactaggggtcacatttccacatgagatgtggatgggaggatgccctagccacactgccctgcttctctcgaggcggctgcagagagcctggcccaggggttgtagggacgctggctctgcccagcccattcttgccaactgctccttacacctcggggggtcccggagtggacttgagtgctacagcaaatcaccgtgtggacacagtcctgcacgcagactggcaggggtgccagcaggggcaggggcagggtagacctgcaggaactcaggatggggtggtgagcagggcaaccagctctgtccaaaggggccggtgccctcggcccgggtgcagcccaccaaagacaaagctaaagcttctggtttcccaggagcagcagggcattgtcccctccacatctcatgttgaaaagctaaagcttctggtttcccaggagcagcagggcgtcgtcccctccacatctcatgttgaaatgtgacctccagtgttggaggcggggcctggcgggaggtgtctgggtcctgggggtggatccctcatgaatagcttggcgctgtccttgccataatgagcaggctaagttcacacaaggtctgcttgttgaaaagagcctggcacctcccataccctcctgctctcagcacacgacacgcctgatccccctttgccttctgccatgattgtaagtttcccaaggcctccccagaagccagcacaccccctgtacagcctacaggaccatcagccagtgactccttcataaatcaccttcataaaccttcataaatggcccagcctcaggcattcctttatagcaagaacggcctgacacacccagggaattttcaattcaccggaagtctcacattttaaaccctgctgagtatttcaaggcccatcagcagcctgggctgacaggcatgtctagagatggctgcaggctgtggctgctggccgtggtgctgctctgcacgacagcatggtgacactcccgcatcagcaggttgggtgtgtggggggtcaggttggatcaaatgccctcatggccctgtagatgcccccggctgtacccacataagcctccgacacacaggacgatccctcacttgctcctgggcctggggggttctggaacttagaatttgtgaccctctgcatgcctacatccacctgggcattgaacacgcacttacagacaagctgggcgatgcattgccataattgaggatcccacccaggggtggccagtgcagataccaggaaggccgcgctgccgcaagcctggagacagctgccccgaggatgcctgcccggctgcgtctccaccgaggcccaaggcacgctactcggcgtgaccataagcataagggatgggagaaacgggcattcgttggttaaagtgaagatatgtcacccagctcacacatcttagcactgcctcacctttgaacgagcagggtgtggactagtgaggccctgctcctgcggtctcaggcacagtgctcagagctgggtctctagctggtcctgtgtgtggacgctgactcgaggaatctggttgccctagtccctgtgcagttgacgtgctttccccgaatgagcatcatggggccaaagcgcaagcaccctcctagcagggcagagcgctggcaccacgtggagctcacagaccaggcatggaatgtaccctctcctgcctgcttgtccaccagcacgtgctccgtaaatgcttgtctgatgggagaatctgctgtgagacttgctttccttgtaacctacaatgaaggtgtggaacaggggcacagcctcccccacctcaaattcctaccaaggagaacctaagagtcctgcccgcccacatccagcttgtttgcacctttcctttaggctcctcgcctgagcacagctccctggcgtcttggcagcagggaaggctctcgtgactgccaggggggtccctgctggggctaagagcttccaattgcctatggggaggaattgccagcagcagccgcttccaaagcatgctgagagaaaagagcaacccgtggtcctgccccaggcaggcgcatttacacctcgatatttatttccggatacagagtgctgtcctgtctgggtttgggactgggcctgggtgtcaccccggctgcagggatgcagggacacacccagccccatggtgctgctcctccccatcccgaggccacctgctcggcgctagggtctgcagggcactgctcagaagcaactgagtccggaccaggcaggaacagatggcagagtcatcaggcaagtcaactgtaattggaacaaacagcagaggctcgcaaatgtggatgtggctatttctaaagacaagggggaagcatccaaagacacccccacagctcccccagctcctggctcagtgccctcctctggcttcccggcctctgtgaagaggggtgataagcaggcgctgtgctggcggctggcatccaaacggggtggttctgagagcaaggggccagatgcataatcactccagaatcataggcagaacccagggacggtccaggctcaccgggtcacttgacttagtgtcagaggcgttcaaaccacagcgactccatcttgaataggggctgggaaagatgaggctgagacctactgggctgcgttcccagatggtgaaggcattctaagtcacaggatgagataggagctcagcacaagatacaggtctcaaagaccctgctgataaaacagggcgcagtaaaggagccaccgagacccaccaaaaccaagatggcaaagagagtgaccgctggttgtcctcacagcacattacacgctcattataatgcattggctgctaaaagacactcccctcagcgccatgacagtttacagacgccaaggcagcatcaggaagttcccctacatggcttgaaaagggtggagccctcagttccgggaactgcccaccctcccccgacaaaaactcatgaacaatctaccccttttcagcatataatcaagaaacaaccacgaatagcccacactgctgctctgcctatggagtggccatccattcgtttcttcacttctctcacatactggctttcgccttcctctacggactcacccaaattctttcttgcgcaagatccaagaaccctctcttggggtctggatcgaggctgctttccggtaacattaggaaaatttggaaacaaattgtcccatgtgctgtctttatgtgatttcattgatcactggctgaatacctactatgtgccaggccctacgtgatttcattgatcactggctgaatacctgctatgtgccaggccctctgatttcatagctcactggctgaatacctactatgtgccaggccctacgtgatttcattgatcactggctgaatacctactatgtggcaggccctgcgtgatttcattgctcactggctgaatacctactatgtgcttggccctgcctgggggagtcatgcattgctgctgactcagagagacctccccggtaagttggtgttaggccattgcaccagggcagaagacgaggccaagagggacttgcggtcacacccccagtgggcagtaggacccacccaggtctctctggcctctgagtctctctgtccagggcccacctaagcccaagcctgtgccctcactcacccacacattcccctaacacactcactggcccaggggtcacccagcctctgaacaagagccaggcagggctggttccctgcaggccgagcaggcccagcgcctgggaccacagccctttagcttcaggggcccacagacatggttccattttagtttcttttaaaatcagaaaagaagtgaaaaagggtgagacatacatcatgcatccagcctgtgtaatactcatctttattccacaatagacgcaaaacacaactgttaggattattttatggaggaagggacgacccctaaaggcaaaggccacacagcccacaatcatccactgcaggcctgaggccagacgcctgcggggaggtagacctcagcctgcctgggaagcaagcacgctggccaccccgaaagtctcccagggaggaaggggggctgttcaggaaaaatagccgggctcctctgaggccgagacgaaccagggctgacatcacctgaggttcaatgcctcgctccaggaggagacacccaaggcgctgtggagagaaggcgagggactcccatcagggtgccctgaagaaccaccacagagctgccgacacgcacacgccaagcacacagcactggcacaggctcctcatgacgttcccctgaccaggaagcccagatcctcatctcttagcccagccacatggtgacaagcacaccagcccctagacttttctcaaagcacctgagagggtgttaccaggctgacttcctgcccttggggccatgccctggcacttgggagctgtgtgtcctcgggtaagtggctcattgtctctgtgccccgattgcctaatcagcaaaatgaggtgacagagaacctcaggcagtggtttcaggggttaaatatgactgtatttctcaagagcctggggtaaagcgacttcctgcattcctgccctctgctactgctgcgcacccagggaataccagcgggtgaagatggcccggccggcgcttcctcagtctggagctgccaacactgacttatgattcagcctccagtacgctctacaggcaggaccagggtcgctgtcccctctgcccccacccagcacctgcagggaggtcagagttctgagctgacaggaagctgtgctgtgcagcagccgtggaaggcctggactccggagccaaactcctgaggcttgaatgggattctgctcatgactatctgagaccctcaggcaggtcattcattaacctccctgtgtcttggtttcccccagacatgaagaagatcaagtgaaatgggcattatcttgtggatgtctcgatgtctctcctatgcactctcaggacacggcccagcacagggcacctgtttgaggtggtggtgttgctctcattgttttcttttgcttctctgttttgataggacgctaagtgccaaaggaattatttaactcctagcagctggaatctccctgctctcaggttcttaggtttacaaaaagaactgtcttgacaggcaagttcctgaaaacctctgttctgtgtttaaatcctgatgcacatctttgctaaaccccaaaactagctcagggtactcctgggacctcaggacttcacgcagagcaaccaagaaaaaagacacttccccattgccaccaaaacctcctggccattcattctttagagaacagggcccagaagtgtccatggcactggagttgtgtatgtggggaccgtgaaaggaaaataaatctcaggaccccacaatcaccaagccaaagggaagcatgaagctgggaaccgtgtcagcaaacctggcttccattgtgcttctaaataagatagccgcaaagattaaaaagctacctacctccctcagaatttgcacacacagagattccttgtggacctcaagatctttatcctaaaacagttccgctgaagttcacccaggcaatgtaaattgatcgtttatcttcacagggatgggacaaagaactcagctcctaaccctctgctcacccgagacaaaggtatatctgattgtttcttctgccctattatttatgcaaaaatgcagattcaatgagccagactaaggcacaaatgacaattcctctgcctccctctcacatggaaattgtgtattcagtgaaaggctcatcagagactcaaaagaatgcaaccctttgtctcttctctacctattgaaaccaccattgcaaaatgataactgagacagtgaaagagatctgacctaactccatcgtgcttctaacctccaagctgtccttgttcattcctgggtgtaggctgaacgaactctgtgaggagcttagtgtgtagtttagctttgaaacaaagaagataacagccctttcccaaaacaagcctccttccctgcctggaaataagactgcctttgcaggactaacaaattggccacaagactataaattattgtttaagagccatgcagctagaggctgaaagattctgaccctccccaaattgctcctggagataacatcactattgtaaaacctaagatcagttattgagatattttgtagaccctgccctctatggatgaactagctcatctggtcttgtggtccccacccaggaactgactcagtgcaagaggacagcttcgaccccctatgatttcatctccaacccagccaatcagcactcccaactcactggccccctagccaccacattatccttaaaaactccagtctccaaattctcaggaagactgattgagtagtaataaaactctggtttcctgtacagccagctctgcatgaattactctttctctattgcaacatccctgtcttaataaattggctgtatctaggcaacgggcaaggtgaacccactaggcggttacactatgacccagaagcccccgcttcaagttgtctcacctttccagaccgaaccaatgtacatcttatacttattgatgactcacatctctctaaaatgtataaaagcaagctgtacccagacagccttgggcacatgtcatcaagacctcccgaggctgtgtcacaggtgcgtccttaacattggccatgtcctgaattgattgagacccatctcagacacctttggttctccgtgtgctcaggcattttatgtaacatgtgttctggggtgtatcctatctaggcgccctctattgtatctggctgagcatggaagcaggctgcccagtggaatgttctgtctacagaaagtcacgaatatgccccattctccaaggacacaaacacctagacatgaaacccccactgcacaccacaggtggttctttgatgggtgagtgggtgggacttgacagccatggtttcttggtcaacagctgcagtgttgggatcaggttcccaaagtgctcaccctgcaaaggccagggcttcccagggaacgcactgctgaaaatactctctgcttcccaggagctggcctcacaggctccctaaacaatgcttctcagacctcagtggcatgagaaacatctggaagggtgattacagccaaccttgggcccctccctgaggggtttggattcagcaggtccgaggccgggcctgagaagccactttgctcacaagctcctgggcgctgctgctgccccggggaacccacttagagaaccacttgtccagaagtgggaaaggccgttccttccacgaactcaccatccaactcagaggcgtggaaaactttcaaaggcctgtctcgggggcaacccagcctctcctccaccccaggggaatagcaagggggtggtctttgacagagaggagcgcaggcagcctccctggcctgtgggaaggagcttgctgtccacacaacgcagaggcagaacggaaggttgtgaggctcaggcgtgcagcttgaattctgatgaccagtaaccgaattaaccgaattcagggttatccgctaggctctctcaacaactctggcccaaggatagaatcaacccacaatttctctcctctgcggtcatctgaaccccaggactgctctcccagcctgacagtcacagccttggcaggacgggaagagccatgtgtctgggcctgcgcagcacctcagcgagcatggcgttgcatttgacgcccggatgagggggaggccctgcttgtggagctcctcggagcagctcctcagctcccccaggctgaggaaccccgaccaccccccacctgcgtcagaagctgcagttcaggaagcagaggcaggtcagagcaggcccaggactcatggccgcgtccactcacgggaaaagcatcgccaagcacgccgggcagggaagatgctattctctagaatacctgcatgctgtccaaggtgttctgcgcgaagagcaaagcaagacagttacagaaagacgccgtatataaaagacacaattcccagcacatccgaattgccttgtttttcgaaccaaagcacgctgcgttgcgaccgtcaccacatttgaaagcatgcaccaccagcagcacggggtgacaggtgacagcgggatcatggtggagcagtccctcagaggcggattgaagccacacagggtcatgtcaatgggctccggggcaactggggagaggcaactaccttttctgccaggagacgatgcaaattaaagtgcggtggataactcaggccaaggaaagtgaattattttccagggagataaatggccatttggaggtctgtttctattctcccaggttatatattttcctatttgctattcatcacactcctccctccagatagtcattaactaatggaggctttcagaaaatccattttaatatataggatgataatgatgaaaccttttcctgtgggaggaatagactttaaaaggcaacgtaagagatgcacatagcccgttttaagtggctgctgctcccccagggacacaggacaaggtcattctgaagagggcagcctcatccaatattggcctcacttaagggaacattaccgggaggacgccaccccagggcagatcccctccgaggtaaatctctccttgagggggtggtgaattacacgatccttgacttcggcaggtgggggccccagctcactgtagcccagccactgtgcatgatggatgcagacagcagaggcctgagggggaccccatagccctccctgtctgcctggctactcactcccaaggaggctggcattggaccaggagccagggacaggggtggtcactcccaatacgccactcacgcaggtgggacgtagccgttgtttccttcccaaggccccagtgggaaacatctctgggaggcaggagaaggccactcatgtcgtgtttgcgaggaccacacccggggaagtgcctcagatggcgctgaggactctgattccccaggccctcctttctctgatcctacaaatgcctccccaggatgggtgtcataccttaaaaaggtaccccaaggcagttcatcagagaccaggatggcctccggaaggtccaccggcctttacccctggggaaattaattcacaagcaagcgagtgagccacgccccctcactttccacccaagaggagccaccagaggacagcagaccacatctgagacacacagttctgggtctggatgtgtggccaagggaaagctgcttaacctctctgtgcctcagtttccctgtaagaacggacctggtcctggcacctgtagtactggttgcttgtgaggatgacatgagaagacacatgaatggcatctagtaactggtgcaccaggcgcacttcataaacatcatctattatttctagcaggcatcagggcaactctccccaacgtcccccacccccgggcagaaagcaggggcacgctccttacctctagcagccgcactgcgccttcatgctccttcttagcctcaacctgagccttttttatgatgaaaagagagaaaagagtaaatgtccaaaggggaaagaagacaatcggatcaatgtctgaatcactgggggtgggggatcatttatttttattcctctaatagaggaattaaaattattcctacattcattatttaacttttatttgagtttcagaaatacatgtgcaggtttgctgtacagataaattgcacatccagggggtctgggacacagattatttcttcacccaggtgataagcttagtagcagaagcatccctccaatgcctctgacagcaccttcatctgcccaaacatccgacgaactgctttggaaacaaaacctaatcctgcagacttgactcccagtcagctctaggttccctgagacctcaccaggccctggaggaggggccggggctgggtcctgagcatgcaacaggccttggcacctgcagcctgtggcagggccgccctcttcaaagcactggcggcaaagccatctgggccccacagaataacttcacatgtttcactacagaaatgtctcgggatggctgctgcccaggcaaagggcagattcaagcacatctgagatggaacactatcatttcttgtcctcacaggcctggaagtcccagcatcaaacaccgttatttcttgtcctcacaggcccggaagtcccagcatcatcatgatggtaaggacctgtcgtgtttcaatggctttgatgttttgaaggtccttgtagccctcggcatagttccttgagtctcactaacttttctgcagacctaacgtttcaaaagacccatggaggcccctcactctgctccatctaagccaatgcccgttgtcccgtcacagtcgccaggggcctggacggcttattgctctgtgccccatctgacccagctagatgcccagcacttcggccacagggaatctgccctcccttctgtgagcgccatccccccagatgctcctgctgctcctgctgcagggcctgcccacctcctggatagcggatcctctgggtaacaggcctgttcctcaggcctcttcctccagcgtcaggagctcctctcctgggaagaacctctggactggctggggtctggacctcccctgtgccaagcacagtctgaaccctcagcgactggtgacctgggtggtgtggggcctacggagggcaatgggcctctgcctgagaatgctgcgggagagggaagcccctttctattggactttggcttgggaggaggtgaggctgcagccactttgccaccaggagggtcagggctggagtggctgggggtctccacagggaaaccaaggctgaagctgatccagaggagggcagagagcagccaagtcctggtgatgtcggggaggccttggattctactgggtctgaggccagcagatttgagccctggatctagccatgtctgaagccacattttcagtgatgggcacaaaaacaatttcctgtttgggttttctgtcgcttgaaaccaagagtgctaacgaacgtcatcgtcaactgtgaaagcatgggacacttcctaaagtgcggacactggaggttggttttctgaggctgtaatgagacagagaagaaaagacgaaccagggctcccgcntgcagcacagtccacattgtgcacccctcacactgacatcagcatctcccaaacattccccgtggagcaggaaaatgggggtttttaagaagcattattttctgacaccagagtgcacctagctcttaaaacgtggaacactaataaagaatccatatgctacgctgtgacttacatttacaattctcagtttctagagaaatatttcctctagctgcctggagaataattagtgatggacgattcaacatcataaataagcaagtgaacattatcttaacagtttctacttctcattctcaaaattccgtgcgctgaaaacagggaagagcttggcttccccagccaaggggaaatctgccattccctgggctaaaaatgaagagtcgtctgaggtttctgtagagttcattcatatgagttccattctcacatatttccaatgagagttttaagagctgggcaagtgactggaacacagcatgttaattacaccattctcaagttcagctcaaccgtcgaaggccgaaaactgttcctttcaaagcaaaaaccagcaagagcaacaataaatagcaaaatagaaaaagagacaaacaagcagggaacatacagggattatataaatgatgccaccattgactcagttgaatcaaagatagttttcaactggcaggattgaaaaaaaagacaaaacaaaaaatattccagcaggctgttaaaactcagccaagctggcagtacaacttcgcttccagcttcagatgaaaaccagtgcatttttgcaggtgcaaactgggccatttgggcaatcagaatagactgttgaaattggcagcgctgaattcttacaaaatccaagcaacagcttaagcgaggctcatttaggggccaacacagggaaagtgcgacctttacggagagtggttcctgcagagcagggagactggagctcccgacgctggaggaagaggcctgaggaacaggcctgttacccagaggatctgctctccgggaggtgggcaggccctgcggcaggagcagcagcagcatctggggggatggcgctcacagaagggagggcagattccctgtggccgaagtgctgggcatctagctaggttggatggggcacagagcaataggccgtccaggcccccggcgactgtgacgggacaacgggcattggcttagatggagcagagtgagggaggggcctcccgtgggcgttatgaaacgttagctctgcagaaaagtcagtgagactcaaggaactatgccgagggctacaaggaccttcaaaacaggagttccgcagagctgagggctgatggacattttctaatactccaggagcacacaggattagggcagacactgcctgaaactaacacagagggtcagctatgacccaccgcagccatccacacacaactgaggccgacaatctgagggcagcacagcaaattcagtcaaagcattaactatgcatcgggcggtgagctcagcttctcttagtatcacacgttacataatagccttaagactgaaagcggtcattctaccagtaagaggaactgtagaccgaagtaaaatcggtcaagtctgcggatgaattataaatacggaaaagccctttagctcacaccactggattatcataattgccacttgtcacaagacaaggatgtaacctacacaagaaactgaaagtctgaagcaacggagcgcagccggaccccaggctgaccattcacctggagaggaagcctcagggtttcagaatcgggtctcaagtggaccacgggcatgttagcctcagcctgcttatccgtcacatggagaaaacaatggtgccttccccccgcaggttacacgagggctgactattcattgattccctccacaggcatttactgaatgttaatgagaatttatcctcggtcatcttatctgcgggattttgaccctactgccccgactgacggaacctcgtcacatctccaattccttctgtgcccttgagcacctccgcccatccaggatttgctggggagctcctaggtgtcaggcgatgtcctacgagtccgacgcgcctttcacggagctgaagtgccaacaggtggaggtgggcagtcggcaaacagccacatgagcgagcaggcatgttttggcatcagtaaatggggcgacatgccctctgtctgggcatggagtggcgtctggtctgagggagactcagtgagagaaatgaaccagttctgcaacaacctggggaccaggcattgtcgataagggtccccaagaggggactggctttggcacggtccagggagaggaggaagcagctgcagcatggggagcgggaggagtggcagaggtggcacagctcaaaggaggccacgactgcactccgggtcccagcccggacacgctgcaccagcagatttgtgcccagagtcgcttctaccatcgtcatgaccattcacagcctgttctcacaccgtcccactccttgctgtgttgctgggacttcactgacatgagacgctccgtaaacgtctgttgagtgaatggacgcagggatttgtgaatgagctcttgctcccggtctccaggaagcacgcgtctcccgggagagcctgaggttaccagcagacagcgtgggtcctggcttggctgccttttgcctttttaaactgtgtctctgctcaggtcccagagacgagggctgcagcatgagctcattgtccctggattccgggaggagagccctgggcactttcatcactcattcgtcattcacccatttgtttatttctccgatttaacaaatgctttccctttcacatgatcttacgtgcttctcccgaccgccatgcagggcaggaggacaggtggagctgcctgggagaaaggtgcctctggacaaggtgctgggatgcaggcccctgatattagacgcctgaatgtccagcaccctctcaagggtggtcaggtctgggggtgaagctgatcccaccaaggaatctctaagtactgcacaatgtggcacaatccacctgtatttcaggaaaaataaactcctgcctcacattgcacatcaagaaaaacaacattataggatggaggaagctgaggatgaaagcacaaagaggcagggaggagacccgcagacggtggggaggggcatttccaggacctggactgaaggaagaggccaggggctccaggcgggcgtctccaaggggaaaatggaatcagaagccccccagaggactgagactctcttgagaggaattttacagcttcagcagggtattggggaacaaaggaatgatgggtacacagagaagtaagacaacaagcaaacaaaaaaggcaattaactccagggaaaggaagagctgtacaaaaacgggagatgctgccgtttacggagctcaaggagttcagcagaagtgcaggtgttggtgaggacagaggggagttctgtgtgggacgtggcgtccgaggccccccaagcagtggtgtcaagcagagggtgagtaaaggaattggggcacagtggcatcgtctggcttccgggtctaaacccgggagttaccacgcagaggtggtgctgaaacccatgcatctatgtgaggtcatgagacagtgagtatagactgagaagggatgtgacttcaggactgagtcttagagtcacctgtgatgtgtataggggctggtgtggagaaggaaaccaggagagggtggtatccttggaggccataagctcaaactgggcctccgggtcaaagaaaacgaggacagagaactacccactggaccgtaagctcatgcatgggtgacactaacaaaagccacttgttgggggtggggtcccgtgacggcaagttcaagaaagagctggggttgcagaaagagagaagagggtcactcctttgagatggctccacagccctctcatcagaatcacctttgggccttggagagtccaaagacgactggtgacttctatcttggtagggggatgagggccagtcttcagctaatccgtgcctcatggtgcaggcaccactgcctggtggggtaagcactccagctctgtgcctcaggcccaaattcaacccctgttccctccctggctgcaccccagctacccggccttcttcctcttccctggatgcgctgggctggttcccaagggggcctgtgtgtgctgctccctaacccttgcacactcctgccccagccctcggcgtggtgggtgtcatctgctccttgaactgtcacctgtatctaaagtcacggccccgtcaatccgccactcaagcctctcaactcccttcaccccttgccatcatctgggcttactcgctttttcactgacttgttcgtcttccttttttagcctgggagggcagagccgtgtcccactcgcagctgtgttcctgcttctggaacagcagctgagtggctgcttggaggggcagacggccgacccctgctgaatgacggtacgacggagctggtcacaagtgcagtgcaacgaccacccacgtggaaactgaatgcaaagatgagctctggaaagaagtcccggatctcattccactcaagagtcagacttcctcttctcatgcttaaaaactacatcaaagcctctagaaattacaaaattggcccattcatatttcatccagtttctctccctctgcccctcgccccactagtgaagcatcagtgtgtccaaaacagagacaatggtgagtgcggggggataaagaacgccaagagaactggacagcacacagaagagatcgtggacgcggaataacagagtcagttccaggtcattctccttggcatcaaatgcttagtaaatctaactccaggcttctagagaatgttctgttgagaggagacatcctttccccttcctggacagtctctgtgtttctacagacttatatctgtctcagacggtccccgcctggggacgtggcttctggagtgtgacgaataagtgcaggtgccatcaggcgtcacccggccacgggaaaggtccttgagacatggcaggagaacataagagtaatattcctgcccgtgtcccagcaatatcccttgcggataacatctaatgaaatattgctgctccgggtgcctgccaccttattatgacaggtaataagggctgtgaagttcccatcagcgctggcttaatgaaatctatccttaatacgatctcatgctaaatgcttagagaaatggcatcagaacttatctacctgtttccacaagctctgctaataaactctggaggagaaacgctgctccggcagattcctatcgccccccaggctgggtgaatgactgtgagccctttattttgagatccaagacctggataagctgtcggatggatcgaggggccacctagggcagaggagtggcccatcccagccagcaccgggcgggaggctgcagaccagccagctgcactctggccacaggggtggctgccctgccaggaggaggagagggcagggctgggtggggacactgggctctggaaggaaatgagatgagacctgttcacaggtccccaccttctgatttcttcctgggggcaccccaagcccataggctccgggagcaccaccctcctacctatctggagagagacagcaggaccgtggctgaggactggagtggggtgaggttacctttctcagtccccagacccatcacaggtgcccaggaggtaaaaatcccaaatcactcagtccttccttccctccttccctggtgcctctctcctttctctcctgatttcttttcctttctgtcttactcatcttgcctttttcctttcttactgggatccggctataaatattgctctgcaactcagttttctcacttgataacacatcatgcaacagcctcaagacagcagaatcaaaccaccatgatccttttcgctgacatcacacggcgcctggtgtggatggaccatggtgcacacagccatcacccttaggtgggcatcaattgggtccagtccctgtccccactgccacacagcagcactgcaagaaaacaaaactccttttgaactggttcctgtactccttgcagggcatcgtccaggatgggggtggcagggtcaccttctgtgtgcccttttagtttaaacggatgctgcacactgctttttccagaagcggaagcaattcacaccctgccagccatctctacgcatgtgtttttcccgacaacctcaccagcatcagaggttagagctttgcatctgctttcgcgttataaaacatgaacacaggtctacttaagaaacaccacagcaggaaagcagaaatgactctgaattcttctgtgcaagcagagagagggagcggcctgggagccaaggccgcaggtcggccgctccaccacaccagggatccccggcccacccgtggactccctgcctcgcacgccgcgcccggctgcccgccgcttaccttctgcagaaggtcaatttcctgctgcttggcactgagaacagccagggcctggtcatgctccaactgcagctgctgccgccgttcagccgcctctcgcatatgctgtggggacagagagaggcctggctgagcagggcagcctgtgcccatgggcgtgcatcctataccctgcaccaagctggctctgactcagcccggtcactccagagcagcccctcaccgccccacagggcacccacctccgtgctgccaacagggctcctccagaggcggcactcccaatgcgggagctatgacataaacaagccccccacctgccacttctcctctgcaggttccaaatgcagcgagcatttgagcagaactctgtcctcatgcaaatgtgactttcgtctttttgcttgttttgaaaaagtgaatctccctcctgtgccttttttgcccaggtcctttgtatataacagcaaaggcttattgatgctgccctgtgtgcccagcactggttcagggttttatctgcatttaagtcatatcatccccatcataagcctaggaggtaggttctagaagtagcctcattctacagagagggaaactgaggcacaggatgtcatccttgcccatcgggcagctgggaagtggacgcctgttcagaatgcaaacccagagtccgcaccctcccgggagcttcccggcctcgggccgagtccgcaccctcccgggagcttcccgacctcgggctctggtcctgactgccgactccagtgaaccagcgcactcagacccaggagtccaaattccttcacttacccctctgggaaagtcgcaaggtggcccccatcagccaggcccattttctgcagcagagaggacagagccgggttcctggctctgtcctctccccctgacaatccgtctgtcctgcttggaggggcggtgcttaatccccagtgctcagggtttaactctcacctatttgccctctgcgggcccttccctcccctctgacgggtctcacgagcccagagtcaccactgggaccctgacagtgaggaccaggcccccagacccatgaagctcacagcagtgaccagccacgaaccctggcagcctgcaggaggaaacacatgggaaatgacattgggtagaaatggccacagcgggcgggtgggtagtcacactgggaacagtcacagaaaacatttcctggggtccccaagccactcctgggggcttggaaaaccagctgcaaaatgctagaatttcattgtcatttcctttcatacacacacacacacacacacacacacacacacacacacctgtggtaacttcgtggtcaacattttaaaatctgggtcttttatataaaagaccagattccttcaaaaatgggaagagttggccacgcatgcctccaggaaaggactgagaagggagtgggagctgccccttccgatggcatatacccccgatgtctgcggccccacgggcctgccccccatgtcccctgacatccgagggccacacagatgacccaggtcctaaagcaagtgggtgtcttggccccagcgagccatggggggacccacacgccttcctcctgngctggaactggttggtcatttattttttattattttattattgtacaattccattgatttttagccttttactcatttttatttatttttatttttttgagatggagtcttgctctgtcacccaggctggagtacagtggcaggatcttggctcactgcagcctccacctcctgggttcaagctactctcgtgcttcagcctccctagtagctgggattacaggtgcccaccaccatgctgggctaatttttgtatttttagtagatacagggttttgccatgttggccaggctggtctggaactcctgacctcaggcgatccgcctgcctcggcctcccaaagtgctgggattacaggcgtgagccaccgcgcccgaccaccttttactcatttttatttagttttggagtcttaaaggcctgtagccttcgcaagtcatgaggtcggacacacgcgtccaagagaaggttaacgtggtttcctgaggccgctgccaactcagcctgagctggaaagaggagcctggcaggggggaggcgagggagtccctgctgagactggcaagctgtgagggcggggggcacccaggctcagggggaggggtgtggcccctcgggaggaggcaggtggtgagggcgggggcacccaggctcagggggaggggtgtggccccgcaggaggaggcagacaggctgattacattcttcttgccagttttccaaaggtagccctactgctaccttttttgctgcctctgaaagctcctttcttctgggaaagatcttgaaacagaaccactttaactgagggtggggaaagcctccacttttcattctgcaaagcgctgtggttggtgggatattttgtttgtgtttaaaaagtgaagtcttcctcccggcccgtgtttcaggcacggcaacctcacgtgctggttcatctacatttttaagctgaataaactcggcatcctctctgctgtctccagaagaggctcccagtgaactcagaagctggaattaccctgcacccccacagacatctgggggtttcactgttgctatgggaactctcacaagaacccgggatccggagaaaatggagttccccaaaacatgaacaaaaccccatgaaacacgggtgtcgcggtcagtggccctcgccagttcactctggggccagatgggccccagggaaacaccatgcttgtatcttcccacgtttactccagctctgagcctgggcaggcctggccctcctgggaagaagccctgggtatttgctgcacagccctcccgagatccgccctgacacactgctccccccgccccgctgggctgtcagcccatttgggcctcgccatttctaacggtctctttccaagagcctcagtttccccccgaccccccaagccgccaccaccaccaccacccaccgcccaccaccagttcactgtgagtgcaaaccagctgcatacattgcagggcatttttaggaggacggggacaagccaccaagacaaactgacagagccctgggggatgcaggggattccccgagctcctgagacgctttgggaactcttctccaaaccctggctgccacctcagtgcggtgtggctttgctctggtgtcaggtttccccatgagggtcccagaggtcctcaggacggacagtctctgcagaccctcatgaggccctccgtgtggggcttccagctccagagaggactatttctactccatttattcattcattgcttcttctggatattggttcatcggactggatttattgagcacctactaggtgccaagaagctggggacacagaacaggacaaacgtgtcttcatgagagaacaccccagagtgggggcacagtgtgaaggcagatcgatgaaacgagaagggcccgagtgtggcacggagcaggatggaggcacctaaatgacatctgtggtcctggacttcaggagtggccatttcctacatcctaacaccagcctcaatctgatacgaggaggagatttcagccagattccaccaggagaactcgctcactcaactcactcaacaaatacttacccaagcacttgttttgtgccaggcaccctgctggcttctgaaggctacagcaacgcaaaacaaagcaaaacaaaaccagctctcttggagctcacattctgcaggggagggggcacacctcatcccaatacacccattgtgtgtgtacatgtgtcagattctgcaggggagggggcagacctcatcccaatacacccattgtgtgtgtacatgtgtcagattctgcaggggagggggcagacctcatccaaatacacccattgtgtgtgtacatgtgtcagattctgcaggggagggggcacacctcatccaaatacacccattgtgtgtgtacatgtgtcagattctgcaggggagggggcagacctcatccaattacacccattgtgtgtgtacatgtgtcagattctgcaggggagggggcagacctcatccaaatacacccactgtgtgtgtacatgtgtcagattctgcaggggagggggcacacctcatccaaatacacccattgtgtgtgtacatgtgtcagattctgcaggggagggggcagacctcatccaaatacacccactgtgtgtgtacatgtgtcagattctgcaggggagggggcagacctcatccaaatacacccactgtgtgtgtacatgtgtcagattctgcaggggagggggcagacctcatccaaatacgccgattgtgtgtgtacacgggtcagcagtcctaagcaccatggggtcaggcggtcctaagtccacaaatgcacgcacctactatgcagccacaaaaattgtaaaaaattaaaaataaataaataaaaggggagaaacagaaaaaataaactgctaaaaatatacttttactttttataaacaaaggggtcttcaccacggggcgtcaaggatcagcgcgggcttcatnntgtgggtcat

SEQ ID NO: 900 - DNA, 735 bp, Homo sapiens
tcaagccccgtggtgaagacaaaaccactaatttacttaaacccttatattctcttacctgctgcagactagactgttctaccctcaaatccgttgtgaaaacacttcaataagtaaactccttcccctataccaacagtccccaaccagggactcgttttgtggaggacaatttttccatggacgggcagtcgggtgcggcgatggcttctggatgaaactgttccacttcagatcatcaggcattagagtcccataagaagtgcgcaacctagatctttcgcatgcgcagttcacaatagggtttgtgctatgaaaagctaatgcagcctctgataggaggcggggctccggcagtcatgctcactaaaccgccactcgcctcctgccatgcaccccagttcctaacaggccacagactggtaccagtctgaagcgtgggggttggggaccacctgccctatgtgatacaatccaagtttttaatggggtcctcaaagccctctatgatcttaggcctacggctctagcctcattttttaatatacctctactatcaccattaaactcaacattttagcaaccctaaagtgcccaaagttcaccacatgaggtcatttcaagcctctcaaatttgcacgttacttctttttcctaggctggttttaatcctttgtctactttaggtttgtcatctttcaaacctaaggttaagaatctcttaatcattgaagc

SEQ ID NO: 901 - DNA, 1587 bp, Homo sapiens
  misc_feature (1)...(1587): n = A,T,C or G
attgcatggcgcggctccttccagccccgcggtgaagacaaatattaaaaagtggtgattttaaaaatcaccatagaaattacttacagtgataaaatagcatgggcaattttatgccaataaatttgaaaaattagattaaaaacaattatctaggaaaggtatctaaaacagaatacgaactaaaaaacctaatcaatgagactttttaaaaaattgggtcagggccgggtgcggtggctcacgcttgtaatctcagcgctttgggaggccgaggcaggctgatcacctgaggtcgggagttccagaccagcctgaccaacatggagaaaccccatctccactaaaaatacagaattagctgggcgtggtggctcatgtctgtaatcccggcaactcacaagactgaggcagaagaatcacttgaacccgggaggcggaggttgctgtgagccaagatggcgccattgcactccagcctgngcaacaaagagcgaaactctgtctcaaaaaaaaaaaaaaaaaaaattgagtcagaagttaaatgcgtactaaatattttaagaccaaatagcaccaaacttttggaggcgggcggngggcggtgaggggtggtgacctgttttacagaatagaagagagactgtgctgtccaaattattcatgaagcttgtaaaatcttgttagtataacgggcaaggatagtacacanaaagattaaaacacaatcttgtgagcataggtgaagtcaaagggaaacagcctattgaatacaccagagtattaaagaaataaaccatatcngcattcaccacatatanggcataggtgaaaaaaacgaaggtgggagtcactcattactagttaaagaattaaaaaaggttgtggcacaaggcggcaccctttancccttccggttgctaaagaaggggggaaaagcattcccggcccccanatttctggtgagaaccaaaaaaaacggagccctcttccccgcgcgccgcgggcaactatatttgggtctaattatcaaggaagaaggaaagatcctcttggaggaagacctcccccccgcccgccccggggtgttttttttaggaatctgggcgcgaaatacacgagaaaattatcggggggtttcccgagaaaagggcgggaaaacccactcttttctttctctctttgttctctctgggggggggggggggagaggggaggggattcctcacataagacttgtgtccccccccctgggggcgtggtgtgngnnncccccctnnnnccccccccccaaccaatatattccccgcaaaatttgtagaccacacaatagagggngntattancctctcncccccccnnngggggagctctcccacaananaaaaaccccccccccactacctcgggaggcntccttctattttttttctcgtagaaatatttttctcccacaccacacattataggataacaccccccccccactcttgaaagaaagaccctcccgccggtttcagacgacatctatatactaacaccatcccttacttgnccnnnccccnnctctataattacatctctccg

SEQ ID NO: 902 - DNA, 1535 bp, Homo sapiens
  misc_feature (1)...(1535): n = A,T,C or G
cggccccccaatgacgcccgcgcgtattgatccccgcgctggtgaagacccacccggctcccctgcccgccggcttccagctgccattccctgcaatttggttcccatccttcatgcctggggggtggtcacagtgctaccaccttgtcacagccactcgaccacctgcctgacccatagttttgtcaccggaaactgaccttgaccgcgggtattggtggctttaggcactgcagctcacacctcacacttactaactactggagaagccccgaatccttttctcctgcctcattaagaagcccactgcgtgggtggggctggcacctggcattcgcagtggctactcactcaagggatgagtccgctgaggggttggacgacgaggctttgtggtggccacggtgcgaccctccctttcctggagcacaggctttgggggggaaaggctgggtgcccctggactctgggcacccactcctgttgccaaaatcttatgacgcttgagccttctgtggcttcccactgtgttctaaataccaaacctgtaaagcggcttataaaaaacccacacacctgcttgagagcctgcacctgcgcactccaccgtccttcctgctctccaggggcgcttccccctgagggtctttcctggacttcagctgccttcttatcaggcctcagacangcccctgcgatgctccaaagcctcagctgtccgtcctacactcactgtggcgctcagcctcatcccaagaacttgactgctgctccccagcgaaggctcatgagcanagccactgcacatcgcacgtgttctctgacacactgactgacagatgactactgtcacataccgagactgggataccgatggttctgtttgctctcatgagggactgaacccactatcaagtgctttcacgcttgactactcagcatacgcccacactgcgttgacatttaatgagtatccgcagcttccgctgtccatgttttttatctggccaggacagcnaatatgataaacatgttcctccttccactccagagtaggataacctttacccgagaagtgaggacaacggccctcttcccggaacacgcctaaataattttacaaaaaaaataaagtgggcaccggaaaccctctccaaccccctgggnnnaccngggtttcccccccnccctctaccttctttttattataaaaaacaggcgcgttagggagatantttccgntttttttttanaaaaaataaaaaaaaagaaggagagtgctcttccgccccctgatttttttatttttctgatagagagggggggggaggggagcactctttaacactcgagtatatatagaagccncnnnccctnnntnnnnntntgacgttactgtctgccncnnnnnnnntaatgnannnnctannntnnnnatatctttatgatttatcggtcctatatcgtcgtgtctctcgctttctcgcgtggtcaactatgttgagtctactcattttcatgcgctnttttggccc

SEQ ID NO: 903 - DNA, 809 bp, Homo sapiens
gaagacaggggcggagagactcgaactcccaacacccggttttggagaccggtgctctaccaattgaactacgcccctaattagggtggcggaacggacgggactcgaacccgcgaccccctgcgtgacaggcaggtattctaaccgactgaactaccgctccaccgaattcttttacaaccaccggttttatgaccggcttactgcttaatttgatgcctggcagttccctactctcgcatggggagaccccacactaccatcggcgctacggcgtttcacttctgagttcggcatggggtcaggtgggaccaccgcgctacggccgccaggcaaattctgtttcatcagaccgcttctgcgttctgatttaatctgtatcaggctgaaaatcttctctcatccgccaaaacatcttcggcgttgtaaggttaagcctcacggttcattagtaccggttagctcaacgcatcgctgcgcttacacacccggcctatcaacgtcgtcgtcttcaacgttccttcaggactctcaaggagtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcgtcttc

SEQ ID NO: 904 - DNA, 1932 bp, Homo sapiens
  misc_feature (1)...(1932): n = A,T,C or G
gaagacaagcgcgtgctaatctcgcacttgcagaagcggtaagcgcccaacaaaacgtagaaaccactcgccagactgccgaagccgatcgtgctggacaagttgcacctaatcgctgacgcgcacgatgcagaaaccaaagcggttgaactgaccgtgcgggcgaaagcagaaaaagaagccgcagagatgcacgcggcggctatcgttgagttagccgaagctacacgtaaaaagggtctggcggaagcagaagcacaacttgcgctgaacgatgctatcaacgtactttctgatgaacaaaccagccttaaattcaaactggcctagttgcaggcgctgcctgcggtaatagagaaatccgttgagccgatgaagtcaatcgacggtatcaagattattcaggtcgatggtctgaatcgtggcggcgctgcgggtgatgcaaacacgggtaatgtggggggcggaaacctggcggaacaagcattatcagccgctctctcttaccgcacacaggcaccgctgattgactccttgctcaatgaaattggcgtttcaggcggctcactggcggcattgacttcacccttaacctcaacaactcccgtcgaagaaaaagcagagtaaaccctcttccaggaataatccctggcccaaaaagccggggattttttatatctgcgttccgctaaaaagtgcaaatgatcaggttgttgcagcattttgcgtgacggctcggggaaggcaaaactgcatcagagaaagcattgcgtggggtctggcgctcatcaacaatcggggagtcagcagggggctgaaacgggaaagcccctcccgaagaagggggccttacagaaggaaagggttatgatgaagctcgtcatcatactgattgtgttgttactcgtaagtttcgcagcttattaacagccaatcagaggggggagaaatcctccctcacccttgttcctttactttaggttgaaaaaaaatcagcgtcaagaaggtttcattaacacatatccctggcccanaaagccggngattntttatatctgcgttccgctaaaaggtgcanatgctcangacgttgcagcgttntgcgtgaccgctcggngaaggcanaattgcctctgggaaagcattgcgcggngtccggcgctcatcaacaatcggngggcagcaaggggctgaaacggaaaagcccntccgagaaggggccctgtatangaaagggtatgatgaagctcgcatcatactggtgggttgtactggtaggttnccgactactaacactcatcagaagggggagaaatcctccctacccttgtccttnactctagggngaaaaaccacagcgttaatagccctgcatgtacaaacgagactgggacccgtttccggtagcctttttatcccgtggacttctggaagagtggccgcgacaaccgcttaaggtggcccaacctttgccacgtggccaaatttttactcgggattttttggtatagcgccgctttacccaatatggaaaaccgggaaaaacctggggggcttttaaaaactaacaggaacgttagggccccaaattttactgtgaggttacgggggaaccctcttcgcttgggggaggggggagaaaaaaagacacactttgtgttttttttaataaaaaaacgcggggggagaaaacggtatcttccctccccggcgcgcattttgtccaccaggtgcccgaaattataaggagagggggncccccccccgaaaatttttatacggttgtgcgcccggccaaattttttgtatagttttgcgctaataaaaaaaaaatctactttttataatataggaagagggaaagtatatttcttgcttgnccgcataancccaaaaagaaagggaatcaatcacgcgaacccnnncccgccg

SEQ ID NO: 905 - DNA, 1656 bp, Homo sapiens
gaagactcaccatagtattccttctacttttgtatatgtttacagtttcccaaacaaacaaaaatgaggtgactttgaatctagaacctaaagttcctggcagagcagggaggtgtgagatgccctgagagccatgtggcacctccagggtggggtgaagcacttttatggcccggggctcagggccacaagggccgtctgcagctcactttcagctctccacccctcctccccaccccctccatgggtatttgggtgaatgcacagtcagtcaatgacttaaagcggtgatgcttcactccatcattcctggccctgcgcctctgagaccgcacagctgagaagacaaggcagatagccatagggaagcagtgagaccccgtgcccagctagtgggatttaatgcccaagtgagcacttggagacagggagggagcaggctgtgggcccgagaggcggggctggcacgcacaggggagtagatcctctttctaagagagggggtcccccgcaaggggagtctgtgggacctggccacctggcctgcatggctggtggggctccgcagcacagctcctccccgcatcccatcttcccccagggtagagtgtgcttgttagagcagggtgtgtggaatcacagtcacaggccgttttctgctctgccgtccctgcgagtgatccctgcactgtgtttcagcctcctcactggcaacatggggaccataaaattaatgagaacatgtgtgtagagtatttcaaattgccaactcttgtgagctggaagtaaaggacggctcttactctttttaagagggtcaacatggtaatagtacagttgttaagatgggaagttttgtaaagtcagacctggcgtcagctactggttcggcaccgcttagctctgagaccataaccattgagcatgtgttctactctgaaatagcgatgccagcacctgcctcatggtggggactagggggtgtggtaccaggaagattgacagataacgcacctggtctgactcctgcagaccctgggaaccgacactcaatatccttcagccattctgttttggtttttggagtggtgtgggatcctggagaagagtgttaaactatgtgggtctatcttaatgttagtttctgctgcttgtcggttgatcgccatttcgtcatttcttttcttttctattttatttttttgagacagagtcttgctctgtcacccaggctggagtgcagtggcgcgatctcggctcactgcaagctccacctcccgggttcatgccattttcctgcctcagcctcccgagtagctgggactacaggtgcccactactgcgcccggctaattttttttgtatttttagtagagacagggtttcaccgtgttagccaggatggtctcaatctcctgatctcgtgatccacccgcctcggcctcccaaagttctgggattacaggtgtgagccaccgcgcccggcccattttgtctctgaagtgctgctttgcttagaattacgagtgtacaggctgggcgaagtggctcatgcctgtaatcccagcaatttgggagggtgaggcgggcgtcttcaccacggggctggaaggatccgcgggggctcaaagtttgtttgtttttcaatttttttct

SEQ ID NO: 906 - DNA, 2067 bp, Homo sapiens
ttgagctcgcgtgacgccagcgcggatccttccagccacgtggtgaagactatggatgggggtgtagtcatggacgtgagtatagatatggatgtgggtgtagatatggatgtggacgtaggcacagatgtggatgtaggcatggatacagacgtagacatgtatgtacatgtaggcatggatgtggatggaggcgtggacatggatggaggtatggatatggaggtattcatggatatatgtatggatatgggtatataaatgtagatgtggatccagataggagatttctttttgcgattggctcatgtgattagaagctgtcaagtctgaaatctgcaggacaggccaacgggctggaaacccaggctgaggctgaggctaaagtcttggggcagaatgtctccttccttcagctgactgggtgaggcccactcacgctgtggagggcatttgcccttactaaaagtcaggtgacggggcacatccaccatgtccacagaataccttcccgggagcactgagattcatgtgtgtttacataattgggtgccatggcctagccaagctgacacctaaagccaaccaccacagcccacacaaccaccacagcccacacaaccaccacagccctgccaaccaccacagcccacacaagcaccacagccctgccaagcgagcccagccctgtctctttacccctcttccctggtgccagcattgcctgctgtggggagcaaaaccacaaccagcctatgaagggctgagcagggcgctgacagaggaccctggtccggcccctgctaaagcctcagcccacagcagggtgcagcttagaggggagtgaagtggaaagctacactgagagcgcagctcattgcctgggactgcatgggcagaggttcctcatctaaaaatactcacgagccaccccctttcggtgcagggaagggaagtgggtcccactgaaggaggctgaaagggcaaggggagatgtggttatcgccgtgaaagtctcctgggtccaacacaccctcccagttcacgctcattccctttggagggactgagtcacctccccagacaccccaaagatatgggaataaagtggttatatcagaaaaggagatctctccagcgacaggggtatctctcagtgtgacttcttggagtcaaggttttctggaagctgagagtgtgtctgcccctccagggctgcctccaccccaagaggacctcgtggacgtggtgcctcaggctccaccatccccaggagaagaagtgggtgtttgacatttcctgctccacccctgcaggccagatctgagggcggctgcacctcctgctccctcggcagcccctcgagtacctgtgtcctcccctgtcctcggccctactctgtgggcctccggggaccataccctctctggtccccacaggcttggggcgaggcgaccacttgccactttgctggtcccaggatgcatcccatccatgagagtccccttaaccttgacctttggaaagagccccatcacttttctttccattaaccccatgtaaggaatgtgaaattcctttgctaggcaacacggaaagcctcgatcggatcctgtcgtcgcggctgcctaaaggcccgggtgaccggttcccaagggggcttaggaatacaaagggaaagccccaacggggcccgtggccaagaatttcacctttctttcccaggctgcgtcccgttaactaggaccagccaacaggctgacaacctttgggagtgcttcggaaggtgccaataagtgcccaagcctgggaattggaatttgggggaaattggggacgaaggggtggccagcacccttccccgtgagtagcatctctggggggccggctcctaatacggcgcaatataccggacggaggcagttgtcgcacaaggagtatcggcgagaagcgcttgacaactgggtgaaaagaaaactgggaaagaatctctaatatgtcgcaccgcgggtggtaaattggtccgccccttaggtgtgaaacggacgcgacccggaggggcagccg

SEQ ID NO: 907 - DNA, 2016 bp, Homo sapiens
  misc_feature (1)...(2016): n = A,T,C or G
agtgcgcgaccttctgccccgcgtgaagactcatcgtaggagaagagctggctgttattggtgtcgagcaacatttggcgataatcggcaatatcgatccctaaacgttccgctacctcagtttccgtggcgttgcggccaagttcctgctccagttgccctattgcctgtgccacttcacgcgcgttgcgtcgcacgctgcgcggcacccagtcacggctgcgaagttcatccagcatagcgccacggatacgctgcactgcgtaagttgtaaatgccgttccttgtagggcgtcatagcgttcgacggcattaagtaacccaatgccgcccgcctgtagcagatcgtcaagttccacgctcgcgggcagtcgaacctgcaggcgcaatgcttcgtgacgcaccagcgggacataacgctgccacagcgagtgtttatccattacaccttcagcggtatagagtgaattcacgataaacagccctgcgttatatgagttatcggcatgattatccgtttctgcagggtttttaatcggacgattagtgggtgaaatgaggggttatttgggggttacaggtaaattccaggcagaaaaaaaccccgccggtggcggngaagcacgttgctggcaaattgcgctttgttcatgccggatgcggcgtgaacgccttatccggcctacatgtcgcacgaaccatgaaggcccgataagcgcagcgcatcgggcaatttagcatttggcatcagagctggttcaccccatcaagaacatccctgtcctgattccttaatgaaaaactactcttcttccaccgctaactgcgcgaagccgccatttccttcccagccttccagtcgttgataaacggtttctaccgcatctttaatcggctgggtcatcgggtagtaaaagccgacgatatccggctgaatgccgaggaaaatcacttcgccaatatcttctttcaactggtcgataaggtaattcaacggcatgttatgggtagtcatcataaacatctcggcgatatcatccgggtcgatgatgcggatctcgccggggtttagccccatatccgtggcgtcgacaatcagcagtcgtgtcgggcgcagttcacggatagcgacgatgtcgttttccggtgcgctaccgccgtcaatcaccacccagttacctttcggcgcggcggcgcacttttccgccagcagcggacctgcgccatcatcgcccatcatgctattgccaacacagagtnaaacgtcagtcacgcagtcttctcaccatcaaatagnatgcgttnntctgatgaatatcatgcagcatacttaacagcattgtacttcattactgctgctgcaagttgcgctgccgggctttatcgatgcgttgccacaatcgcacatggttatgcgatgagatctcacatattcgcacgccttcatttgcgcggcttactgctgcctcgagtgcaatcatgcagatttcatccacggcagtgacgcctttcagcatcgataacccagtgtgacaatcgcagttgattgacactgtggcttccggcntgatgtttcatataattacgtagtgctgaccacttctctggtacgccttacactgataagttgaatgntaaacgatgtccttcaacagggacgtgttttcccccccccaagggtgtgaattaaagaaaaacacagttttttttttcgggggattttaatatcttgttttttccccgggtgtttttagccaccacaacggggggggggatttataattttttcccccaaaaaaactctcaaaaatttgtccccccgagtgtggccaaataaagatataaaaaaaatccccctattttttctgccgggggattttanaacacatgggggggagagtggcttggannnnnaanggantcgtaaacnnnnnnnnnnnnnnnnnnnnnnnnnnnnnnancnnnnnnnnannnnnaaanngannngcanggcannncgnnnnnaannggcgaccc

SEQ ID NO: 908 - DNA, 2234 bp, Homo sapiens
  misc_feature (1)...(2234): n = A,T,C or G
atggaacattggcgcggccccttccagccccgtggtgaagacgtatctatatctgtattcatatccatatctgtatctataccaatatctatgtccacatccatatctatgcctaaatctgtacccatatctgtatccatatccatctagatccatattcctatctgtatctatacccatattcatgtccatatccatacctctctctatatcaatatccatatccatattcatccattcccgtgcttatgtccacttccatatccacgcatgtcctgttactctgcttccctggggacccctggctgaaacaggaggcttctattgaactcactggatgtggcaaattaagaaaggtttctcttgttctggggtcttaggtgacccctgctggtcccctctgttggtgatttccttgaccctggggtgctgccctctctgcagcgtcagcctctactggttcttgaagagaagcagcaggccagccccatccctctggatttatatgtgggggcagatctctcggtcatgggtctctcaggtgctagcaccacagcatggagttatctgagttgtcatctcagagcaggaactcatcaccaaggagagagtgccaagccatgcatgaggaatccactgccatgatccaacacctcccatcaggccccacctccaacactggggaccacatttcaacatgagatttggaggggacacacatccaaaccacatcaccacacagttgtggtgataagatataaaatctatcatggcaaaggcaaaaaataaaaagaaatgaagttgagtttaacaatcagtggtaagtggcagttataaccactgtgtcttctgtctcatagtggaacaccgaggcatggggcagcttcccatcaccttacctttgatgatggtacctcttagctttcttcttggggcctccgtctctccatttgtaagcagaatattggatttgctagttcctgcggtcctcccagagtgacatgctaggctgctgactggaattgcggaggggccagagcagaccgcccctagaagggtccgcccaagtaggaaatgacagcctccctgccttgtcatctcctcctccagagtggacgtatggagacttcactgcacatgtggggattgtgcttgttgacctcgtagttccctctgaagagggcatttgggtctcaatagaggcccagttgctgcccagggaaataagaaattctataacatccacagcttatgtggccttaaaaactcaaagaagagctgggtgcggtggctcactcctgtaatcccagcactttgggaggccacaatgggcggatcacatggtcaagagattgagaccagcctgaccaacatggcgataccccatctctactaacagtacaaaaattagctgagcgtgcaggcgcatgcctgaattctcaggtactcaggatgctaacgcatgataatctctgtaacctctcttgcccaagttgcagagagctcagaacgtgtgattgctttacctgctgtaaatatacacgtagtgcctcttataaacagagaccaaaacgctaccctgccttctcattatgacctcatggatcaattcccagactagactaagaaactctatccactcaatccaatgttgaaattcgcagcgatttcctttgggatgcatggaacccttctttagggtctcaagctatttggacatggatcaggctttgcttatagtaaagccgctattctctgcaccctaggatgaataactactcccattttcctgtatttgttgccgctggttttttgaaagaggagcctccgtcaacctatataggtccagctaacatcttaatggcatcttcttcatatattttacttgcacagcagatattcttttatatataggggcgctctcccctcttattacactggttaagaaanacgcngggnggggtggctatatatttttgtctaggggttcatatgaacaactccntatcttattgagctattttatgtatcttttgtctttgttnntntttcgnggggggcgacatnaatggtcatatcagagtgttatttgtgtgttgtatgatcatatcatgttacgtacaatgagtacaccgtcagtcgtgtgatactcactactcgacgcgngtctcttgtgctgtgttcctgtcacgtnccgcacctctccacctgatgttatattcacatcaatcttt

SEQ ID NO: 909 - DNA, 2610 bp, Homo sapiens
  misc_feature (1)...(2610): n = A,T,C or G
cattgagccagcgctgatccttccagccccgtggtgagactgtatatgtagatacacacagatatatatacatacacacatatatacacagatacacacagatatatatacacacatatatacaaatacatggaaaacacacatacaaaaaaatggaaacataaccaacaaactttaaaactgggtaccactaaagggaaaggagaaacaaggggacgatgaagaaagaagctagactccgaatatgttttatatatttgacgtcagaatgacataaatacttcacaaaacttaatgcaaaattaaatttaaaaaaattaatccctaaacttcaaagaaaaaataaagcaaacctaacagtaagtcaagttaatgatataaacatacagaggagccgggtgcagtggctcacgcctgtaatcctagcactttgggaggctaaggcaggcggatcacttgaggccaggggttcgagaccagcgtggccaacatggtgaaaccctgtctctactacaaatacaaaaattagctgggtgtggtggcgggtgcctgtaatcccagctactcgggaggctgaggcaggagaattgcttgaactcaggaggcggaggttgcagtgagccgagatagtgccattgcactccagcctaggcgacaagagcgaaactccatctcaaaaaaataaacacacagaggaaaaactattcaaagcaactttaaaacccagtaatttgtagctggacacagtggcgtgtacctgtagtcacaagtgctcgggggatcacttcagcctaggagttcgaggctgtagtgcgctatgatcacactggtgaacagtcactgcactccagcctggccagcacagcaagaccccaggtcaaacaacaacaacaacaacaaaaagtaatttgattatctagcccagtgggatatacctatagacaaaaagaatgacacaaaaaataaaaaataaacctttaagtaatcatactcttgacagtagatgctggcataattattttgagtctgttgtgtgtgtactatgaatagcaagtgaataattatgtgtcagtgagaaccagaatttggggcatagttgaaaggaaataaagatgtaatattgcccttattaagtaaaaatcctttcaaaaaaatttttagtccttcctttattcttaatttaatttggattctcagtaacaaatcatgattcattttatcttttaaaaaaatcttagcccagtccactgaaaaagcctaggaaagaatggtcaggtcatcgtcatgtatagcaatacattccccagcatgctgacctcggtgtctagatcacattcttcagacacaggagcagggcttcctggggaaatggctgatgccaggcccagggaggaaaggggtgaaatgagcatggggacttttgtcacagcaaaaagtggaaaggctgtcacagacaatgaggggcctaccaaaaggactcaagagtccaccctactagccaaagagaccatctgagcattaaggataatgcagcaatgaaaacatcagatgtgtttaaatccatgtgttcacgatgatggacgacaagcagcaacagagactctccctggtcatctctggaggaccccagggaactgacctatgaaaattataccagagagagagagagtccaacgctgatcctctctgtcctccatgatctgtgacccagaatgtgctttggctcccttggttggagaagccaggtcattcgtcctacagaacctgccacactgcacattttgctgatttcaccctgcaacacattcagtaagctctgctgtcctctgtatttactgtgggctcatagttaaattctccaaactacccaattcaagagttgaaggggaaaggtttctttttaactattccagcaactaaacaaagaaggaagaataaaatcaggatattcatgcttgtaatcccagcactttgggaggctgaaactgtcggatcattngaggacaggagtgcgagaccagcctggcgcaacatggctgaaaccccatctgtactcataatccgacaattagccatgcgtggtggaggccgcccgtggtccccactacttaggaagctgaagacggaggagttctcgagcccatgaggtgcaagcccccaaagcctaaaaggtgccagctgtcctatatcctaggagagacattgttaaacttttgccattaagacccatgaagcttggcccgggcggcgaaacccctggaaaaattccaacccggaaaagcaaggtccccatcccttggttcccggaaagggaacgctttgtcgcctatggccaggctaatcaaacgcttgctgggacccaaaggaacacacctgctttggggggcaaaccaaaaccccaccgggtagattttgccgcctgtgaaaacccttagggacgggctccaacttttatccacccaaatcttgaataatggcccccatattaatccacgaaagctttttgccacgcgtaccgtagattcggtttaacggggggaacccacttttttcagatatgagggcacaaggttttttttattaaagcacaccgtgggaggtatttaggcc

SEQ ID NO: 910 - DNA, 3688 bp, Homo sapiens
  misc_feature (1)...(3688): n = A,T,C or G
gagagtccccccccggggcccaccattacacgcactctatgcacggctctttcacctcgggtgaagactgtgtgtctgtgtctctgcgtgtgtgtgtgtgtgtctctgggtatgtctgtgtgtgtgtgtgtgtgtctctgggtgtgtgtgtgtgaatgtgtgtgcgtctctgggtgtgtgtgtctgcatgtgtgtctctgagtgtgtctgtgtgtctctgtgtgtgtgtgactgtgcgtgtcacagtgtgtgtgtgtttgttgattttcgccatgtgagcttccactttgcatccccagcactggacatgggcgagaggtggaagtcctaacacatactgaattacacacattttattacatggttcccttcatgcgatttattctataaattcacatttatggccatgcccagtggctcacgcctgtattcccagcagcactttgggaggctgaggcaggaggattacttaaacccaggagtttgagaccagcctgggcaacatagtgagaccccccatctctaattttttagaagtaaaaaatatatatttttattaaaaaaattcacacttaatttttcagagatgtgcaaggtcagcatatgctcttatcccttctcacatattcatattctgtgatgctccaatttggagctcagaaaatattgattgatggtgttggatttggacttataagaacaaaatctggggaaaaatagtgttaaccaaaggaaaatgtcataacaggaggaaactgaaagcttaaattgcaaaaataaaaagcacataatggtccagatcccaggaggcccaaatatgagaatacattagagatcagttgattagagatggggtctgactccgtcgtccaggctggagagccatggcgtcgtgatcgtagctcactgcagcctcgacctcctgggctcaagccatcctccagcctcccgagtagctgggactacaggtgtgcactgccacacctgtctttcttgctttcctttttatacggatttctcacctctaggtactcccgagagcgcctcctctatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctctgtctgtggatctgcgtggtctccatcactgatctcacctctaggtatttccgagagagagcgcctcctccgtcactgtggatctgcgtagccggcatcactgatgtcaccttctagggacctctgagaactccttcttcgtctgtggatctgcgtggtctccatcactgatcttacctctaggtattcccgagagagagcgcctcctccgtcactgtggatctgcgtagcccgcatcactgatgtcacctctaggtactcctgagaacgtctcctccatcactgtggatccacgtagtctgcatcactgagatgtgtcgcgtcatttctgtcttcctgttgtgcgttgctttggctgaagtatagaaattgcatcaatccactgcctttcacccccgcgaatagcttcctagggccactgtaataaattactacacagtgggtggcttagaacaattttattcctcagcctcctggaggccacacgtctgaaatcagggtgtcagcagggcagtgctccctgtgaaggatccagcgagaaactgttccatggtgttctcttaggtcctggtgttgccgacaacccttgctgaccctcggctggcagaggcatcactcccacctctgcctccgtcatcacagggccctctccctatgttgcgtgtctgtctctgtgtcgcctctcctcttctaataagaacaccaggaatacccacccacatgccggcacggtgctccatgcctgtaatcccaaaattttgggaggccagggcaggtggatcacttgaagtcaggagtttgagaccagcctggtcaacatggtgaaaccctgtttctcctaaaaatacaaaaaattttacccgggcatggtggtggggcatgcctgtagtcccagctacttgagtggctggggcagaaaaatttcttgaaccctggaggtaaaggctccagtgagccaaaaccaccccgctgcactccagcctgagcaacaaagcaaaacttgttttaaaaaaaaaaaaaaaaaaaaaaaaaaaaaaaaaaaaaaaaaaaaaaaaaagaattcaagaatagccaaggaaatggtgggaaataaagggggattacacaccagagaggacaacggagtcaaaatccactcagaatcctggggatctagggctggagaagttgaaggtagcacagacgctcagaatggagccctgctgcctgaggattagcacagggcacggttgtcactgccacgggggaggtgggcggaggggctacttaataaatgccactgcagcaaacacgtcatcagtatgggagaaggaaagacaaaccggacctggatctctagacacagaataatttccagaaagagtaacactttcatgcaaacaaataaaattaaaatgccaaaatcatttacaagactatccatacaacttagattagaggaacctattcagggccaacagaaatccagaaaccatgatagaaagataaaaaatattcagccataattgtaattgcatgaccaaaaaaatgtcaaaaatatcagtagacaaatgaaaaattaagaaaatattagaccaggtgcaatggctcatgcctgtaatcccagcactttgggaggctgagactggcggatcacctgaggtcaggagtttgagaccagcctggccaacatggcgaaaccccatctctactaaaaatacaaaaattacctgggcgtggtggtgggtgcctgtattcccagctactcaggaggctgaggcaggagaatcacttgaacctgggaggtggagcttgcagtgagccaagttggcgctactgcactccagcctgggcgacagagtgaggctccatctcaaaaaataaaaataaaaaaaaaatacaggccgggcgtggtggctcacgcatgtaatcccagcactttgggagactgtggccagcgaatcacaaggtcagaagtttgagaccagcctgacaaacatggtgaaaccccatctctactaaaaatacaaaaactagctgggcgtggtggtgcacgcctataatcccagctactccggaggctgagacaggagaattgcttgaacctgggaggcgaaggttgtagtgagctgagatcgcgctattgcactccagcgtcttcaccctgnaaggagaagctgcaacgccat

SEQ ID NO: 911 - DNA, 5001 bp, Homo sapiens
  misc_feature (1)...(5001): n = A,T,C or G
cacccccggtgaagacattattttctttttcttttctttctttctttcttttttttttgagatggagtctcactctcttgcctaggctggagtgcagtggcaaggtctcggctcactgcaacttccatttcccgggctcaagtgattctcatgcctcagcttcccgaatagctggaattacaggcttgcaccaccatacccagctaatttttttgtatttttagtggagatggggtttcaccatgttggccaggctggtcttgaactcctgacctcaagtgatccgcctgcctccttggcctcccaaagtgctgggattacaggcatgagccaccacgcctggtcattattttctcttttgatggtcaaattacactatctttggcatcactgcagtatgacacttttcccgtttaataacgtttttgctttcagtcatgacaaaatgtcctgggatgatcgtacatatttctggctccagactaagtatcagagtttccccagcaagccctgagtcttgttaacgagaaatgctctgcagagacctgggtctaggggctcaagatgtttgctgttaccagtttgtcattgctactcgactattttggggacacaactaggaaacaattttttttgaaagggaaaaatattaataaatccctggatcttttgaattcacttttacaacagcataggtattacatcacatcatattgtattccaggatatgttcaattagaccctcttgaaaaacatgtaggtgatttccagtcttttgtaatgaaagttgatatggtgtagctctgtgtccccacccaaatctcaccttgacttataataattcctatgggtcaagggccggaccaggtagacgtaattgaatcacaagggcagtttcccccatgctgtactcgtgataatgagtgagtctcacaagatctgatggttttctaagtgtctggcatttcctcctttgctcggcactcattctctctcctgccgccctgtgaagaggtgtcttctgtcatgattgtaagtttcctgaggccttcccagccatgcagaactgtgagtcaattaaacctcgtttctttataaattacccggtcttgggtatttcttcatagcagcatgagaacggatgaatacaaagtcttgcgtacttataatttcatatagttgtgccagaacatctttgtagcagaagtgagactggggtcaaagggtaaaggcatattcaatttggctaaatactgccaacttcttccctttaggggtcataaccattttcattcccaccagcaatgtattctgttttagccaaggtcattttaaaaaatttatacaacttaaaacttttcaggaccagatggaatgactcacgcctataattccagcactttgggagacagagctgggaaaatctcttgaggccaggagttccaggctggcctgggcaacaaagcaaggcctcgtctctaaaatcaaaacaaaattatcatgaaagcatggatttccattttctctcgagaaacgagatgatctggccatgcccgttcctgtgtggagggacagagttcagcagatcaccaggactccggcttctggaaaatgcaggcctgcttgctcacacttggtgtaggtgctagtttacaggcatttgaatttcagagttcttgttataagctggactttgccatttacctgtgaatgagacacacatgtctctgctctaatggtgcttacgtgtgtgtgtgtgtgcatgcatgtgtgtgtgtgtacatgcatgtgtgtccacatgtgtgaatatagagggggctcagcatgctttataacatgtttatataacatagaaattgtcagcctgggcaacatggtgaaaccacgtctctactaaaaatacaaaaattagccaggtatggtggcactcacctgtaatcccagctacttaggaggctgaggtgggaggattgcttgagccctggaggtcgaggctgcagtgagccgtgatggcaccactgcagtttggcctgggcaacagagtgagactctgtctcaaaaagaaaaaaaaaaaagaaatcaacctatggttaaatttgtaatgccttcctcagaattttataaattattttcattgcagagaaattgggttgaatttgaaatagtgggagtacttgcccttcatcttaatgaggccagcacagaaggaaaggcgggagtgtgtggagtctacagcctggcctcgaaggctgagggcacctggaattttgtgtctaacaaccgaggattactgcaggggctgaggagggcagggccgacggtgctcatcggaggcaacatcactgctgagatgttgagaaagatggaaattgtgctggcttgggattctcctatgattaaatcacccaatatttaatcctattaaatcctcacagtgctctagtttaataaaactctttaatatatgtcataggaaggccttgttatccgaagataattggtattaaaagtaaccacttgaaaagagtctacttaacacaaggacaggaatcttacagtgacagtgtgacaagttttggatttgatgctatggatttcataattgaaattgtatgctgattcttggaacaaagcaaaaaacgagctgcgttcatttgggaggaacgtcatttgtatggtagaattatagtttattcttcaattcgcacttggttttcacagcataatcataagaacagatttctatgaaaatacttcagggcttcatcagcttcccggaggcccttcctttgtcttctgtcctcagaatattctcttatggacatcgattgtcctcgggacatttggacagttctcccaagggaccttctgtttttttctttcctttttttgaggcagggtctcactctgaggcccaggctggagtgcagtggcgcaatctcacctcactgcaacctccgcctcctgggctcaagccatcctcccacctcagcctcccaagtagctgggattacaggggctcgccaccacacctggctaatttctgtagtttttgtagaagtgggatttcgccatgtggcccaggctggtcttgaactcctgagctgaaggaatccacctgccttggcctcccaaaatgctgggattacaggcatgtgccaccgcacctggccccgggtgatcttctgttgcaggatttgcaatgtctcttttaactggtttaactccaattccgttcatcagagagggccaggacgaccaaggccagggattttgactccctgacttggatgataggtgccaacatgaggcagggggagttgtcgaggagccattttgtaagtgatcaatagtgaataacgtcgggtgttgatgaacttcgcctctcttgcaacctcgatgagggatatttggataatgagaagctgttgtgtttcattggatcttatgatatcctgataccagccaaggtcccacagccagacacacagatgtcatccaccccgtacctatgagcctctgtgacaccattaggcccagcgctgctgtaggtactgtgaaaagagggatatttttaggtcaatcaacaatgttaacatatgcatatatttaaaaagtcttaaattattattatttgccgggcacggtggcttctgtctataatcccagtactatgggcggctcgtgcctgcaatcccagcactttggagtctgaattggaaggatctcttgaggacaggagttcaagaccagcctgggcaacatggagaaacccctgtgtctacaaaaatgtttttagttaaaaataaataaataaaattctgtgatttcaaagtattgcatttttctggacttatgaaataatagggaaaatttaaaattcatccccattcccccatttacagtcctaaagaattgacaatatcagtcaaccatagcagtgtttcttctgcttgtaagttcaaggctggcttagaattcattgtgtcttctcctcatcctggatacagaatgtaaatntaagtgggtatgaagctttaatgatatctganaatccaatcgccttgcttatcattattgtagaatataataaattcctctataaaggttttagcctgtacattgtttactacaatgagttctgagatcctctccaaagaaccaatgtatccgaatgttcagctccctcgttctttgctcttcattttaaagtttaactgtctcgttctcttcatctgcttgcctctagtttcaataaacaactccctcctagcctctatcacctgctctgaccttagtcaccctttgtccctgctctgaccttagcattcttggtaacccgtctgtcttaggcttctgagtacctgtattgaaccatcttttaccaaatacttccttgcactccgatttgtcccctgctgctttaaatagccaatagaattagctagactgccaggccaccctagcacangagactacacacatatggctacttgtgcggtatagaatcttccctccttgcaggggtctccaatgttcatctgaaacacctttataattaaatccttctggaaagtattccagctttctttctcccgagttatcttacttttcacctatttaaaagattcttggggcgcggtacatgtattcacttctgggagagtggtcacagcggattctatcctctcgcgtaagaaanccccccttcaaaaaaacaatnngggngaggttttcctcgagctgcatatataccaccgtgtcatatcatattcctctcccgcncttaaaatagttctcttgcggttgcgatatcacgctcttcgtcgtntataagaagaacgatcctcttgtgcgcttgtggggtagancatataatggtctggcgcttctacagcactctcttcttcgtgggacggtaattgtatgtcgcacatcgtgtatatagttttagttccgcgcttgntncgcacgttactctatgataacgtcacgtctcat

SEQ ID NO: 912 - DNA, 6001 bp, Homo sapiens
  misc_feature (1)...(6001): n = A,T,C or G
ataacttgacgcggctccttccagccccgtggtgaagacaagaaagaaagaaagaaaatatttgcacagcatacgaaatgccaaacattatcttacaaatcaataccaaataatgaccaaaagacaaacaacctaatttttttttcttttttctcctttcaattttagagacggggtttcgccatgttgcccagactggtctcaaactcctgggctcaagctatcctccaacctcagccttccaaagtgctgggattataggcatgagccaccatgcccggccaaaaacctacttttttaaagaatcaaaaaatacaaagaagaaacatacaaagtaaaatggtctttatacaaatgaaggatgctcccacttccttggagtcagggaagggcaaattcaaataataatgaaatatcattttatacccagtaaatcttcaaaatgtaaaagagtgatattagctggaaggatgcaaggaagaaagaaggtgttcttaaacaagcctagaaatgtgagttatccatttgggagagcaacctggcaatatctattaaattatttccattccatctgggaatctatcttacagaaataaaagcatcaacacataagtaagaatatatattgcagaaatatttgtagttaggaggaaagactagaaatggagtaacaaactatcagtttaacaaactgtagtattttataaagggcaaatattatgctcccattaaaaagaatgggtttatggaaatagaaaggaatagatagatatagatagaaagatagatagatagatgatagataggtagatagatagatagatagacagacagacagatagggccaggcacggtggctcacatctgtaatcccagcactttgggaggccaaggtgggtgaatcacctgaggtcaagagttgaacaccagcctggccaacacggtgaaaccctgcctctactaaaaatacaaaaattagcccaacatagtggcgggtgcctgtaatcccagctacttgggaggctgaggcaggagaatcgcttgaaccagggaggcagaggttgcaatgagcagagactgtgccagcctgggcaacaagaatgaaactctgtctcaaaaaaaaaaaagatagacagacagacagacagataaatgagtgacaaaacaagcatagtaaaatgtgaatggtaggttctaggtggtgggtatatgagagttggggggaatttgttgacttgaacaaattgaaggtagttccactatgtattgctaagtaaaaaaagttcagtgtgggtgagtagataagtcccattttttgtaaaacaaacaatggaaagacactacaaaggcaaatttaatgaactttcatatatacaaagaagtatcgcttaaaaggtataagaaaaaatgactctatatacttaaaaaagcatcccaccaaaaaaaatttaaaatacctcaaaataagcttaagaactctacaagaactgagtgaagaaaacccttaatgtattaattttttagtatgaagaaatagaaagaaatattatattcttggagagaggactgaattagttagctaggactgccataataaagttccccagaccttttgccttaaacaacaaaatgtgtaaaatgtattctctcacagttccggagcttgcaggttcaaggccaaggagtcagcagggcgagtttctcctgggggctctctccttggcttgcagacggctgccttcttgcccgtgtcctcatagggtatttttctcggtgttcgtccatccctggtatctccttgcatgtctgactctcctcttcttacaaggacataagtcagattagaacaggatccaccctaagggcctcgttttaatttaatcacctttttaaagactatctccaaacacaatcacattctgaggaccaggggttaaggcttcaacacatgagtttcagggtgtgaaggcacataattcatccctgaacaaggactcaatataataaagtgtccttgtctctatgttaatttataaatatgaagtgttgctaacacaaatactataactagattctttgcttgcattgggttctgttttgttggaactaggttaagaggaaaaataaacaagcaagagtaaccagaaaaaaagtgtatatatatataaagtgtatatatatatatatatgtatatatatatataaagtgtatatatatatataaagtgtatatatatataaagtgtatatatatatataaagtgtatatatatatatattttcatatatatatgaagaggatggattatgaagttacaataattaaccctggtggccttggcacaaaaatagatcattgtaatgctatcaaaagcacaggaacacgcctcagtacaaatgagaatataacatatgataagtttgacatctcagagaaattatgggtaactcttcagtaatggtgttgaaacataggcataactatcttgaaaaagaaaataaggccgggcacagtggctcaggcctgtcatcccagcactttgggaggccaaggcgggtggatcagttgaggtcaggagtttgagaccagcctggccaacatgatgaaaccccatctctactaaaaatacaaaaattagctgggcatggtggagtgcgcctgtaaccccagctactcgggaggctgaagcacaagaaccgggaggcggagattgcagtgagccgagatcacgacactgcactccagcctgggggacagtgcaagattctgtctcaaaaaaaattaaaataaataaaaatgcaaaagcaaaaggcaaatgatgaactgggaaaaaatgtttgcatctcattacaagggatgttcttcataataaagagctcctagaaatgcattttcaaaaaggagaggcaactaacaaagaaaatagagaaaggaaggctatgagcatgcaatttacaaagaactaggaatagctgttacacaagtgaagaggttaaatctcacctgtgataagataaatgcaaattaaagccacgcggaattacatttttcacttatcagaatggcagagttccaaaagtttaataacacaggctggtatcaaagctacgggagaacgagagcgctcccactctgctaatgggaatgtgagcagcacaatagtgcaggccgttaagcagcagctagcgacattcatctgtgacccaacaattccacttctaggggttgatcctgcagatgtatttgcacatatgcaaaataacaagtgtgcaagaatatattcacagtagtgtttgtaataatatgataaccaacccaaatgtcctcaatagggggctggttattcaattttgatgcatccatccagcctcgatggtatacagctacttagagggatctcaatactcactgtgaaattatctccaagatatgctcttctgtgaaaaagccaaacgcatattgtctaaacaaactagcttttgtttgcttttataactggtggaagaataaaagtctatattcttatgtgtttgagcataaacaaattatgacaggacatacaggaagccaataccagccagtgtctatcggggtgagacaaagattgcatggatggggagagacttcccaccagtgtgcctgtcagcacttcgtgggctgtggatcatgtgagtgtctgcgtgttccctgttcaaataatcaaaagtattgaaattcatctgtgatggtaaatattagacgtcaacttgtttggactgaagaggcctagatggctggtgaagtatggttcttgggtgtgaggatgttgccagaggagatggacatttgagttggtggactgggagaggaaacataccctcgatgtgggtgggcaccatccagtgggctgccagcgcggctgggacaaggcaggaggaagatgggatgacctggcttgctgggtctcccggcttccttctttctcctgtgctggatgcttcctccctctccttctgcccttggacatcagcctccaggttctcctgcctttggactctgggacttgcatctgtggcttctggaaggtctcaagccttctgccacagagagaaggtggcactgtcgactttcttggtttgaggcttttggacacggactgagccactaccggcttctctcttgcccagcttgcagacggcctatcctgggacctcgtcttgtgatcgtgtgagccaattttccctaataagatcctttcatgtatacatacatcctgttggttctgtccctctggagaaccctaagacaccatcaaatctgtgcacacacacacacaacacacacaagcacacacacacactgtgacaacggagaaagcatggaaggatagaccaccaggctgttacctggtgagagaagatggaaggaaaatgaaacgaccgtgctttttaaaagtctatgagaaaccggtcacaaacaatgacttgtgccataacacacagaagcttgtctcaaagtgcaggactgtggatggctgtgctatttctatatagtgtctgaatatttttataattaacatccactcgtgtaataaaacaaaatggtaattttcttttcctagctgggcgcagtggctcacgcctgtaatgccagcactttgggaggccgaggcaggcagatcacctgaggtcaggagtttaacaacagccagtatcatgaaaccctgtctctacaaaaatacaaaaagaaagtggccagacatggtggatctcagcctctctagtagctgggattacaggtgcccgccaccacacccggctaattttgtgtgtgtgtgtgcgtaaacctgcttgcctgcatcgctggctttaatagaagcctcttgcgccagtttgctggcatgatgcgcgttatccgcattctgtttcaccgtcgcagtgagttgctccatgctggcggcagtttgttcgatagccgccgcttgttcttcggtgcgagatgacaggtccgcattgccagctgaaatttcgctggtgccacgataaatctcttccgcgccctgtcgaacagtccctactgtcatccncagtgaatgctgcatttgctgtaaatgacgacttaagcgaccgatttcattacgacccgccggttcatcattcatcgtcagatcgccactggcgatnntttcaatccgttgtgcggcatgttgcantggacgaatgacgatcccgacgtacaccatttaatgtatcagcgtcatgaccagggcaggcacaacacgcccaattttgaacttccaacccagccgttcgctctaatggccaattcccccacatgggtggtctgtggctctacatatttaacggttttgctcaatatatggnttacgctttactcagcggcggtctgccactatatgatgaaagcgttaaaacatccattttggcatttccactaggtgcataccgtgaatagcccgaagcgtgattattaatgcgggcttcatacagtggttaccgcatattgaagccatacctgtgacggtaactcaatggtgccatatcttatgttcttccaacactacccgctcatattacgcaaccaaataagtgtttcgccatttttcgaaaaacccgtttgtccccggaaacccgtgttttaaaaaaacctagaggaacccctgtgaaacctgggggtttttntnnnnanaaaaaannnggtttaaacttcttctataaaatttggagagatttcccaaaaaaaccgtttttcccggggggttttgaaaaaccttcccgattttccgagggggtttttcccccggggggggggtttttttttcgggctgttgtaannnnnnnnnnnnnnngncgcgatggagtgggagcgggcgttcttcctcnccnnnnnnnnnnnnnnnntnnnnncgacgtncangactatgacctcaacgtcgtcgtagacacagcgatnnngntgncgttggaactcgacactatgcataaaattngatcgtgaggc

SEQ ID NO: 913 - DNA, 7492 bp, Homo sapiens
  misc_feature (1)...(7492): n = A,T,C or G
tatccgtcccgctgcgcaacgcgggcacacagcgttttctgagcggcggttgggtgttgtcccaacgaaatgggtacgtcaacaaaagtgaagcgctgatcaagctattccaacacaattttggcctttgcgtgaggatgttagcgcgtgaatataggtgtctgcgggccaaagaggtggtaaacaaacaatatattattgagtgggttttggccgtccatccagaggcagccgccggtttgtctttcaaaatagtagcttcccacctccaggacagggccagtgaaaaagagaaccaaaaagcatgcaccaaccaaaaacggcttctttttgtttaaaagacggagtctggtacgttgcccagaatgtcttgaactctcagggtcggcgaatcctcccgcttcagcttccgagtagctgggactacaggcgcgctccacatcaggcgtattttttaaaaattattttgagagccagaatctaactatgtctcccaggctggcctcagaggatccacccgcctcggcctcccaaagcgtccgacttctcaaagcgtttcataggttggcagctttggccgctgcatgctacagacaaaatgatgaaatactgtttgcagtctggacgcgtctaccagccctagttaccatcggggacggaatgagtaagtgctcagcttcacagccccctgttggcctgaagctgtaagagcccaaacaagcttgagctatagggacccgacttcctgggcgcccctgccgacatgcagacagataaaggcccaaatcagcgcagtcaagcgcctcagaagagtccaccatggggagagagccgcagtgaccgaagagtcctccctgcagtcctgagcacacttgcaggcgagtccgctaggaaccccagtgacgcaaattaggcacaaagcaggcgacaaccggcctgctgggaacgcaagtccgagctcccccagaaccctcaggggaaccccaagcacctctcagacgctgctggcgggagagcagaatctaacagtaaaacgggaatgcccattgcttgtgaccccggatttccatttctagggagaggccccagagttaaactcatgcctcacgcatgtgcacaacatttaatactgtataacatttaaaaggaatgacggtcatctgtttcaacagggttagatagatgtcaaaaggatagtgttgagaaaagaagaaagaggtgataacagctttataaagtctaggccacctgtaatcccagcactttgggagtccgaggtaggaggatcccttaaacccaggagttacaggctgcaatgggcaatgatctcaccattgcactccagcctgggagacagagcaagaccctgttttcaaaaattaatacataaaacctaacactatatgtaactttatctagagggattatatatatagtataatgtcatttatgtatattttttacaaatacacataaaacaaaagcatattggctattggatatatgtattttgttgttttttttaattgactgcaaggatctatataccatatcctgatggttattgcttcaagaaagggtagaaaggagtgtgatggaactgagaagaggagtcaaagaagactttaactttacctgcaatgttctatttccttttttttttttttttgagacagcctcactctcgctcaggctggagtgcagtggtgcgatctcggctcattgcaacttccgcctcccaggttcaagtgattctcctgcctcagcctcctgagtagctgggattacaggcatgcgccacaacacccagctattttttttatttttatcttatttttatttttagtagaaacagggtttcattatattggaataggtaatcgagtggtcactttggcagcacgtataccaaaattggaatgatacggagaagattagcatggcccctgcgcaaggatgacaattttttttcttcttcttttttttatttttttttttttgagacagattctcgctcttgtcacccaggaactgcggagagaggtcatagaagagtttaaccttacctgcaatgttccatttcttttttaaaaaatggtaatcagggccgggcacggtggctcacgcctgtaatcccagcactttgggaggccaaggcgggcagatcacgaggtcaggagatcgagaccatcctggctaaaccggtgaaaccccgtctctactaaaaatacaaaaaattagctgggcgtggtggcgggtgcctgtagtcccagctactcgggaggctgaggcaggagaatggcgtgaacccgggaggtggagcttacagtgagcagagatcgcaccactgcactccagcgtgggcgacagagcaaaactccatctaatcaggctgggtgcagtgactcacgcctgtaatccgagcactttgggaggccaaggcagatggatcacttgagctcaggagtttaggaccagcctgggcaacatggggaaacccatgtctctaaaaaaaaaacaagaaagacaattaattttaagaatggtaatcaaagcaaggtgacaatatattaaccatttgtataattctgggtgatgagaacatcagtgtttataccttttggcgttttttcccctacaagaatccagtcgaggattgcatgttacgcttttaacttgtttctcaggcctccttagtctctagttttttttttagagacagggtctctgtcacacaggctggagcatagtggcttactgcagcctggaactcctgggctcaagtgatcctcccacctcagcctgcttagtagctgggactacaggcatgtgccaccaggcccagctaattttttatttattttattgtagcaatggggtctcactatgttgccccagctgatctcacctatatacctatatgtgattttataaagacgtaattacgtgtgtgtgtatatatatgactttttttctctgaaatgtttgaggtaagtggcaaacaggatgccctttgatgtgcagttcttaaaaccaaggacattctgttacataaccactgtacacttatcaaaatcaggcagttaacattgctctaatttgattatctaatctcgacccttaactgtcagatgtctcactaacaccatttgcctggtttaggatccagtccgggattgcatggaacgtttgcttgtcagcctccttagtctatttccatctacaagtccttcagcctttctttatctttcatgaccttgacactttttgcagagtttttttttggtttttttgagacagaatctctctctgttgccagagctggagtgcactggcatgatcttggctcactgcaatctccacctcccgagttctggcattctcctgcttcagcctcctgagtagctgggactacaggcgcacgccaccatacccacctaatttttgaatttttagtagaggcggggtttcacgatgtaccatgttggtcaggatggtctcggtctcttgacctcgtgatctgcctgcctcggcctcccaaagcgctgggattataggcatgagccaccgcgcccggctgagtattttttttcccccaagacagagtcttgctctgtcgcccaggttggagtgcagtggtgcgatctcagctcactgcaacctctgcctcccgggttcaagtgattctcctgcttcagcctcctgtgtagctgggattacaggtgcctgctaccacacctggctaatttttgtattttttgtagagatgggttttcaccatgttagccaggctggtctcaaactcctgacctcaggggatccacccacctgggccccctaaagtgctgggattacaggcgtgagccaccacgcctggccttgcagagtattttagaggccaggtattttgtagactgtcctttcatttggatttctctgatactagctcatgattagatacaggttatgcagtttgggtaggaaaaccacaaaagtgatgttgtgtccttcttagtgtctcagatcaggaggcacagggtggattttgttttgtagtgacagggtatttctctgtcaccagggttggagtgcagtggcgagatcatgactcactgcaaccttgagctcctggggtcaaatgatccactcacctcagccccccgagtagctgggaatacaggcaggcaccaccacacccagcaatttattttcttttttgtagagatggggtcttgctacattgcccaggcttatctcaaacttctggccacaaacaattttcctgccttaacttctcaaagtattgagataacaggcatgagccactgcatgtgacccagagtgatcttttaaaaccatatcagaggcagggtgtggtggctcacacctgtaatcccagcactttgggaggccgaggttggcggatcatgaggtcaggagatcaagaccatcctggctaacatggtgaaaccccgtctctactaaaaatacaaaaaattagccgggcatggtggtgggtgactgtagtcccagttactcgggaggctgaggcaggagaatggcgtgaacccgggaggcgaagcttgcagtgagccgagattgcgccactacactccagcctgggtgacagagcgagactctgtcaaaaaaaaaaaaaatcagatcatcctcctccactggtaaaacctgcagtagttttctatctgtctcacttagatccatgaaatctgtagccagggaggtactatgggctctagctcatgcctacctctcccacctcgtctcctgcctctctccctgtaacctcacaagactttctgtatcttaccccagccaaatttattcctgccacagggcctttgcacttactggtccctctgtttaaaagtatcttcccttggctgggcacggtggctcatgcctgtaatgccagcactttgggaggccaaggcgggcagatcacttgaggttaggagttcaaaccagcctggccaatatggtgaaaccccgtctctactaaaaatacaaaaattagccacgtgtagtggcacatgcctgtaatcccagctacttgggaggctgaggcaggagaatcatttcagcctgagagttggaggctgcagtgagccataatcgagccactgccctccagcctgggcaacaaagcaagaccctgtctcaaataaacaaataaacaagatgctcttctccacatatcttagcctggctggctccttctcacctttcagtcccctgaccacccctaggctttctccacttcagcacccactttcttttcttcagagcacattattgagaacatattgcttaattatttacgtgctcgtttttcaatctttcttttcttcactaaaataagtggcataccatgtcatgacattcaaagtatctagcgcagagcctgtcacataacgtatgcttaaacaatatttattgaaatattgaataaattactctttttttgttttgttttttagagacacagtcttgctctgttgcccgggctggagtacagtggcatgatcatagctcactgcagcctcgaactcctgggctcaaatgaacctcttctcttagcttcccaagtagcttggattacaggtgtgtgccttctaggtgaatgaatgactcttgaccccttctgaatacagaaagaggaatgagacacagcagcattatattctaatgaaaataataggccaggcatggtggctcacgcctgtaatcctagcactttgggaggctgaggcaggtggactacctgaggccagaggttcgagaccagcctggccaacaaggcgaaaccccatctctaccaaaaatacaaaaaattagccaggcatggtggcgggtgcctgtaatcccagttactcgggaggctgaggcaggagaattgcttgaacccatgagacacccgggaggcggaggttgcagtgagctgagattgagccactgcactccagcctcgcaacagagcaagactcttatcaaaaaaaaataataataataataaatatgcaggcctattgaatgttaataatggtacttcatggcaaagactaatctttgcatacactgcactccagcctgggtgacagagcgtgaccctgactcaaaatttttttttaatttaaaaataaaggctggacacagtggcttatgcctgtaatcccagcactttgggaggctgaggtgggaggatcacttgaatccaggaggacaagaccagcttgggcaacatagcgagacctcgtctctataattttttaagggttttatttgagatggagtctcgcactctcgcccaggctggagtgcagtggtgccacctcggctcactgcaagctccgcctcccgggttcatgccattctcctgcctcagcctcccgagtagctgggactacaggcgccagtcaccacgctaattttttgtatttttagtagagacggngtttcaccatgttagccaggatggtctcaatctcctgaccttgtgatccacccacctcggccttccaaagtgctgggattacaggcatgagccaccacgcccagccatttatagttatttttatgtattttcttttacactgacactagcttctataagtgcccatgtagtcttttcttactgaaaatctttcttactctctatataccatcaangtactgtctagtgtcctttcattttgacctgaaggatnccntntagaatntcatgtaggacagntacaaaatnncgactgctttgtnatctcatttacattctgaanatctagagccctaagaatatgctaacctatntgctggcttataatggaacacaacctggtgacaacattgttatacatgttactgatatttaaccactgtgaacctatactatagaaaattcttctaataactgatatgcatgcctagcaccaaacttgggaataagttgttcacttgtaccattcattgtgccatgtaagagattgctcagctattaaaatattttagtaaccgctataggtacctctgatggccggaaggaaaactagaggcccctggcccagcgactttttaggggaaaaacaaagattaataataacccccccccaatttggggaacaccccgaaataatgggggagggaaagagaggaccttttttttcgcacgaaaaataaaaaaagagggcccccggcccccccccccccgccgggagaaattttttattttttttttggtgggggggggggtgtgtttttttttcccacacacggaattttgtggggggggggggggggccccccccccccccaccatttttttncgtctattatgatttatatgttggggtggtatatannnnnnnnnnnannnnnnnnnnnnnnnnnnnntacnnnnnnnnnnnnnnnnnnnnnnnntcacgctccngtactncctccctggtgncgtntcccttcgtgcngtttnantantggcacc

SEQ ID NO: 914 - DNA, 6689 bp, Homo sapiens
tctgtcaggttttggtttcgtgatgatgctgtcctcatagaatgagttggggaagagtccctcctgctcaattttttggaatagtttctgtagaatagtagcagctcttctttgtacacctagtagaatttggctgtaaatccatcaggtcctgggctttttttggttggtaggctatttattactgatttaataaatcagagctcattattggtctgttcagggaatccatttcttcctggttgagtcttgggagggtgtatgtgtccaggaatttatctgtctcttctcagttttctagtttgtgcacatagagttgttcatagtagtttctgatggttatttttatttctgtggtatcagtggtaatataccctttgtcatttataattgtatttattggaccttctctcttcctttttattagtctagctattggcctatctaccttacttattttttcaaaaaaccaactcctggattagctgatgttttgatttgtgtatgtgtgtgtgtgtgtgtcttgatttccttcagttcagctctgatttttgttatttcttatcttctgctagctttggggttgatttgttcttgtttctctaactctttcagttgtgatgttaggttgttaatttgagatttttctaactttttgatgttatgaatacttttagtgctatgaatttccctcttaacactgcattagctgtgtccccaacattctggtatgtttatgtttgtttgcattagtttcaaaaataacttcttgatttctgccctaattttattatttacccaaaagtcattcaggagcacgtttttaaaatttccatgtaattgcatggttttgagcaatttttttagtcttgacttctatttttattgtgatgtggcttcagagtgtgtttggtgtgacttcagttcttttgaatttgttgaagattgttttatgtctagttatgtcattgatatatgccatgtggcaataagaataatgtatattctgttgttttggggtggagagttctgtagaggtctatcagatccatttggtccaatgttgagttcaggtccggaatatctttgttaattttctgccttgatggtctgtctaatactgtcagtagagtgttgaagtcttctactattattgtatggcagtctatgtctctttgtaggtctctaagaacttgctttatggatctgggtgctcctgtgttgggtgcatgtgttcttaggatagttaggtcttcttgttgaattaaacactttaccattatgtactgttgccttttttgatctttgttggtttgaagtaggtttttctgaaattaggattgcaaccattgcttttttttctgtttttaatttgcttggtagattttcctccatccctttattttgagcctatgggtgtcattatgtgtgagatgggtctcttgaagacagcataccatcgagtcttgcttttttatacaacttgccattctgtgccttttagatggggcatgtggcccatttacgttcaaggttagtattgatatgtgtggattcaatcctgtcattgtgttgttagctacttattatgctggcttgtgtgtggttgctttatagcaacactggtctgtgtgtttaagtgtgtttttgtatcagctggtagtggtctttcctttctatatttagtgcccttttcaaggtctctcataaggcaggtctggtggtaaattccctcaacatctgcttatctgaagaggatcttatttctcctttgcttaggaagcttagtttggttggatatgaaaatcttggttgaagatttttttttctttaagaatgttaaatataggcccccaatctcttgtggcttgtagggcttcagctgagaggtccactgttagcctgatggggttccctttgtgggtgacctgccctttctctctagctgcctaaaaaagacatttaagccttcaataataactttaaaaagccaattttgatcatcatgctagaggaaagagttttctttctgttctctcaaaagaaaacaaaattataaaatcattgtcatctggagaagtaatcaaagattacacaaatagtgttaaaaacaaatattatacaaatattataaggtgataggtagcccaattaccctgattttatttttatacttacatgaatgcatcaaattagcacatgtacccctaaattatgtacatttatcatatatcaataaaattgatattatagtagagtcttaggcagttaattacaataaatatatgctatttttctggattttgtgatatttgtgggatttgtcaacattttaacatctggaatttgttgtgatttattttcttattctcgataaatgatcatttgtgtattttgtattggtgttctttgtgttttatttttcttaactagggctctccacattatataaactccaggccccacaaaattggacccacaactgaatctgaaatatgtgttgcaaatatgttatctcagttgtagcaaatcttttggttttatttgtggcattttcccactgtgcagaagtttacatttccacgtaatcagatttaatcagcatttccttttattgttcctgagttttcttagaaagtccttcttcatttgacaataatgaaaaaaattcataagttttctagaatgtctaatttttcttttatatgtttgaatacttgatttatctggaattaacttatgtgtaagaactttttcccttaattatcctgtattctgacaattatttattgagtattctatattttcttattgattagaaatactattttatcatatattaaattctcatatgtaatttggatttgtttatggaccacccagtttgttctatgggtctgtctgttcatgtaccatgacaaaacaattttatttatatatttataatatattttaatgtctggtaaaactagttttctttcattactttttcttgccttcaataaaatgtctgggttatacttttgtgcttatatttccatactaagtttagaatcagcttccagaggtctggaaaaaaatctcggctttatgttgattgtaatcatattaaatgttaaggttgatttcaggagaattttataaaatttaaggaccctctccaagtgtggggttggcttttctttttgctccatttttcttttattttttcctcagttttcttcatatatatcttacacatttctaggcatgcctttctttttgtatgctattataaatggaatttttttccccttccattatacttcctaactgattattgcttttatataggaaacctattgacttttgtatattatttttgttcctccaaaataatatgcaataatatacaaatatatatttgctgggaacctaaaataatacactattctattcaattatggaatatatctagagctctccttttttttttttttttttgagacagggtcttgctctgtcacccaggctggagtgcagtggtgtgatcatggctcactgcgaccttcacctcctgggctcaggtgatcctcccacctcagcccccgagtagctgggactacagacatgaggcatcacacctggctaattttttgtatttttcatagagacaggcttttaccatgttgcccaggctggtctcaaattccagagctcaagtggtcctcccgtctcagcctcccaaagtgttgggattacaggtataagccaccacgccagacctattctatcctctcctattcaattcttatttgtaacagtttttctgtgattggttcatctgggtttccaggtagatcatcatgtcatctccaatactgcctagtttttagacctttctgactaccctactacttgtaaacagggcaggtttttccgagagatgttcctagctgagtgctgcacttatggtgaacacccagcttcaaaggctacttgaaaggatttagggggctgcacttacccaccggccttggaattggcctcatagaaaacttgctgtgctttgtggaagctcgggcccgcagaggtgctgatggtcagtgtcagcacagacctattattagctgtccagcgacaggagattccactttaatgctgaagcttcagaactacgttgcaaacaaaatgactggcattttctcagacagcagttccaagtggaaactgtctagttgtgctgtctccatacggagggctggaaaactgtgaatggcaattatgcagctttgcatctcacacttcctgacatctggcaaacactcgttccatccaggaccagataaaacaaatggtgccttattcacaggagtctttaacggcctaatagacccgatgagtagcaatgcctttgtgtggcctgtgtgcagtccagagctagcaggttgcctatgacaagcgctggagggggtcagcacttttgattccatcaccgaaactggtccccaccacagcagctcatttttcagaactggctagctccttcctgctgggttgaatacatcctcattcttcacaggcccagaatggcttcatctggattgttagttacctatgaaagtctctggtttgttacatttttttcagtattttatgcacaaaatttacctaatttttgtgaagttagaacatgacaccaagaaatggaatcctgtattatttttcttttctttcctttttttcttttctctttttttttttttttgaggcagagtctcactctgtcccccaggctggggtgcagtggagcaatcatagctcattgcagccttgacccccctgggctcaagccatcctcccacctcagcctcctgagtagctgggaccacagccgtgcactaccatgcccagctaagttttgtattttttgtagagatggggtctcactacgttgtccaggctggtcttgaactacgaggctcaagtgatcctcccactctggcctcccaaagtgctaggattacaggcatgagccactgtgcctggccctgcattctttctatgatttgaccatgtgtctcttggcagctacagtcaactctttggtctcaagttgtccagctgaaaaagtgggctcctcacgccgagacccatgacatgcagccccacacacatgggatactgcagacgacagtgcagccatgacagagactcagtggggctggtgcagacagcaatggccctgtatggggagaacccagcatctttgaatggaaacattttttgcagcttatttgttttcgaaccttggctttttggcctaaatgttccatggcattccttaacaattaatttcctctctgctgagaaaacaaaggtggagagtcattttcatgccactgaatgaccttttaaaagattgaatcctttctaagggggaatagctttatttccttctgtcaaatatttcatttgtcccctagaagagccccgtgaagtagacattatgtgataagcagacacgatcgttttacagatgtgggaaaagactgacctgctccaggccacacagatggagtcaggaaggggcagactgggtcagtggggcccaattcacaggcactttctacggtcttttcatatgtttttatggaggtaaagttcacatcacataaaattaaccattttaaagtaaacaattcagcggcatttaatacattcacagtcttgtgcaactgccacctctctcttgttccaatgtgttctcaccaccccaaaaggaaaccccactccagtaaggagtcactcctcatctcctctcctcctagccctcagcaaccaccagtctcctttctgtctctatgaattcgcctattttggatatttcataaaaatgggctcatacgatagatgggctttgtgtctggcttctttccccagcatggtgctctcaaggtccatccatgtggtagcaggaatcacatactccattcctttttcctggctgaataatattgcattgtatggatatgccacattttgtttccccattcatccattgatgggcacttgtgtcatttctaccctttggctgttgagagcagcgcagctgtgaacatgtgtgtacgagtatctggtaaccagtcccttccacgattttctgcagtcttgtagtttctgtgacctgataactctgctgcagggtgaaaaggaatcatctgtggtttgccacctactcctggatacagcacgtatctctttgttccatgcacagaggctggggccactctacacggggcttgaaagaagcctccagtcttgcagccaaattcagaggcatataattcagaagcctatccgggaggccaaaatgagtcctgactgggaaaactcgctggacccgtctgccacagtgttgaaaaagttgtcttgggaagaggtttcctctggctgtctaggtttgagacctttgcgattcctttaagatcacaagcaaaaccacggtgatggtaggatgtgttggttttactaaggagcccattttttaaaaaacttgtaaagtgagccttaattggagaagcaacagaaagcacctcgggacaagtccttcctttttgtacaaaggacccgtggtgagcccttccttggaattccgcggatcctctccctatagtgagtcgtattagcggccgcaaatttattagagc

SEQ ID NO: 915 - DNA, 8018 bp, Homo sapiens
  misc_feature (1)...(8018): n = A,T,C or G
gaagactccacctctctgccctgggatccgcggctgcaggtggcgcggcgcgggcggtgctgggaccggggacccgcccaggaccggctgcctctggcgccacctggcggccgccgtgcccagccctgccccgggtcctgaggttgacgggggacctccgggagggcagcagcccggggatcgccctgctcaccgggacctaagcagagcgcctgcccgagaatagggagacacgcgggaggcggagcacagtagtcccccttcctccctcccaccctcccctcttcctttaggaacaaggcgggaaggccaagagcctgtccctctctgcgttaccccgggcccatcactgggagagaggaatcactgcattttgctttttaaagactgaccaaggaagcggctggaggctgctgcctacattttggttcacactctgtcacaaaacaaaacacaaaaaagcaatggttttctttagagcccaaaagggactatcatgaaacagtaacagttctaaatttactcaaaaaatagttctctctgctatgacttggcagcaaaaatgttttggaggtaaattattcaaaaaaaaatgcggatacttattcaaatataatttccctaagcattaagcatgatgttaacagatgttacataaaaggtcctacgggcaaataaatgtgtgaaacactaaacaaagctaaacaggcttccttctaggaagccttctcagagccttgattattctacgggtactgcaacttcccaagaggggctgggcgacggcacgaagaggtccccggaaagatctggccgcaggcagcaccctggctgcacggactagctcatgagacggcggctccagaaacattttgggaaacacacttctgagtcactgagagggcataaacagaggctcagaatattattttacaagatacataaaattttaaaatgcactttttcaatttaatactactttcttattttttcaacgtacggctacactaagtaatattccaacaaaaaatgtatttgctggcaactttcctccaagaccaagaatacatgtgcccccatcaccacttctattcaatactgtactggaggtcagctaaataaatcagttaaaactaacaagcataagagctgcaaggaaaaaacggtcactatttattcacaattacatgactgggtacagagacaatccaacataagctacagagaatatcagaattaataactgattaggcaaggggtacaaggccaatatgcaaaaatcattgtatttctatataccaacaacaaacagagaaaatgacatttaaagtagatacggctgggcacggtggctcatgcctgaaatcccagcactttgggaggccgaggcaggtggatcacaaaagtcaagagttcaagaccagcctggccaatatggtgaaatcccatgtctactaaaaatacaaaaattagctgggcgtggtggtgggcacctgtagtctcagctactcaggaggccaaggcagaagaatcgcttgaacccgggaggcggaagttgcagtgagccgagactgtgccactgcactccagcctgtgtgacagagtgagactccgtctcaaaataaaaaaaaaaatagataaataaaaaataaagtacatacgacttgcattaacatcaaaacattgactacctaggaataaatacaacgaaagatgtgcgcgaccctcctcggaacccacagcaccgcacagaccggcattaaaggcggcctgtgtcgtggaggtaggggccattttcatggattcaaagactcaacgttgttaacatagtaactccccccaccatgatgtgtggactcctatttgtaatctctggcttgctcagatccatgtcccctgtaaagctttcaatatttatcattccagagcaatgaaactctcttctctatagctcccacgcccctaacgctgagttaatttaaaatcatgtcttttctcccaatgaggagatgcaaataccacggggaagcaaattgagacaaaaatccaggttctccagctgcttccactgagctcctttcactctcctgtgtgcctcagattcaaaaggaagcaaatgtgaggcagggagaatttggataaacaggtaaagaaagaaaaccgtttcttccgtgccatcccccacagccactgagcgcagcacagtccatacaaaagctcctcaagactttcagagtcgcctcagtgcgtcttcctatttcactctgctcttacaagtactgttttccaaatcaatccctgattcactgccctctgaacagaaaatgctgtcttgctgaactgtggtctaatcttggcccctaagttctgtgaagccactttcgtgtattctttaggacatgatccatcagtgggcctcaccctggctgaccactagaatcatacaggcagctttaagaaaaaaaaaacatacagatgccctggctcgccccaggccaaacgcctcagactctctagggtgtcagcatttcatacaaactcccctgaatctcccgtgaggccagagttgaggcctgtgccgcagacagccagagggacacacagacagacaaacgttttgttgtgaaaaccaacaacttacttccttccgggtttggtgcagaaagaatgatgctgtggtttttctttacttcttcaacatattgagttattttatcaatactgtttctaatctcctccacctaggagagagagagagtcattacagcatggcaaactcaaatctgtgaccacttttcatcccctaaaaggggaagaataaaggagggaaataaataattaccacataagaaataaaagcctctcccattctcacactggtatcgttaaatttaaaaaataaagatatatcctatgaatatttctaccttcatacctaaagcagtaccaatcaacattcaccgggaaaacctatcaggttgtaaaaatttctagtcaagtcccaagcatgacacagatggggccaattagaagcatactactactaatacccattctcagtataaccaggaagtaagcccataaaacatgcaggcacagtggctcacacctgtaatcccagcactgtgggaggccaaggcaggcggatcacttgaggccaggagttcaggaccagcctggccaacatagagaaacctcttctctactaaacgtacaaaaattagccaagtgaggtggcacacacctgtgatcccagctactcaggaagctgaggctcaagaatcgcttgaatcgggaggcagaggttgcagtgaaccaagatcacaccactgcactccagcgtgggcaacagagcaagactctgtctcaaaaaaaaaagaagaaaataataataataatactcttatgggaggaggtatctatagctcatacagccaaggcttcataattattatctttgacctctaaatgtttaaattcaatatttgtttcaaaatgtaacatatcattagcaagatttatctagatggagtcataacattatcttcaaaaacctctacggcaggctgaataatgaccccaaagatgttcaggtcctgatccctgggcctgggagttaccttatagggcaaaagatactttgcagatgtgacgaaactaaggatctggagacgggaaatgatcctgaattctccagtttggtcctcattaacccatttatgccagaggctgcaatgtgtgtgtgtgaaaaatcagaccttggtgatgaccctgagcagtaggatataaataactcgcaaaagcttagcgttccaataatggaacactacgcataaatgggttaaagtcgcaagtgttcttagaagacagcagtagatggagatccagctacagaagcagcaaggtgagccctggagcaagatgctctgctgccagctcctacctccttcctcattttaaaatagtaattataggccaggcacagtggctcatgcctgtaatcccagcactttgggagccaaggcagaaggatcacttgtggccaagagttcaagactagcctgggcaacatagagagacccccatctctacaaaaactttaaaaaaaaagaaaattagccgggcacaatggtgcatgcctgcagtcccagccactcaggaggctgaggcaggaagatcacttgggcccaggaagttgaggctgtagtgagctgtgactgcaccactacactacagcctgggcaacagagcaagaccctgctcttaaaaacaaaaaaaggaagaagtaattattaaccattacatgttgtggcacaatccacaccctaatcccagagcctgtgaatatgtcaccttgcatagcaaagggaactttgcagatgtgatcaaattgagtcttgagatgggagactaccctggattatctgggtgggcccaacgtaaccacaggattccttataagacgaggcaagggagccaacgttggaagaaggacacttgattgtgaaaacagcagctggagtgatggctttcaagagggaggaaacccaagaacacaggccgcctgcggaagatggagaggaaggcagctccaggaggcttgcggctctgccctgccagcatctgagcttctccaggccctggaactaggaggaggtgataaacgtgttgttgaagcacagtgattgcggtgattttgttacagcagcagcaggaaactgacacacggatcaacataaataacacatttctgtgaaaaatagatctccaaaaaatcggtggaaacagaggcagtgatttgcactttttgtaaatctaatgtccagcttaatagacagcaccctgatcatcacagatatttctgggtttggtgtgttggctctgagaaactccatcattgtgcagtcataagacaatgaaaatggcaatgatcatcttagtattactttgaaaagagctttgaccacagaatcctcttgaaagggtcttagggaccccagggactcctaacccaagccccggaccagatttgaaaagtctaagtattaaagaatcatgcaggccaggagcagtggctcacccctgtaatcccagcattttgggaggccaaggcgggcagatcacttgaggtcaaaagttcaaaaccagcctggccagcgtggcaaaatgccgtctctactaaaaatacaaaattagccgggcgtggtggtgtgcctgtagcaccagctactcaggaggctgacaagagaattgcttgaacccagaaggaggaggctgcagtgagccaagatcacaccactgcactctaccctgggtgacagagcgaggctccgtctcaaaaaaagaaagaaaaattaccatttctaaagtaatacacatatgttagaaagtaaaagaaaaaaacattattttaactcttggagagttctgcaatatacaccgctgctaactccaagcccccgtatggctccagaggaacaggagaccgcagggctatacaccctgtacctagacaggcactgagagagaatggtgccagctaccattttatgtccgggaataacatagcacaggggtcctttggctccattataaatcatcttcacagaaacaagactccctggccacccttcagagcactgttttagtgttaaccaaacactcaccatgtgaaattcatttctcttgcaaacttctatgtgatattgaagatcagaatgagtttatattaccaaacattatttgcttctgtatttgtctaggaagtcatttcacagaaattaagtgcaaaataaattgactatttaacaaatgaaagcttgagcttaagttagaacccaatgaggcaagcaccgggcaagccttcctaaagtacgagtaacctgtttcccacatgcccctgagacgccagcagcaaagacagactggcaccagatagacaaagaccacagcttaatggcactcagtgaattgcacaatgtaacttttctgttcttttttttttttttttttgtcgcccaagctgttgccccaagccggggtgcagtggcacaatctcagctcactgcaacctccgcctcccaggttccagcgattctcccaccacagcctcccaagcagctgggattacaggcacttgccatcatgcctggctaatttttgtatttttagtagagacagggttttggcacattggcctggctggtctggaactcctgacctcaggtgatccacccacctcggactcccaaagtgctgggagcacaggcatgagccactgggcccggcctgcactatgtgacttttctattaaatgcaacacttaatggcaggagattctttaaaataaatacatttttacaaagaacttacatggaagagttaagcaaccaagtaaaaggaataaaatcagaaaaatagtaatttgacaaagggggcaggaaggctaaagacaatttaaaaagtctcatttccaagaagtgaaatcaggaaatcccagcatcttaactccttcataccttaaaggaagttccttgtagctaacaatttaatctcatggttttttcctttaaataacagtagcaactaacaaatactagaaaaccagtgactaggcttacgtgagatattcaagaaattctggctgaatctgaaaaactagtaactttccatatgcttttataaacctattaaaatgttcaaatccaggcactgctaggccagatgaggctgctgagtgaaactatcccatgagactcagcataatcaagacgagtcctgcaatgaaggttccgtcattaaaaaacccactggacgtgtgttttcgtttcttcatgttttacaaggtcaatatatttgttctgtgactcaatttcaaaaatttgaaattaagcaacattagatcagataattcttaggtttgagaatttcagcagggcctaagcccaagagctgagctggggagataagcaggagggggaggcctcacacctcagataggatcccagcaccgccaggccgccacattttaaaatatcagccactgggtcacctgtgactttcctctgagtcttctacctgagctcatatacagctgatctgtcaccgatttcagaccctgagccctctgctctaggcacttgcctcaggactcacacccaccagtggacggatggcagtgctggtgggagccacgcacacctgacccctgcccccacagccaggcgccacctctgctgccggaaccaccacttcctgaagaaccaaggaggcctcgttctgagacactgccagtcttgcaggaaggcctttgtaaaactctcttaaggggcgccgcaggacctccaaaaggcagcctgcaaggaggcggtgctcctgcagcagccagcaccgggtgggagaagtggccgcccaccagcagagggcgctgcaggcccggccccaacccacgcggaggccacgtgcacagctccaccatccacacccagttccctcccggactgcattagaacgatgatttgcatttttctcattattaacattgtgatcatactaaaaattccagagaacttacgtaattcaaacaacaacttttaaaaatattagcttaagtattatttcaaatatgataaatgcacaatcatattgatataaatctttaaagaagaaagccaccaggcacaagggctcacacctgtcatcctagcactttgggaagctgaggcgggcggattgcctgagctcaggagtttgaaaccagcctaggcaacatggtgaaaccccgtctctactaaaagtgcaaaaaaaaaagaattagctgggtgtggtggcacacacctgtggtcccagctacttgggaggctgacgcaagagaatcacttgaacctgggaggcagaggttgcagtgagccgagattgtgccactgcactccagcctgggcaacagagcaagactctgtctccaaaaacgtcttcaccacgggggtggaaggatccgcgctggcgcatngnccccccca

SEQ ID NO: 916 - DNA, 9391 bp, Homo sapiens
  misc_feature (1)...(9391): n = A,T,C or G
ccgagccccaggctggccgttccggtacacgtcatgtttgtcccttgatctgcttttaagttttcacaactcttggttttattttatcaaaatatagagcattcaacgaatagtgacaaaagagcaaagctcccggaatgtgctgggtgcagctttgggtaatacatatgccgaacttctctttaagggtccacgcgcagcctcgggtgtgaatgaaggagaagagatcgtgtaccacacatgatgcttacggagcataacacggcagggggcggtaacggcaagagcgtccgcaggcccagccctgggataccattctggcaggagaaacaggcaatacagacacagacaaataaatgatagatgagaaaagaaagtaagggcatgggcacggaactggcagagaggtcgtcatgaaggtgcaggagcttaggtgaactacccaggttgggggaacagtcctcaagaccattatcacctctgacaccaacggcaaattctggcggtttccaaatccaccttcaagttccataatttgctagaaggaatcacagaatacactaaaaaatactgtactcacaactatggtttcttagcaggaaaatgatacggattaacatcagccaaggaagaagggcagagggggagtctggggattacggcgtgcagcttcaaggtcctcccgtggtcctctccctgtgtagtcaggcctcattacttgccctgcactgatgtgtggccttacacacgaagtactgccagccagggaagctcacttgagccacagtgtgcagaacgtttactgggctccattgcatgtgcatgattgattgattgtttgattgctttcatgcttgatctcagcctcttggttaagtgatatccatgtaaccctaagcccccaccataaatcacactgttactctctggctagccgaagactcccaggcaaacaaagattgccttccaggaggagaaggcaaggccagatttgtttttaaacaaggttaaagtctttactgcctcctggaggaggtggctttggtctgaccagaaggcagcgctaagaaatctgcttgagagcaacaggctacacattaaaaaacaggacgttttggacttggttctaggtgtgatgtggttctgttacccgatggaaggtcttgacagccagttgtccaggtgagtgtggtggcgggcaccctgtatcccagctactcaggaggctgatgcatgagaattgcttgaacccgggaggtgagcttgcagtgagccaagatcgcaccactgcactccagcctggacagtaaagcgagactccgtctccaaaaaaaaaaaaaagatatgttttttctctccatatcctgaacttccccaccagaatgcctcctggaccccgcaacaggcaagtgcttttctttcggccttcttgcctctgccaccaccattttaattctccctctctggtaaatactgggccctccctcgtttctccctctctcccagtggatttttcaaaaacatatgataatattggcagcagctggatggtgttgaattggcaaccaaaactttttgtttgtttgtttgtttgtttgagacagagtcttattctgtctcccagactggagtgcagtggcatggtcatagtccactgccgccttgaactcctgggctcaagtaatcctcccacctcagcctccaaaagcacagggaccacagacatgagcccaccatgcccaacctcaaaactttccttatcctgccagagaaaaaaaatgaagttgtgaataatcgttgtgggaattcagggaccctgaatggagggaccggctgaagccatggaagaagaacataaattatgaagatttcatggacatttattagttccccaaattaatacttttataatttcttatgcctgtctttactgtaatctctgaacataaattgtgaagatttcatggacacttatcacttccccagtcaatacccttgtgatttcctaggcctgtctttactttaatctcttaatcccatcatcttcgtaagctgaggaggatgtatgtcgcctcaggaccctgtgatgattttgttaactgcacaaattgtttgtagagcatgtgtgtttgaacaatatgaaatctgggcacctagaaaaaagaacaggataacagcaatgttcagggaacaagagagataaccttaaactctgactgccggtgagccaggcggaacagagccgtatttctcttctttcaaaagcaaatgggagaaatattgctgaattctttttctcagcaaggaacatccctgagaaagagaaagcatccctgagggtaggcctctgaaatggccgctttgggggtggctgggcatggtggcatgtgcctgtagactactcaggaggctgaggcaggaggattgcttgagcccaggaggttaaggctgaagtgagctgtgactgtgccactgcactccagcctgggcaacagagtgagaccctgtctaaaaaaatatatatatacacatacacacatgcactataaatatatagtatatacatactatacacacacatatagtgtatacatgctatatacacacatatagtacatacaagctatatgtatatacagatcgcagctgtagggatgaaataagccccagtctcctgtagccctcccaggcttattaggacgaggaaattcccgcctaataaattttggtcagaccagttgtctgctctcaaaccctgtttcctgataagatgttatcaatgacagtgcctgcccgaaacttcattagcaattctaatttctccccggtcctgtggtcctgtgatctcgccctgcctccatttaccttgtgatattctattaccttgggaagcatgtgatctctgtgacccacaccctatttgtacactccctccccttttgaaaatcgcttataaaaacttgctagttttatggctcagggggcatcacggaacctgccgacatgtgatgtctcccccagacacccagctttaaaatttctctcttttgtactctgtccctttatttctcagaccggccaacacttaggggaaatagaaaataacctacgtgaaatattggggatgaattttgcccaatatctggctgaatttcccctgataaataataatgtgtaatttatcatttttgttcatattacatacatacatatgcagtcaaggtgtttttggggtcaaaacatcaaccagatcacaacagtgcgttcaaaacaccatcataacagccaaacactaaaattgaatgaaatctacatggaggctgaggtgggaggattggcttgagcccaggaagtgggagctgcagtaagctgtgatcatgcaactgctctccagccgggtccacagagcaagaccctgtttctaaaaaataaataggtaggtaaataaatgtttaaaaaacttaaagaagaaaacgcgaaagaggcagaggaagaggaagaaggaaaaaagagaggaagaaggaaaaaagaaggaagaaagaaaaaaggaaggaaggagaaaaaaggaaaaagaaaggaaggaaggaaggagaaaggaaatatggaagaaagaaagaaagaagaaggaaggaaggaaggaaggaagaaagaaagaaagaaagaaagaaagaaagaaagaaagaaagaaagaaagaaagaaagaaagaaaagagaaacaaagggctaagttacattcccgagaaaatctgactggagcctgggcaacatagcaaaacactgtctctgcaaaaaatttttaaaaattagctgggcatggtggcatgtgcctgtaggttactcaggaggctgacgcaggaggattgcttgagcccaggaggtcaaggctgaagtgagctgtgattgtgccactgcactccagcctgggcaacagaatgagaccctgtctaaatatatatataatatatattacatatatatataatttatatatatattatatatattatatatacattatatatataatatatataatttatatatatatattatatattatatatacattatatatataatatatataatatatatatacacacacatccactgtaaatatatagtatatacatactatatgcacacatatagtatatacatgctatatacacacatatagtacatataagctatatacacccatatagtacatacaagtggtatacacacacatataggatatacatgctatatatactcatatagtacgtgctacatatacacatatatagtatatactatatagtatgtatatgctacatagtatatagtatatacacacatatgtatatagtatatacatgtagtatatatacacatatgtatgtatgtatatatgtatatatagtatatattgtatatatactacgtatatatagtatatattgtatgtatactacgtatatatagtatatattgtatgtatactacgtatatatagtatatattgtatgtatactacgtatatatagtatatgtcgtatatatcatatatatactatgtatatatagtatatatcgtatatatcatatatatactatgtatatatagtatatatcgtatatatgctacgtatatatcttatatatgctacgtatatatagtatatattgtgtatatactactgtatatatggtatatgttgtgtatatactactgtatatagtacatatacaatatatactatatatgtatatacagaatatatacatatatgtatatacacaatatatacatatatgtgtatacacagcatatattttatatgtatatacacagtatatactgtatatgtatatatatacacacagtatgtactgtatatgtatatatacagtatatactatatatgtatatatactgtatatactatatactgtatattctataatacagtatgtacatgctatttatcgtatgtatatactataatacagtgtatacatgctatttatcgtatgtatatactataatacagtgtatacatgctatttattgtatgtatatactataatacagtatatacatgctatttatcatatgtatatactatatttgtgtatagtatgtatatactatatgtgtgtatagtatgtatatactatatgtgtgtatagtatgtatatactatatgtgtgtatagtatgtatatactatatatgtatagtgtgcatgtgtgtgtgcatgtgtgtgtgtatatatgtatgttttttttagccagggtctctgttgcctaggctggagtgcagtggcacaatcacagctcacttcagccttgacctcctgggctcaagcaatcctcctgcctcagcctcctgagtagcttacaggcacatgccaccatgcccagcatatacatatagtatgtatattctgtatgtataatatgtatatactatatatgtatgtataacgggtcaagtgctccgtttaactgtgattctaggactttctatgctggcccaactctggcatcttgcaccactttcccatgattcttcccttagggtggcctgcccgcatgtgtagtgctttcttcatgctggggaagtgagcatgtgcagtatgtttagcaagctgtacgcatgcccatctgagactttcttccctttcctagcagagagccccacaggaggtcatactccgccattttgtctcttaatgcaaatgctcagactcccttgcccaatacctgagattttattagaatccctttctgcttctcctggcacttgccttcaattaacactctaatataaccgctgcagaccatcaggagattgtctctcgctggcgccagctgctgaattatcattttgagagaggcagtgtgatcattgttgaaccagcacctgatggtctcctgacattcctggtgggtcaggggagagccctctcctgccccactcatgcctgtctacctgtaacaggctgaagaatggaccccaacagaagtacaccctaatcctcagaatttgtactatgtcaccttagatggcaaagtctataatcacaggtcatagactttcctggagtattgggagttagctcagtctaatcacacaagccctcaaaagcagagcactttccccagctggaataaaagatgtagcagagggggaagtcagaccccaagtgtaaggatttgatgtactcttgctagctctgaaatgtaggggccccatgcaagggcccaagagagacctctaggagctatggatggacctcagtacacagccagcaaagaaatgggaacctcagttcttgagctgtgaagaactgcattctgccagcaataggagtgggcttggaagtgaattctcccttgtgcctcccaacaagagcccaggggctgcaccttgatttcagccttgtgaaacccagagtagagagccagtggagcccactcaggcttctgacctactgaattgggagctaacaaatgtgccttatttaaagttgctacgtctttttttgttttgtttcattttgtatgagacagagtctggctttgttgcccaggctggagtgcagtggcatgatctttgctcactgcaacctctgtctcgcaggttcaagcgattctctgattctcctgcctcagcctcctgagtagctgggattacaggcgcccaccatcatgcccggctaatttttgtattttaagtaaagatggggtttcaccatgttggccacgctgacctcgagctcctgacttcaagtgacccgcctgcctggcctcccaaagtgctgagattacagacatgagccattgtgcctggccctagagttgctacatctttatcattgttacagcagcaacagaaaactagcagtcatttagtaaaattaggtatttagctcctgaagaatagggaatataggctggaggatagataatatattatgtaccccttgtcaagaaatgttacaagtgaatgaatgaacagggcaaggaaggtgatttattgatcttggtagccttccctaccccacacagctatgtttctggtggacatgaactgaataaatcaaatattcagttagtccccagggaatgagaagggcatatatagagttagaacagagctgaatgcattctgaaatcacaataggaaacagatgtgagagtttacaggctgcagactcatgggcaatatacacatcttctattcagtctaacataccccagcttttctctgtacagtctagggttttcctctgcaccattggttttatttctcctacttgactcacccatcagaaatggttgttggccagtggttcatgcctgtaatgccagtactttgggaggccagctgatcagttgaggtcaggagttcgagaccagcctgagcaacatgatgaaaccccgtctctactaaaaatacaaaaattagccgggcatggtggcgggtgcctgtaatcccagcgacttgggagtctgagacaggagaatagcttgaacccaggacttggaggttgtggtgagctgggatcacaccactgcactccaacctggacagagcaagactctgtttcaaagaaaaaaagaaaagaaaagaaatgaaatttttttttttttacttttaagttcaggggtgcacgtgccagtttgttatataggtaaacttgtgtcatggggggttgttgtacagattagtacattaccaaggtactaagcctagtagccattagttatttttcctgatcctctccctcctcctaccctctaccctccaaaaggccacagtgtgtgttgtttccctctatgtgtccatgtgttctcaccatttagctcctacttctaagagagaacacgtggttatttggtgtctgttcctgcgttcctttgctaaggacagtggcctccagttccacccacgttgctgcaaaggacatgatctcgttctttttttatagccgtgattcataagcacactgaagtttgagcccacactctaaagattagagcacattggcaacatggcctgcagatgtatgggattcttagattcatattcgtagtgtttgtgttcctcggtgtacaagcctggctgaacacctcgactatacagaataaggtttccagcaaataggcagagaagccggcagaaagggagatgggggaacaggggggcttagcatcgtgtttttgtttttgtttttgttttgaggcagggtctcactctgtgggcccaggctggatgcagtggccccatctcacctcactgtagcctctacctccctggctcaagcaatcctcccatctcagcctcccaggtagctgggactacggttgtgtgtcaccacgacccactaattttgtttattttttctgcagacagggtctccctatggtgcctaagctggtcctgaattcctgggctgaagtgatccaccctcctcaccctcccaaagtgcctggatatacaggatgaagcaccttccttaccccgggactgttgtttaaaaaactgaaaccttaatacattaaccctttattataaagaatgagttgcctttaaaaagaagggacaatctcggtcttaaaggatcaaaaattggaatacatctgtccaacttcccacgaaactctgggaatgtattatccccgcggagggcggcccgtggggggtttccacgtaacccagcctttagggagtgaggggagagctcttttgggacgtcatgcaacgcgtgaaggtatgaagagcggccctttaatgggataaatctaaagctgtgtgcgcccgggcgcccccgtatataatattcaagtatgttatccttttaccgacccaagagggtntaacgttgtataaattaaaaaaatatcttntccctttnntnnnnaaannaaaanatttttaanaaaaaannnnntnnnnnnnaannattacccccttgttgggtgggantcgataagagctctgtgtccatacgtatcgcagacggnnnnnnnnanannnantcgagntngtanannaanaattatacacccccgtannggnnagacttcgaaagtaatgggattcgcaggaatacantaccctccagtgatcnntngacgtataatgggggggggtgaatgaaaacgaatangttacccgtgccnancnnggancantatgatttaaataantgtgtantgngganccngancanaanngactattnacgtatgatggnnangntntttgnnncggaannngnccanttnttntgnnnngngaangggtannnannnnccnnnccctgctcctgccgacttgactcccactccgccannccnnaccgcctgctgnntnncntacttttnnnnnccgc

SEQ ID NO: 917 - DNA, 5751 bp, Homo sapiens
aagtgcgcgaccttatgcccgcggtgaagacaacctcgtctctacaaaaaataaaattagccaggtatggtggtgtgcttctgtggtcccagctactcgagaggctgaggtgggaggatcccttggatccaggagttcaaggccacaataagtggttatcacaacactgcactccagcctgggtgacagcgtgaggctctctctcacaaaaaaaaaaaaaaaaaaaaccaaactaaaagttacagttcatgtctcacgttcacaaaggtcttcccaccggctaactgctaagtctaagaaacagcctggggttacagaatgtgaaatgcagtatacattcgtaattccttatccagaatgctgaaatccacaacattatgaaaactgggttttccttaagctcgatgtcaaaattcaatgagcggcaaaatctgacctaaactgagtcatggctatttataatcttaactcctcccccttactgtgaatactcacatttcactggagagctgtgtgaatgtgcctgattacagggtgcagtcctagaccccacctggggattacataatacacctcttatacattgtactatcttcctaaaatctgaaaaattctgaactctgaaacacatacagccccaaccattccagagaaagcactgtggacctatgtaacatgccctggtccaagaagaaactcacttgccatttgaagaaacaaagcatacagcacaggaaaagatatcctgtgatacaaggtaagaaacctgcctgatgacagggctgacggaaggaagaaagaaaggggacaaaatggttttaggtgcaaggatttggagaagaccactgtatgaagacagcccgctgtgtggccagagtgacgccatcctgaagcaaaaccaccgtgatgaccgatgctcgactcgtgcatgccaagctgttctgcaatgaggtctgaagacgatgcctccggcacaggcaacctctcatcaagatgctcatccagcctgaccagtggtcccaagtgttgtcaagcaagtcagaagacagggccggctgcacacgttctaccctgaaagcctgctgtataaagaacactttctgagggcaggcggctgtggggtccaccgtctctgtctctcgggggcttctgttcgtacgtccctagccaatgtttccttcgagaaactggatttgttagcctctttctttggcgtctcagctcgctcagcctttgggggtgagtttgcatagacctgctcacttcggaatagccacatggagggtttagaatttaacagacttaaaggaattactaaaaaaaactcccaacacgtatatgatacttcattgcttataagacactttcacaaacagtactgcattcgatagagtatgattgcaagagaagaaactggaaatgaattctgtgggctgagatagaataatgtgggaaagagagaagagacttaggcgatctgatcacgccaccggattcacatggggagtgaagacaggatggacctgcaggagagatggtgcggggccttcaagcccaggctggggaactctgtgctagaaaagcgctcaccacagagtcccagagcataaatcctcacagtgcaaccggctgcctgtaatgatgactttcactttaaaaagtactaacagatccctgaagtcaaagtggtttgtaaaaactttttcatagaaaagcagtctagtcgacatcatgattgagcatttctgccaggatggagcaacagggaccgtattttccctgccacttgaaataaccacaaacccaccaaaatctacaaaacgatttccaagacactgagcatcaggccacacactgattcccaacagatggaaacaagccaggtgagcctgctgctgccctcagacggaactctcgtgtcagccacagagcagaaagggcccaggtggagcccaggggaagtcctaaggcaaaggcacagagctcaggggagaccaaggcaactggatttgcaagatggagtatgagagatgagagagatgcagagagcgagctgcacagaccccgcatgctcactggagtgctgaccagcatgccagagggaacacgctgccaggcagacgagggtgccatgaggttcacggccatcagagcaggtgctcagaagggtcttacctcaggagtgaggaatgacaggccctcaaataaagctgctctgctccctctaaatgcaagatcccaaaggctaaaccatgctcatgtgatttaactacattctaaaacaaagcccaaggagatttacaaaaatactcaaaatacagaaatactcagcacccaacaaagtaacgttcacaatgtctggcacacactcgaaacttaccaggctcgcaaagaagcaggaaaacacaagccacagaaaggaaggaaatcaaccaaccagagcagacaggacactggagttggcagacaaagacggttcaagttactacaagtgcgtcccagttgtacagtggggagcaacacagcagacatgtaaaacacccagcagaactagcaacagaaaccagtgtctccgatgaaacatacaccagaggaggttaaaggcagatcagacaagcaagagaaactgaccaaaaccaaacacactggaaaagagtatctaaaacatgaggagcctcgctgagctgtgggacaaggtcaagcggcctggcgggcatatgacaacattctctgagggggatgtgcggcgttgggagccgggatgggcctgaggcttcatctgacctgcgagctgacacgctggcctgccagggctccgtgggggccggcagaaggtccaaggccccaggtcagggacaaagggatttcctactcacagcacagcaggcaacctgaggctcatgagcagctgtccacggcccccagtctcatggggagaggcagagcagctgcagtgggacgtcctcacagtgggtttgtgtcacagctgaaggacccgagcttgggaaccccaatctttcacaatggggagtctacaaacctgaccaacctttatccctgaaacagacccgtctgtccccgaagaaggcgccatctccactgccacagccaactgtccccatagacacccctgaaaagagtctggggcaatagggccgctgcctctgctcacagacaaggagagatgtgaggagccatgaagatgcccccgaaccagggcagggcgggactgaggacacagaaacactcaaagaggaaatgactgagcactctcccaatctccctgaaactctaaaagcaacagcaatgagcaaggtaaaccccaccgcttaggacttcctgaagacaggaagaacaggtttgcctgactcacggcataggaagctacgagtggtctttgggttttacactattggtgaaaatagacatggatttccttttctgaagttaaagtcatttgaagtgagaccttaagggagaaaaacatgattttaacaaagacggagtctccattactcacttatctccagctggcgctggatgcggcctttgctccgctcccgaaacagagtctgtgcctcattgtactccgccatggcttccacaaacttccgagacagcaccgaatgctaacaacacaggaaaactacattcgtatctgagggccatgccttctactgaaagtgacatgcaagacatgcattttggaaactcaaactacatgttattctgctcctgcaaatggaaaatgacaatggcaaagtccccatggcagcatctgtgctaagaactttgcatgcatgatcttacctaatttttacaagacccctactatgccggtcacaaccctacttaaagaaaaccatgactttgaggtcattagcccaaggtcacaggcttttctgataaacacagatcagcactgggacccaggcaggtggaccccagagcccgcgtgcttcatcgccttgtgcccatgaggggacccaggcaagcggaccccagagcccgcgtgcttcatcgccttgtgcccatgaggggacccaggcaggcggaccccagagcctgcgtgcttcatcgccttgtgcccatgaggggacccaggcaggcggaccccagagcccgcgtgcttcatcgcctcgtgccctcgaggcctcagggctctgtcttcctctgggcagtaccacaaaccactaaaacgtggcggccttaccacaaacactaaaatcatttggataattccctactctttggaatagaactctgttgatggaccgaatagatttttcttcacaataaagagatttctataaatactgtgaaaggaaaataaaatcgcaggacctcacactcactatcccaaagggacagttaagcttgggaactgagtcatgcaaaacactgccctccctcctcttctcaaacagatggctgcagtgacagaaggccgcacatcgccccagcagcctcctgcacaaagtgctcacaaggaaattcctcgtaggtcccagaatctttcagaatccatatcccccccaccaaaaactaactctaaaacagagttctgcagaatctcaccctgacaatgtacattagccgcttaccttcacaggtacaggacaaagacaagactagaagtcaccctcggcccaccctgagaaatgcatgtatagctcctccctcacctcaggctcacactggcccacgtaagaggcggatctgggcacgggaggagtgcagaatcgacccccactcctctcttcccacatgtgaaatgtgaacgcagtgagccctgagcaaagcctcacagcagtgtggccaccccgctgcctacccccactttttctcttttttttcccctttcctccttcctctcctgcccgctctttcccctttaaatactgaagtcctcaaaaccctcttcaggaaaggcacaaaccacagatcctactctaatttgtatttcttttctccaagtgtgtcctcaactttggcaaaataaacctctgtctcagatacttttgttttacaatactatattatttttgtgcagaaatactatgaggataagcatgacagtaaagatgaaattattcagagtctgcaagaagaaagtaaaaacacttattctgcgacattactttaatctaaacgaggctgatagcaaacctgggttcttcgtatccgaagatccactgaagtccggttcccactctcatcctgatcaaaactttgttcaatagctaggaacaaataggaaataattaccttccaaatttaaaaatgaaaatgttccaagcctgacttcaaattccttttatttcttatctttgaagtatctttataaaactaaagctaatgaacaagtgaccttctaaaacaatctactaaaaagacaatccctcaataggaaattattttctgagacaaggtctggctctatcacccgggctgcagtgcaggggcacaatctcgtctcactgcaacctctgcctcccaggctcaagcagtcctcccaccgcagcctcccgagtagctggaattacaggcgtgtgccaccacatccagctaatttttgtatgttttgtacagacgggattttgccatgttgcccaggctggtctcgaactcatgagctcaactgatccgcctgccttggcatcccaaagtgctggcattacaggtgcgagccactgcgcccaaccccatcaagaggaaacatgtgttcaccaggggctaaaggtcctcaat

SEQ ID NO: 918 - DNA, 6802 bp, Homo sapiens
atggcgcgtctgcttccagccccgtggtgaagacggaatggtttctgttttgcttcttcaaggaggggaactgaaacccaactaaatccaaggtgcctcttccaacgcctgtaactaaacttcaagcatcacagccccaacacctgctgatggcaccattttaactgaggtccatcccgcaagcttcccgactgtccacactggctctctctactcctgtgcaccaaagaaacaagccagaataaatggataaaagacagtgtatgcgcatgcctgtcccagctacccaggaggctgaggcatgagaaccgcttgaacccgggaggcagaggttgcagtgagccgagacggcgccactgcactccagcctgggagacagagcgagactctaaaaaataaataaataaattaaataaataaataaataaaattaaaaagatagtgtaggctacaaacctcaggaagaaaataccagcatgacttcagaatagtcagacctaatggtgtataaagttctcccggctcctctccacccacctccatcaatcccaccctatctctaacccccaagttctctgttcctcgaggttcccatagaacatttaataaacactagggacatgagagagcagcgacatggccctcgccctcgtggcaattagtctaggaagggaaagtcgctatcgcaaatttgccatgctgactagggctgaaggcaatcttgtaatgtctgtagtcggacatccaactcaaggtaaaaagcagagtgaactctaaaggaactaaagcattaactggtaggaccgacttcaggagagggaagggggagttctggaaagcagcatgcacacagatctcaagatgcacgtgtgaccagagcctgcaagaccttgtaggaaatgtggagcaggcgagatgcatcagatgttttttgaataggactctgaccccttaactaaagataaggtttccatggttaggtgccgtttctccccaccatgccctcggcttcaagggtaaaaggtgctgcaaggagttaggataggtgctgtcctagtacagggtctgcctcatacagggaaagcttagtctcacgtaatcttgctgggcaggatagccctgtacagcccgagtggcagaaaacatcatacacgatgtccgtcagtttgctggcaagaaaagctgaatccaaccctcatcccatttgctcagcaggtaattttttgtgtttctgatctgtttttgcaaaagaaaccagaaattctctgtacttgagttccttcaggtgaacagttagccaggaaaccagtcctctttggaggctattttggagtctcatcttttctagacattttatgattgatacaattttttaaaaaatcccattctatgtggttttttaaaaaaactggctctcacacaaattgaaactactaatttaccagtttcacattatatccacacaagacctatgcactaactatgctttttcttaatgactttgctctaataagctattactggtttgcagtaacttcatataaagctttcaaggcttcccccattagacacgagatttcaaaaaatggagagcagacttttcccatttgtacaatctggagagaactgaccccttccccgccgcccccccaaaagataataatctctgctaactcttcagcatttcctaaagcaaatactagagatgattcaaaaaatccaggcaaagtagaagcaatatattttgcaacaattattctttcaataaaggacttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattatcctaatagacctaattcatttttaaatgtggaaaatatgcaagataaattaaatgcttagttaaaaaaaaaaaaaagtttcaccaactgttctccattactgagaagcccccacactgccccactgtgcatattcctagtatttcatccatgtcctgctctgctgtgctgccctacaaaaaaaccctcccgggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctagacgaagagatggaaaaacgttaacactccagatcaaaactgccaggaataaacaagccaaaccgaacaatctgaacagcaaagtggccacaatacctctaagtcgtgctcatactgtgctgccaaagctgggtccatgacaacttctggtggggcgagagcaggcatggcaacaaattccaagttagggtctccaatgagcttcctagcaagccagaggaagggcttttcaaagttgtagttacttttggcagaaatgtcgtagtactgtttaaaagaaaggtaaaattactttttaaaattcattattaagatgacgatttttctaggacattgcaagataagaaaatgttaagattcttggcaaggcatggtggctcatgcctgtaatcccagcactttcgggggctgaggtgggattgcctgaggccaatagtacacgatcaggcctgggcaacagagcaagaccccaactccacaaaaaaacaaattaggtgggcatggtggtgagtgcctgtgagcccagctactcagaaggctgaggtgggaggattgcttgagcccaggagttcagggctacagtgagctatgttcatgccactgcactcctgcctgggcaacagagcaagaccctgtctcgaacaacaaatatataaatacacaaacatttcagctgaccaaccgggccaacagtgaaacccaatctctatcattctttaaaaacagtagtataaaaaagacaaaattatttccggccgggcacagtggctcatgcctgtaatcccagccctttaggaggccaaggcaagtggatcacttgaggtcaggagttggagatcagcctgaccaacatggtggaaaccccgtctctactagaaaaaaaagtacaaaaattagccaggcgtggtggtacacacctgtaatccagctactaggggagctgagacaaaactgcttgaacccgggaggcggaggtcgcagtgagccaagattgcgacactgcactccagcatgggggacagaggaagactccgtcttggggaaaaaaaaatcatttccatatataatagacactggttaatttcatggtcttacatataatctccgctaagagaaataactcaggaagttttaattttacacacctgaagattcttctttcggtggaagacaatggatttcgccttcactttcctgtccttaatatccactttgttgccacacaacacaatggggatgttttcacacactcgtaccagatctctatgccagttaggcacattcttgtaagtaactctcgatgttacatcaaacattatgatggcacactgggctgaagaaacatttgtgggaattagtacactcagtttactgcacaagtgaagaatgctaagaaccagagactaggattcaactagttatagtcttagacctcaacgagtcacctgtatctctcccctcactttcaaggtctctgtcaattctaaaaatgttaatacacaattcctcctaagagagatgagctgaccctatcaaatctccctgatatacttcaccattaatactcccctcatcccaaaaaagtatctgaagtaattaatgctaaatgagattctggataaccaagctgccatattctgagggtagggcctggaaacacattcttcagaaggtctttaaatggctggctatactggaaaacattattcctgtcttaaaaaatccagataggccaagcaatgtggctcacgtctgtaatcccagcactttgagaggctgaggtgggtggatcacctgagctcatgagttccagaccagcatgggcaacatggtgaatccccatctctacaaaaaaatacaaaaattagtcaggcatagtggcacgtgcctatagtccaagctactcaggatgctgaggtaagaggatggcttgagcttaggaggcggaagctgcactccaggttgggcaacagagcgaaaccctgtctcaaaaaaaaattaaataaataaataacccagataaagcctatatattcacctgcaggaataactatggtacagttagcaaggcaagaaaccacaactttttggttaaaggattcttttgggggaaattcttgtgtttatttgtacatgctcaaggaaagcaaaaggcatggaatgattccagataatgtgttatcggcaacgtgaggttccaagagagatgagtattttcttgattcctctttttggtacaatgaacattttccttgcaatttttaaatcaaactatttgagaaaaatactctgcacaacttagtacaaacaatttaacaagaaatcagctagtcttgtataacacttgttaagatctcctatctcctctggtctagtatctggtgtttattgttttctaatacagtaaaaacattcattgatcaccacaccaaaatacatacatgaacctaagtttccaaatactgaaactgctgttaacagcctattattgttttaaatatgacttataagtcccagtgtaagtcatagttttttctaaagcatgcctagcatgacacagcatgcaaatgacacaactttaataaaattttctctgccaccaaaatggtggtcaactccccgaagtccacttgtctttttttaacccaaaaatgacactatttgttggaacagacctgattttctataaccttgaagactgaagtacacaaaacctctcaaaaaccgttcagcaagttacaaatgcctaccttggatataatagccatctctcagtccaccgaatttctcctggccggctgtgtcccatacattgaacttaataggtcctctgttggtgtggaacactaggggatgaacctcaacacccaaggtggctgaaacggaaacgatgcgattgagtggatgaacttacccatttctcacatatttccacaagcaaggttttccagcacatacctacatacttcttctcaaattcaccagtcaaatgacgtttcacgaaggtcgtttttccagtaccaccatcaccaaccaatacaagctgttgaaaaacacattttggaagtaaaccctaaacacttcacctctcaagatcccagagtcacggaactttaaccaccacaggctcacttaaaacaaagaatgtggatgcggggccccattacagccatcgtggccccaggaggagggacccgcgagtcgcacgcggtcgggctcggccgcctcccgccccgcagggttacctactttgaactggacctggggctctccctgcggtcttc

SEQ ID NO: 919 - DNA, 5267 bp, Homo sapiens
ttgatgacgcacatgatgcaccccccggtgaagactcactaaatatgattcatcacataaacagaactaaagacaaaaaccatgtgattatctcaatagacacagaaaaggctttcaataaaattcaatattcattcatgttaaaaactctcaataaactaggtattgaagaaacatacctcaaaataataagagccatctatgacaagctcacagccaacatcaaactgaatgggcaaaatctggaagcattccccttgaaaaccagcacaagacaaaccagcacaaggataccctctctcactactcctatccaacatagtactggaattcctagccaaagcaatcaggcaagagaaagaaataaagggcatccaaataggaagagaggaagtcaaactatctctgatggcagatgacataacctttttttttttttgagacagtctcgctctgtcacccaggctggagtgcagtggcacgatctcggctcactgaaacctctacctcccgagttcaagtgattctcctgcctcagcctcccaagtatctgggactacaggcatgtgccaccacacctggctaattttttgtatttttagaagagatggggtttcaccatgtaagccaggctggtcttgatcccctgacctcatgatctgcctgccttggcctcccaaagtactgggattacaggcatgagccaccacacctggcctagataacataattctatatctagaacaccccatagtctcagcccaaaagctccttcagctaataaaaatcttcggcaaagtttcaggatacaaaagcaatgtacaaaaatcactagcattcctgtacaccaacaacagtcaaaccaagaaccaaatcagaaaggcaatcccattcacaattgccacaaaaaagaacaaaatacctaggaatacaactaaccaggaaggtcaaagtgctctacaatgaaaattacaaaacactactcaagtaaatcagagaagatacaaacaaatggaaaaacatcccatgcttatggataggaagaatcaatatcattaaaatgaccatactgcccaaagcaatttacagagtcaatgcaattcctatcaaaccaccaatgacattcttcacagaactagaataagctattttaaaatttatatggaataaaaaaaagagcctgagtagccaaggcaatcctaagcagaaagaacaaagctggaggcatctcgttacctgacttcaaactatactacatggctacagtaaccaaaacagcatagtactgttttggtataaaaacaggtacatagaccaatggaacagaatagacagcccagaaataaggccatacacctatagccatctgatctttgacaaagctgacaaaaacaatgggggaaaagactccctattcaatcaatgatgctaggagaactggctagccatatgcagaagattgaagctggaccccttccttacaccatatacaaaaatcaactcgggatggatcaaagacttaaatgtaaaacccaaaaccataaaaaccctggaggacaaccttggcgataccgacctgcgcaaagggcaaagatttcatgacaaagatacaaaaagcaatcacaacaaaggcaaaatttgacaagtgggatctaattaaacttaagagcttctacacaacaaaagaaactatcaacagagtaaggagacaacctacagaatgggagaaaatgtttgcaaactgtgcatctgacaaaggtctaatatccagcctctataaggaacttaaacaaatttacaagagaaaaaacaaccccattaaaaaatgggcaaaggatatgaacagacacttttcaaaagaagacatacatgtggccaacaagcacatgaaaaaaaatctcaatatcactgatcattagagaaatgtaaataaaaaccacaatgagataccatctcacacaagtcagaatggcttttatttaaaagtcaaaaaataacagattgtggtgagattgagagaaaagggaacacttacacactgttggtgggagcgtaaattagttcaaccattgtggaacgcagtatggcgatttcccaaagagctaaaagcagaactaccattcgacctagcattcccattactggttacatacccagaggaatgtaaatcattctaccataaagacacatgcatgtgaatgttcatagcagcagtattcacaatagcaaagacaaggaatcaacctaaatgcccatcaatgacagactggataaagaaaacgtggtacatatacaccatggaatactatgcagtcataaaaaagaatgagatcatgtcttttgcaggaacatgaatgtcgctggagaccattattcttagcaagctaacacgggaacagaaaaccaaatactgcatgctctcacttataagtgggagctaaatgatgagaacttatgaacacaaagaaggaaacaacagacactactgtctacctgagggtggagggtgggaggagggagaggagcagaaaagatcactattgggtactggacttaatacctgggtgatgaaataatctgtacgacaaaccccccgacacaagtttatgtatgtaacaaaccttcacttgtaccctcgaaactaaaacgaaagttttaaaaaaatggtttttttaatgaatttatttcaagtagagttgtagtaaaaataggcttgctgttaggctactattatagagtgtgtcctttaagcataggaattctgacgtcttttttatttgaataccattaagaaacaaaataaatttaagatggttcatacttgtgtttgctgcattattgagaatattccggacagaagaacttatcttctcaccgtgcattggtgacagccacatccaccatttgcagtttatatctgaagactgaaagaattagccacagactggctttggtctccacccatttcaaacctcttttctcacccgctactcatgtttgtggtgccaaataccatacatgttatatgatgataaaagctttggtcacacagggtcatgaagaataattcagtacagagagtgggggaagcatgacaggaagtggtaccatgatggctgctgataatacagacccagaagtgacagcaaaccagttaaaacacatccctctaaattcaaattcaaggtaactgtaacttagatttatcttagcctagtccccaaaaatgcccacagcctctctgacatcactcacaccagggaaaacctcggtggaaagatacaatcattttaaatgcttgcagttaaaataaacctgagtcaactttgtgaacccattgctcggtcctctccggggtctcatgagagcttatgcaagggaggtctctgaaatttaagcgtcattggtttcataagtctgtctcttgacaagctgaggactaccttgcttaatatataaagagctcttacaaatcaataagaaaaagaccaacaatccaatagaaaaaaattggcaaaggatatagacacacagttgagcagcccccaatgaggtggtgctacaatacgatctccaaaacatactgagtggggaaaaaagaatggtattatgtagtcttgtatttgcatattagacaaggatgcctgtatgtgtactgactgttacaggatgcccaccatgggaatggcggttacctccatagggagagaggctggggactgagagtctgggagtgaaagatcccttttacaccactatctctcttttactcaaagctctattatttagtaaaaatcattgaacttaagcctaaaaagggtaaatttgctgtatttacgataaaatcttacaggtatttttaaaagctattattaaatatcactaaatttatactatatacatgttagatattacacatattacacatattcacacacatgcacatatatccacataggatgcaagcatcgaagacaaaatcggcccttgataatccaccaaagtaagactgcgccgtgcaggatggaaggttggtatctcaggtcccctgactcctgggttctgggactgtgggaagagctctcctctcatccagagccttgtgccagggggaaggtggagcatccacactcacactagcactcacactcgcactcacacactcatactctcacacacacactcgcactctcacagtcacgcactcgctcacactcgcactcacacactcacttgcactcacactcgcactcgcacacatactctcacttgcactcagtcacactcgaactcgcactttcacactcgcactagcactcacactcactcacaccactcatactcgcactcacatcacacactcatacacacactcacactcgcactcacacactcatacacactcatacactcacttgcactcacattcacagtcacatattcgcacttgcatacacacgctcacacactcactcgcacttgcattcacactcgcactcacacttgcactcacatacactcacactcacactcatacactcacttgcactcattcagtcacatagtcacacttgcatgcacacgctcacacactcagtcgcactcacattcacactcgcactcacacttgcactcacactcatacacacacacactcacactcacttgcactcacattcacagtcacatagtcgcacttgcatgcacacgctcacacactcgcactcacactcacactcgcactcactctcacactcgcactcactcacacacgtgcactcacactccctgtggagacacctgtcccaacagccacagcagctcccactgaggctgtctgagcaatggctccatgtcccggggctgccaccgagcagctcttcctgggctggaaaatcacagtcccacgtcccgccgtacactgctgtggctgtgggtgactccgcgcttgcttcttgtgtttttcagtttcctataacacatacattaactttttaaaaataaaggttactttcaaaacctgagaaaaacagaaaatcacagtccttcagggcacagtaagaaaggctgaaccaccgggcccagctactggggaaacttacccccgagttcaggaaatgctaagggggcctgcgtcccatcacagtgcacacccggtctccctctgcaggtgagacaggccttcctccacctccagcaggggtgggtgtgacgggggtggggaggggggggaggagaaagaggagcagaagaagaaagaggtcttc

SEQ ID NO: 920 - DNA, 9344 bp, Homo sapiens
  misc_feature (1)...(9344): n = A,T,C or G
ataaattgacgcgctccttccacccgtggagaagacttatccctggggcttcacaaaggactgtgcaccaagcgggaggcaacagatgggtgtgaaatgtgggcaccttagagtgctgggtgcttggggtggggcgagcgcgaacagcagcttgtgtctgatctcccagtagtttgctttggaaactgggaccgtgtgttgactctgaacgcaccttacgcgcccagcagccgggcacacagcaagttactgtttactttagcaagggaaaagcaggtcactaaaaattttggaaggatttcgatgcattctacacgtgtaaaggtgacaggactgtgcatggtgcagtgacagcggaatgatagtgatggtcgtgcactttccaagcttgtctaacccaggacggcttaggccagcagaagtagttatgactttttccctttacaatacaggtactaattcatgctacgtgtgtgcacagatagagcctctggtctctaaattgttggcagcctcagaacaggggtgctaaggcccacagccctacgacacccactgcatgtaatgaattattctctctcctctgctgctagaatggagctgttatgtacccccgagtgggagaatagagaaaagagccacttaaatcattatctgtgttctgtggttcagatgaggagctctggttgagaaaggcaatgatttcatccttaggatcatggaaattatgctttatattcattccaaggaagtttcttcacggtgatttttccttttttattaatggacaaatattccctgtgttccgcagatcaatatcatcttaaacacagcaaattatagttgtgttgtcttgcccgatggattatctttcagtgccgtgtagtaggagctcaggtacacactcaatgagagaaagctgtggctcactcctgtaatcccagcagtctgggagatcagggtgggggcatcacttgagcccaggtattggagaccagcttgggcaacacagggagacactgtttctcgaaaaaaattaaaaaattagcaggaggccagtcgcagtggctcatgcctgtaatcccagcactttgggaggccgagttgggtggaccacttgaggtcaggagttggagactagcctggccaacatggcaaaaccccgtttctactaaaatagccggatgtcatggcgcacacctgtagtcccagctactctggaggctgcggcaggagcatcgcttgaatccaggaggcggaggttgcagaaagccgagattgtgccactgtactccagtctgggcaacagaaagagactctgtttcagaaaaaccaacaaaacaaagcacgcacaaaaaaactatccaggtgtgactcgcacctgtagtccttggtactcaggaggttaagctaggaggattccttgagcccaggagatagaggctgcagtgagccatgattgtgccatgccactgcactcctgcctgggtgacagagtgagacattgtctcataaaaaaaaaaaaaaaaagctcaatgtcattgaacgtgagagctgtgactatttaggcataatacagccacatttatatgttggggaatcgtgagaaagtaagttttcttggcttgaatagcaaaaagcaaataaggcaattatttgtcactcagtttctatatatccaaacccttcctgaaacagtagaacatgtcaatcagttttgttctagaacggcagagctagaagtcagctcatctacttcaataccatcctgctttagacacagcagctgagcagtcagagagtatatccgtggaagtttccactcatggagtttctcatcttgggcaaataatttttaaatctctcaaaactttttcttgtacgtgaaatggggacagtggtatctctcttgtccacctcatagagggagttatgaagcataaaattatctaatgtgtgaagctctgggagaaggtgggagggagcaagtgctatgtaattataagtgtgattaatgtttaccagattttttgtttttagggagttataaaaagcagccttctggctgggcacagtggctttcacttgtagtcccagcactttgggaggctgaggtgggcagatcatttgagctcaggagttcaagaccagcctgggcaacatggcaaaaccctgtctttacaaaaaacatacaaaaactcagccaggtgtagtggtgcatgcctgtggttccagctactcaggaggctgaggtgggaagattgcttgagtccaggaggcggaggttgcagtgagccaagattttgccactgccctccagcctgggcaacagacagattgagaccctgtctcaaaaaaagagaaaagaacaaccttctccctagtataaaatagtaagttaaaactgaatttgaagtttaataacttttaatatttaaaaacccatcttaaagttaccagatacaagtttaattcccctcccccgccccgccccaggaaatgtgtcctttcccagtagttcttagagtagttgaatgtgtactcacaaccgtgcttgtaaatggctggtgtttttttctaggtaaagttgaatattttgttggttaaaatgcctcatcaacaatgtctgattaacaaagtatttgtgatgcttccatgaagtttcttttcttagctgctgatgcttgttcctgtgaagaacgtgcctctgacagttacgtggacagggcttaaagagtaatctgctcaatacaatctgtactgacagatgtagtttctaaccagtgatgctgtttttgagcaaccagtcatttgggcatagaaagtttgcgtgacttggtccagatctctgacactctaaatccagaaagatatttctgatttacagaaagtaaaagactcgcccatccagcaggtacttgaatgtcaggcctctagcagatcatgtgctgggtgcagagagacacagcagtgaactgagcgtgggtggggatgcatgcagcctgggaaggaagagtgaccgaggtgtaatgaaattcactgtaggacgtaagcaaaatggaatagctattctataagataaccaccccaaacgtattttgattactttttaaaaaaagtttatgaacattgatgtatttatatttgatacatatatatgatatatctatttattatagtgaagaatagagaaaccacacatttcatctgtgggaattgtttgcatgataataaacaataaatacacagtagctgtgtggtgttcttagtagacctaaaagaaatgagaacgttatttttcatcctggtttcaaggtgatgaattgcaaatctcttttttttttctttgagacaggatctcactgtgtcgcccaggctggagtgcaggggcacgatcattactcattgcacccttgacctcccaggcgcaagccatcctcccgcctcagcttcctgagtagctaggaccacaggcgcgtgccgctgcacccagcaaacttctgtattttttatagagatggggttgcgctgtgttgcccaggctggtcttcaactcttgagctcaagcaatctgcccaccttaggctcccaaagtgctgggatttcaggcgtgagccaccgtgcctggcctgcaaatataatttcttaaagggcggaaaacactgctcagatatttttaaaagttattttttgacagctcatgtttgtccacgtagtgcagaatgttgtatagtgaagatgcaggttccaattcataaaataagaagattaaaaaacttcactggaacttaaaatactaagagtttaatatatgaacataattttatatatgcatatatttatagtttagaatgtcataacttatgcaatcctgccaaatttttatattttgtgtgttctcatacaaacagttcctacagttggagtctatagtttctctattcttaattataataggtttactcatttgtatatctaaacatgtcctttagtttgaagagcaaaatctatatgtttttacagattaatcacttcttgtttttaacttgaggtctattctgaatttaaggagtagcaactgtaagaaataactgatccatagaagagctccctaggagcccagatctatcgccttgtggtggcaggatttgctcctgcctccggactgatacgcccctcctccctgcccttgcaggtgctgctccctttgtctgaaccactggacttctccctctgcgccttctctcttgccttgtacctttttttttttttttttttttgagacagagtgtcgctttcttgcccagggtggagtgcaatggtgcaatctcagttcactgcatcctccgcctctagggttcaaggaattctcccgcctcagcctcccatgacacccagctgatttttgtatttttagtagaagtggagtttcaccacattggccaggctggtctcgaactcccgacctcaggtgatccacccgcctcggcctcccaaagtgctgggattacaggcgtgagccaccacatgtagccttgcaccttttttagtctcaggttaggcatcactgggaagccttcctgcctccctttcctcgcatgttcccacagatggcccatcttgtcttggggcattctggacacagatgcagtcctgttttttcctgcacccttcccccagtgcttcagccttttcaggacagatgcatactgtcatttgtgctctgaagcctcagtattctgcatggtgcctgatccagagcacctgccaggtatttattgaatcagtctgtttccatttgaaaatgcccatggtaagaaaaatgtagatgccactggaatctgttgtcttcaaggccttttggttaaaagggacagaaacccatcagctaaagcagaaaagggagatttattaaaaggcagaatgggctgggtggggtggctcacgcctgtaatcccactactttgggagtccaaggtggaaggatcacttgaggtcaggagttctagatcagcctggccaacagggggaaacctcgtctctactaaagatgcaaaaattaattgggggtggtggtaggtgcctgtaatctctgctatttgggaagctgaggtgagagaatagctggaacctgggaagtggaggttgcagtaagccaagatcctgccactgcactctagcctggctaacagagtgggaatccatctcaaaaaaaaaaaaaaaaaaggtagagtgatttctcccaggctttgagggcacgtagtaccatcagccctcatgagggatggagttaggacggagcgagccactgaggtccttcctgtccttgtgtcgtggccgttttgtgcttgcggggtcttagtctgtgtgtgtgtctctgtttccgtttgttgacgtttgtcatttgtgtgtactttcccactctcctcccccttgtctgtgtctgcccttctcttgctcttcattcattcattcactcgtttgttgacctggtcatcactgactggcggctgggtgccaggcactgctgtgggcagaatgcctgggttgtgaaaagacagaagtccttgctcttgtggaacctgcagctgggagatagacagcagctgagcagatgaatcaagtgtctttcgcaatccttgctgtgaaggaataagcagggcgagggtgtgggtgtggctgccttggccgggtgggtcagggggccaccccgtgagctgagctgtggataagaaagcggctgtggacagggctgggggagggtgccctgggtagaaggcacagcaagtccagaggcccagagttgggaacgaagtcatgcaagggacagaaagatgctgtcggtagtgagtggatggtcagcagtgggcggaggtgagacgtgagtgagctgaggaggttggctggagcgagatcctgagggtttctcttcgtctccacggcctggtgtaaggggctgcccccgcccccaagtttaaatgctctctagttcacgctctctaggcttcatcatgtcagttctgatcctcattcctggggcgagatcatgtggtgggcccttggtagctcaagattagcctggcagtgtctcatgtccatgtgccatgctgggggcatccaatttattgcaagtgctttggagagcaatttggcattgtttagtgaagctgaagacgcttaaaccccatggctcggtggtcctctctctgcatgtgtgtgtatgttccagaaaaccatcctgacatgcatgtgcagccttgtaactgtggttcgttatattgttggtaatggaaaaatattaggcacaataggagcctggatggctacctcatggctgtttatataatggagtgtatgcagcagtaagatgaatgtatgaggttgaaccatatggtgtggtttcacctaacactagagcaatatatgctgagtggagaaatatgaatgtatagctgagaggaaaaaaaaaaatgattaaattgcagaggcaggccgggtgtagtcgctcatgcctgtaataccagcacgtggggagaccaaggtgggaggattggttgggccaagaagttcaaggccagcctgggccacatggccagacctcatctctaaaaaaatatgtgtgcctgtagtcccagttactcaggaggctgaggcaaagggatcacctgagcccaggaggttgaagctgttgtgaactgtgatcacgctactgcactccagcctgggtgacagagcaagaccctgattccaaaaaaaaaaaaaaaaaaaaattgcagaagtgtaatactatttacataaagtctaaatgcctgttaaaaagtatttatataataataatggaaacaagtgttagtaaaaatacaaaaaaataaaaaagtataacattttattataggtataaaagtgtaattcaccatacaaaatatgagaaagtaggttacgtttagcaccatatttacaaactggcccagagtcagcatttacatatttatttatttgttttttgagacaaagtccctctctatcgccaggctggagtggcaccatcactgctcattacagcctcagtctcgtggctcaagggatcctcacaagtgtgagccaccacgcctggctaatttttgtattttttgtaccaaaaatggggtatcaccatgttgcccaggctggtctcaaactctggagcttaagtgatcctcccagttaagcctcccaaagtgctgggattacaggcatgagctgccgcacccggccagcttttacctatgtttaattacaagtattcttttctttttttacccaagtgatttaattgtgaaaagtaagtcaaagtattctagcaacaaagtactaaaaccactgtgtatatgtcaaggtttataatttatttgcccacaattattatttgtatggaaggtccttagcatgtgtgtgtgaacaacaggcagaagaaagccaggattctgtccagctttggattctgccatttgtggtagttcagcttctattgaattataaatgatgatcgttccaatggcaaattactcttctctgttaaatagtctctaaaccaggaagctacctgctacctgtttctgacaatagtattcacacagggagagttgtgattttactataatgctacttttaaggagacttctgttaacatttaaccgaaatggaatgttgatatttaaatgtttatcctgtacttcgacacttgggaaatcaagtatgtcatatagagagtattccctggcttttagtaaatgtttgccactagcagtttggttatttacaataaataccctctcataatcatggctgttgtacagctgttgcactatctcagcctgaaagactgaacatggacattcattgaagacaagaataatgtagcttagggataaagccaaaaagattgctttggtcattttgttttgttttgtttttttgaatggaaaagcaaagacagtattattgggtctgtttcctgttatctaatcagttttgagacttccaggtagaaataagacatataagtcaaggcttaagaataagaaataagacaatagaggaaacatattccagtcatgtggatctttcctggtctacagggagagaaacaaattgtttaccagcaagcgaatgacttggaacaaaaatccgcccgtgccgtgggttcagagtggaggaggattgacgccacgccactgtggggggtgcatcgcgcagcatgggacggtcaccatgggagaggagggttgagcctctggttgtttacgccacgccactgtggggggtgcatcacacagcatgggacggtcaccatgggaaagcagcttgctttcacagggaagcgtggcgctggggagcattgagatgggtgcagcctctttcctggagctgcaggtgcagcctccacagtagcatctgcctcatgggatntgcctcacgatggtcttgtggtgtggggggtaggaagtagtnggagtggtgcnccttctccctcccttgacaagctgcctctgtttctttgtgtgacagctgaagctccccatgccatctttgtcccagagccatctaatttcctcaggcttttaatcactatccccaacattgaacctctgggatggtgttacttcacgcccgctgcacctgaaggagcttgatttccatttacacttggctcccgtcaaccccggggtgggaacttgatatgcccgttaaacacctacgctcgggatattaaaaaagacctccgtccgggggcaggttttccctcccctttcttgggcctggggggcataaccaaaaacaatggttgtgccccgcttatgaagtggncactttcttcagggctctttatatgagagctctctgtagagcacatctttagggatttattctccctctccgagcggcgtttgttcaaagtgcctcgacaatcacagcaacaatacctttttgtgttggtacccaggaatttttccctttattaagccgcaaagtgttcggctaacctcccataaagtgttttttttcccnccccccccnnttaanagagaanncnnanggnnantttaaccngnnnnnaaattttttctttgttgtggtcanagtaattgtatcagcttacactagtattgnnncncnttcngnnctnggntnnnggtcanggggaaagtcaaaagtatatagcctaagggctaatcccctaaatatatatgtgattcgtttangcgtttagctcgttgctctacgcgtcaattatttcgtaatacgcgctaagncgttgccgataatgtctancncgtctactgcgtatctctctatatgttcgt

SEQ ID NO: 921 - DNA, 7691 bp, Homo sapiens
  misc_feature (1)...(7691): n = A,T,C or G
cattgactcacgcgctgatccttccagccccgtggtgaagacactcatggagacccggctccttgtgcggaggcccctgaggccctggaggaagccgcgcctctgtggctctggattcagatcctgtcccaccggttatccctgtgtggccttggacgcatcacttaacctctcccggggcagttcccacacgtgtgaaatgagctagtggtggcatctgccttccagtgctgttgtgattcttcctcccccgccctctcccccccaccctccagaggagtctccctgtgtcgaccaggcgagagtgcagctgcgtgatctcagcccactgccactgcaggctcagcctcctgggctcagacagtcctcccactgcagcctcccgagtagctgggattacaggtttatgccaccacgcccagataattttatatatatatatatatatatatatatatatattttttttttttttttgtagaaacagcgtttctcactgtgttacccctctcctgtcccctcccctgcagggcatggggacagctcacggggccttctcccttcagaaacgaagccgcgcgtactccccgtaaggagctgcgtggccaggctccggcatcccctcccactgcagggccttcctggggagtcttggctccgggacccctgccctgcttcagcccagctgcccccaccacaggctgggaccaccccacccgaggccttcctgcccttgcggttcctctccccttccttcttacctccttcagtgaagattcgctattatctgaaattatcctcagtttagtattattctcgaaggatattttcactgagtagaagattctagtttagaagttgttttctttcaccactctgaagatttaaaacatatttttccagtgtcttttggctttactttttttttttgtcagctaattagagcttttaagatatttggtttttggtctttggttttagcagttttactgtgaagttttgagatgtggttttcgttttctttttccctcttcttataaggcttcttgagtctttggactgacgttttctggctgtgtttttgaaaaactttggccattacttcttcaagtagcatccttgctccgttttctgtcatctctctttgcggctggaattgtatgtctttagagcgtttcagtgtatcctttctgtctctcctcttttgttctctatttttcatcattttttctctatatattttattttgaaaatgttttccctgacttatcgtttgatttctcttcagcgattgtctttcaggtcagggaatctttcttcatctatggaattatttttggattggttttaactcctagaattccacttggttccttttaatactgtcctattctctgacaaaatttatgatcttacattttatctctttgaatgtaattgttttaacgtctgtgtcttgtaactttattagctggtgcctctgtggatgggttagtgttgtctctttttgttgggttttcattcatgtgttttttttttctttgtttgcctggttatttttgattgagttttgagctttgtattggaattatttgcagtaataatttgagtcctgaatggtattttctttttaaagagatgatttatttttatttctggcagatggctagaagcaccagcaattctggatctaattttagggattgagatgatttagactgaggcttcagcccctgcgagggccagcttcccacctgactgttcctcctagggcattgtctctccaagtcagcacagttttctcagcttctctgcagctcagctgccttttatggagttggcacatgcccccaggtaaaagtggctgcaaaagtggggcccatgtctttgggttttcttcttctgagtcttctttcctgccttgttaggtttcttttgtttttatttctttttttaattattttattttatttattttcgcaccttgttaggtttctaatggctttacacagatttagaaagagtattgtgtctaccctttctaattgttctcagcagcaggattgagctgaatcacctaggccgctggaagaggaggttcctgatccccgtctggtctctgatttgaaataccacctttatcaaatgtgaccttatggcctgcgtctgcagcttgcaggatcagacaggcagtgcctcttttgttttgctgatgagttgctcaagccccgtgggcctgtagtggcagcaagttcactccgtcatgagtgccccccacccctgctgtgtaacggccaagggctttctttccccaggggagtgagtcctgctgtggcccgccagctcaagagggagactctcatccactggcaggcccagctctcagatcttgtggtttctgtggctgcgcggtggctcaagaccgtctcccgagtctagtcgtcctcagctgtgctcaggcgctggctgggccggacccctgcacaaatgcccttgctgtgtgtacgttttagcttcgactcctacactcagccctcattccccaggcacagtggccaggccttgggggtgtttgcatcagcctcacgcaccacaggagccagcacccctgccacaaactatggacctgccaccctctntattcatagcaagtctctctaattcctgtcaaatgccccattttataaggcattttgtgttccctttactattctaaaatgaagttcatagatgatatagcctacctacctccatgattttaaaaaaacatataatatccaaactaatatgaaggagacataaaatggaagtaacttacatattgaagtacaaattgtattgtgcaggctcaggcacaacaccagaaaacaaaattcaggcgcttgcccccctacaaacaagtgctgtgactgtcacagccaaggctgcaagctgatgaggtgctgtgattcagctgccgttagcaggcttccctgtgcttttcctgaggcagtaggtgtcactgaaatagactgaagtacagctttctcgccatgcagagcggtgacacggcagttgcattcctgaaaatccactggatattgaaacgatgcagatgaaaacagggcttatttgtaagctggagtcaggttctgggctcaggaaaacaggtcttttctcctgcctgagtgagcagcgtgcatctggcagttatgcaggccagtgggtgatgtgctgatgtaatgaggttcgagggtggcacatctcacacgcgcacgaacaccccgtcgtcacgctcaggaactacaggaggatggaggccagttctttgttgtgtggtgctggctggtgccattcctggcttatgtcttctggatgccagtggctctcccttttttatgatgactggaaataccccacaaatttcagaataccccttggggtggtagaaagattcccctgagaatctccctttagaaacatgttcacagaggagaatcacgaaatgacccctttgtgtctagtttctctttttttctagtttcatccattatcagaataatttttctttgttttttctttttctttccttttttaaatagagatggcatgttgctagttgcccaggttggccttaaagtcctaggcttaagtgatcctcctgcctcagcctctgaagtagctgggactacaggtgcacgccactgtgccttgcttaaaaataatctttttaggctggatgcagtggctcacgcctgtaatcccagcactttgggaggctgaggtgggcggatctcgaggtcaggagctcaagaccagcctggccaatatggcgaaaccccatctctactaaaaatacaaaaattagctgggtgtggtggcggaggcctgtaatcccagctacttgggaggctgaggcaggagaatcgcttgaacccaggaggcggaagttgcaacgagtcgagattgtgccactgcactccagcctgggtgacaagagcaagactctgtctcaaaaaaaaaaaaaaaaaaaaaaaaaagtctttctaatgcatctttgctgatgcctttctttgctgagaaaccttcagtgctgactggtgccctcagtaaaagccccaaactcagctgggcctgcacactcctgcccaggcagcctgtagttggcctcctcccacgccagtcactacagcccaccgtcccgctgctctgtgccatagacccttcttctgcctggaatggaagccaccagtctctccactcccaggtcagatgtcccctcctgtgggacagctgcagcagacgcttctcctcctcgctgcccatggcattttgtgaaccctgtctcgtccgttgttagtctctgcgtggcattggcgcttcctgggtttgtcttgtctgtttttaccgagttgttaggtccctggcggtcttgttagcctccttagatgacacgggcctgcacacagaaagtactcagtaggtgtcactggtgcgtgacctgtcacctctggagatcactcagtctctgatctggctctgaaaccctggacgagccaggctgcgtctgatgactgtagctgagcatggaaagaagacttagcacacgcttgtgtgcagtgggtactcggggcaccctgcgtatgctcagctgagggggtgtcaggaagagagtgggcatctctgaaagctttcattcttggccaagttgtctacggcagaaacgtttgccttttccccggctgatgcgtgtgagattgagtgagagaggcaagtgcaggactctctaaaacgacaacaggactccagagacggggcgggggccttcctgtttcagcaacttctgcccaaaggagagagaaacccccttcccttctggtcacttcagccactggactggcaaatgtgagtgtgcggcatggagcagacatcctgccaccctccctgggctctggggcagctaggcatgaaagcagaggctgctatgacgccctgggtggccttaggtctcagcactgccctggagtgtcagctcctgctctgctggcctccctccgtgttaggaggccggcccctgcctccatcgccccctgcttgcagccctgagtgtctgagaagccaggccagggcgaccggcccagcagccctgaagtggtggctgtgattattcgggcgttttggggagacagctgacagcacaagagaaaagcacacacacgggagactttgttgagatcatcgttacgtctccgttttcctttcccaggtctaggtgttagcagtggatttaggcagcagtttcattcatgggtatagagcagcaagtctcaaacttgtgtcacctggagggtttgctaactcagattgctgggccactgtccccacctcagtttctgagtaggtccagggtgggccccagggatttgtgtttctactaagctgccacctgatatttatgaaagctgctgtctagggacccaccttgagaaccactggtataagcggtagtttttcttacagaaaaaaagtgaatatttactaaggatactgtttcacttaaatttattggatatcatttatgttggatattatagctcagatgctgtattttattttttaattttaaatttttatagaaataaaagaagagcttgaagatctgaacaaagaaatcaagaaaactgcgaataaaattcgagccaagttaaagggtaagtttgaagttttatgtttaattattgatgttgggagtatgggtatttgttatttttttctttattggtttttgttcttttacatttttaaaaattaaaatagtgactgctttaaaataaattatttgtatgtaattcagagtactaattaatattcaaaaaggttatgtgtttgcttataaactgttatactgttacatttttgatgacatttcaggctaagttgcagatgtttgggaaggtgagttgccaggctcttcttgaatggaccctttaattgctcatttctttcaaactttctgtagaatttattcgatgatgtttggcattccactttagcagcagtagttttttgggaggcttatagctttgtcatgtaaaacaggggacttaaacagaggttgctttttctcgatttggtagaaaacatgttgtatttgatttttgcagaatggcatcaagatcaaaaacaatctctgtgcagatgataaaatacttttattacggcaggtttcagatgtgtgcagaagcagagagaggcgaccacaagccgaccccccagctccacagttctccatgagctcccacccgcacccgctcccagactattctgaagcccatcccaggcatctgagatttcatcagtgtgtatttcaaaaacagaagcttccccaaaagcacaaccacaattatatctaaacccaaattcattataattacttaatagtacagaatatccaggcagaatttccccagtggtcttacgattttttttttttaaacagtttgcttgaattgagtcccaaataaggaccaaaccctggcttttaaaaatgagattctcccttcatgatttttctctctgcactttttcctttggttggtgaaaccaggtcatttgtcctacagaatctgccatgctgcagattttgctgattttacctctgcagcacatttaataggctctgccgtcctctgaatttgctgtaggttggtagttaaattctccaagctttatctgattcaggtgttttttgtgggtttttaaaatgtaaagatgcagcatctgattacagattttatgtcctcatggttacgttaagatgttaatggtggcctggcacggtggctcacgcctataatcccagcactttgggaggccgaggcgggtggatcacaaggtcaggagatcgagacttatcctggctaacacggtgaaaccccgtctctactaaaaatacaaaaaattagctgggcgcagcggttgcttaaggtttttagggttccatgcgggataaggcgtttacgctgcatccggcatggattgcctgatgtgacgctggcgcgtcttatcaggtcaacgtgaacagcccttccacctgaaattaattttaaaaaggggctaacagccccttttttgtcaggagaatttattatggcgaaagaatttggtcgcccgcagcgcgtagcgcaggaaatgcaaaaagagatcgctctcatcctgcagcgtgaaattaaagatcctcgcctgggcatgatgaccaccgtttccggtgtcgaaatgtctcgcgacctggcgtatgccaaagtatatgtgacgttcctcaacgacaaagatgaagacgcggttaaagcgggcatcaaagcgttgcaagaagcttctggttttatccgcagcctgctggggaaagcgatgcgcctgcgtattcgtgccggaactgaccttcttctacgacaactctctggttgaggggatgcgcatgtcaaaactggtggaccaaccggggcaaaccatacgaagaaccgtgtggttaacccggacaacagcaaggaggactaagggagtcgtcttggtctcggggtcgcgaaatttaacgggtttttttgctggataaaaccctagggtattgtccacaaccaagcgcttgcaaaaagtgaaactttttatttacgcccaccctgccggggcattacggtcccctgaacccccttgggaac

SEQ ID NO: 922 - DNA, 9797 bp, Homo sapiens
gaagacactcccgcctgggtgacaaagcaagaccctgtctcaaacaaaacaaaacaaaacaaaaaaactgaaccacactactccagtatggcctcgtcttaaccaattatatctacaatgaccgtctttccaaataaagtcacattttgagattaaaggggttgggacttgaacatgtccttttgggggacacagttgaacctacagctgtggtgagtaagtgtctccaggcttttgatctccagaagcgtgttactacattctcctttccatctcgtgttgtacatgtgcaagagtttctcttggctggacacacacacgcatacacagaattgaatggctggatcaaaaagacatttacaacacatgctcaccaaaggaatgttgcaaaatgttccccagtttgtaacgtctcttttcacttaaagtcttcctgattcacaaaagttgttaattttaatatggttcaacttattgatacttctttcagttcatgtttaaaatatcctttcctatcccatagttgaaaagatattcacttacattttattttattttattttttgtggtggagtttcgctctgttgctcaggctggagtgcaatggcccgatctctgctcaccacaacctccgcctcctgggttcaagcaattctcctgcctcagcctcccgagtagctgggattacaggcatgcactaccacacccggctaattttgtatttttagaagagacgaggtttctccatgttggccaaggctggtctcgaactcccaaactcaggtgatccgcccaccttggcctcccaaagtgctgggattataggctgggccactgagcccagcctttcacttacactttatactaggaatttttaagttttgtttttgacagatgaaccttgatccatcaggagttgctttttgcatatagtgtaagatagggattttctttttcttttcttttctttttctttctttcttttttttttttttttttttgagacagaatttcactctgtcacccaggctggagtgcagtggcacgatcaaggctcactgcagccttgcccctgcagtctcaagcaatcttcctgcctcagtctcccaagtagctgggactacaggtgtgcaccaccatgcctggctaatttttttttttttttttttttttttttttggtagagatggggtttcaccatgttgtcaggctgggctcaagtgatctgctcaccccggcctcccaaagtactgggattacaggtgtgagccaccatgcccagctgtagataggggtttgattttgtctttttttttgtggatgaccagtttttccagttccagctaatgaatggttccttctgtgctgatctgacatgccgtccatcccatgctcacatccataatatgactgtgttgctggcctccctgttctcttccattggtcagcatgccttttcctgggccagtatcacactgtcttaaataattactataggctgggctcagtggctcacgcctgtaatcccggcactttgggaggccaaggtaggtgaatcacttgaggtcaggagtttgagaccagcctggccaatgtggtgaaaccctgtctctactaaaaatacaaaaacaagccgggcatggtggcacatgcctgtaatcccagctacttgggaggctgaggcagaagaatcacttgaacccgggagacggaggttgcagtgagccaatactgtgccattgcactccaggctaggcaacaagaaagaaactctgtctcaaaaaaaaaaaaaaatttactgtagtttggtaagtgcttatatttgataaaccaagtcctatctctctgttcttaagaagagttttggctatgttcgatgcttccatgaaaattccacaaaaaacactgggaattttgattgaaatcacactgaatatacagctatttttgggaagtgtacatatttcctaggatgaattttgaggagctgaattgcaggtcaaagactgtatgaacacagagacttttgacaaacatcatccagttgcttttcactggctgtactaagctacatataggcaagaacttggccggctcacctttatgtcttgagctcctagctcagtgcctgaaacacttatcaaaccagcaatgtctcttatgccagctgcaccccaacttctccagtataattttgttttatttcttatttttatttttatttttttgagatggagtcccgctctgtcgcccaggctggagtgcagtggtgcgatctcagctcactacaacctccacctcccaggttcaagcgattctcctgcctcagcctcctgagtagctgggattacaggtgggcaccaccacgcccagctaatttttgtatttttagtagagacgggtttcactctgttggtcaggctggtctcgaactcctgacctcaggtgattctctcaccttgacctcccaaaatgcttccaagctttggcatttatgaagaaagcagctataaacatccaggtggaggttttgtcaggacctaagctttcagctcatttgggtaaataccaaggaacaggatggaggaatcatatggtaagatactgtttagttttgtaagaaactgccaaactgtcttccaaagtggctgtaccgtttgcattcccaccagcgatgaaggaacgttcctgttgctccacaacctcgccagcctttggtgttgtccgtgtcctgaattttcaccattccaatagaaggtgctgttttctgctggttatgtttagagatattcatgataaaaagtagttacacttttcaaaattctactagaggccgtgtagaaaaagcttggaagcacccatgatgtcctccagcaggtgaaaggataagctgtggtgcatccagaaatggaatattattcagcactgaaaagaactcgaccatcaagccatggaaagacatgggagaaaaatgcactttactaagtgaaataacctgaaaaggccgcaataccaactatatgacattccagaaaagccaaaccacggagacactataaagatcagtagtgagggtgtgggtaggatgagtgggtttcatgcggagggtttttagggcagtgtataacgttatcacagggatacatgtcctttcacatttgtcaaaacccacgaaatgtgcaccagcagactgaaccccagtgtgaactgtgggcgataatggtgtgtcactgtaggttcatccgttgtaacaaatggaccactctagggggatgctgatatgggggaggctgtgcatatgtggggagtagggggtgtgctagaatcctctatactttgcacccaattttgctgtgaacctaaaactgctctaaaaaagtctatttaaagtaaagcaacaacagaataagattttagtataaataagtctgttataaaatagagaacacccatcaatggataaaagtcaagatttttatgttgatcaatttataagtgaagtgacttacaaaactttttttttgaggtcaggttaaagccatctcagcaacaagtaatggagttgccagtctccgaaataagccacgtgggtagagagcaaaccgttaataacttcagcatttctgtgcacagaaccagggaagtaatgtctttaaatacagctgcatcttgaaatatctgccactaattcaggcacattgaaattgctgcattaaactactgaactataatagaagcctctgcaacctttattctgagtttactggtcctatttatagcagaggatcagaaaaaaaatgtattgctatctggtgtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgactatgagtgatgtgtgtctggtgtaatagtcgaccatgatggtgataggtgatggtgacagtgatgtggtctggtgtaacaggtgaccgtgatggtaatagatgaccgtgacaatgacatatgtctgatgtaatagttgaccgtgagggttacaggagaaagttgtaccgtctgtttccacgggaacatctgtagagcatgtttggctaatgtttctcttagtgcacattggaaccatgccattctgttttccctgcccccacctgacagcacagtgcccagcacatgtacatgtacggtattaacattgtcagaacacatagctgtgacatggtatcactctctcccctacaggcattcgtcctaattctgcaaggagatgtatattccatgctaaccagcagtccctggtgtctctccagtcatttagatggtctgaagcaacatgggcttagccatttgggattaattttcctggatattgtgcccttccaatacctaatttcaaggtttttttgatttcaggaaacagttctcaaaatatacttttttttttgagacagagtctcactctgtccccaggctggagtgcaatggggtgatctcagctcactgcaaactccgcctcccagattcaagcgattctcctgcctcggcctcccgagtagctgggattacaggcacgcaccaccacacctggctaatttgtgtgtgtgtgtttcagtagagacggggtttcactatgttggccagtctggtttcgaactcctgacctcaagggatccacctgccttggcccctcaaagtgctgggattacgggtgtgagccaccacgccaggcccaaatatacgttttaatattattttgtattactgccttggttttcctcttcagcaactcctattaaatttatattagatctttttttctgatcttctatacttattcctcattttgaattggtttcatcttgtcatttattctttaattccaactttatggaggtataattgaagtacactaaaacacagatattgatggtgtaacctttgtttttgaggtgcatgtggagtttcacatccattacactcaaggtagcagctatttctatgacccccaaaagtttctagtgcccatctatatccatccctacctccaccccatccccaggatgtggtttctgtcattatatgctagttttcatgttccagaaattcagacaaatagaattatacagtatattctatttttcttttcttttctttcttttttatttttatttattttttttgagacgaagtctcactgtcacccaggctgaaatgcagtggcatgatcttggctcactgcaacctctgcctcccaggttcaagccattctcctgcctcagcctccagagtagctgggattacaggtgcccaccaccacaaccggctaaattttttatttttagtacagacagggttttgccatgttgcccagactggtcttgaactcccgacctcaggcgatccgcccgcctcggcctcccaaagtgctgggattacaggcgtgagccgccgcgcccagccgtgattctgtttggcttcttttacgctgtgtacttctgaggttcaactgtgctatcacttgtgtcagtagcttccttttttaattgctgaataacatcccaccgtatggatacatcacccttcctttgtccatgaagtgcccgcccacttcatttcatgggtatttcagttgtttccagcttttggctattggaaatacagctgtgaaggatatctgtataccagtgcttatgtgggcatgtactttttttcccctggagcaagtctgaaatggttgggtcatatggtggtgtatgtttactgtttcaagaaagaaagtcctattttttctaggatttatcccatcttataccgccaccagcagtgcgtgagacaatgcctgttgtttacaagtgtgtggcagtgtctccttgtggttttcatttgtgtttccctgatgatggaggggaacatttcttcttcttccttcttctttttcttcttttttttcttttttctttttttcttttttttttttttgtttgagacgagtcttgctctgtcacctgggctagagttcagtggtaggatctcggctcactgcaacctccgcctcccgggttcaagtgattctgctgcctcaacctcccgagtagctggattactggcgcacaccacaacgcctggctaatttttgtatttttagtagagctggggtttcgccatgttggccaggctggtctcaaactcctgacctcaggtgatctgcctgccttggcctcccaaagtgctgggattacaggtgtgagccaccacgcctggcatggggcacattttttcatgtgcttattggttattttaaatattattctatgaaatgtctgttgcctatttttttaaaagtgggttatttgttttctggttattggcttttaagagtaagttctggatgtaagtcctttgtctggcatgtgtggtgcaaatgttttcttcaatggatggcttgcctttctgtttttaaaaatgggttatttcaaagagcaagatattttattctatttcatttttattgtttattttttgagaccgagtcttgctctgttgcctaggctgggtgcagtggcacgatctcggctcactgcaatctctgccatccaggttcaagcaattcttgtgcctcagcctcccgagtagctgggaccacaggcaagcaccaccatgtccagctaatttttgtatgtttagtagagacagggtttcaccatgttggccaggctggtctcgaacccccgacctcaagtgatcctcctgccttggcctcccaaagggctgggatgacaggcgtgagccactgtgcccagccagagcaagatattttacttttgatgaagtctagttaatttttttctcttgtggtctatgccatatcactaagattttcttcctgttctagagactcatcgtttggaattttacatatacctctgtgacatattttggattaaacttgcatatggcgtgaggtgttaagagttatttttcttccccgcgtgagtatccagttgatacagcaccattcattgaaaagaatttcctttctgtgttaaattacctggacatcttgttgaatcaattgacaaaagatgtgtgggtctgttcctaaacttgcagattctgtgtcattgatctctgtgactatttttctgacaaggtattttgatttatgtagttttgttattgttgtttgtttgtttgtttgtttgagatagggcctcactttgtctcccaggctggagtgcagtggcgcaatcttggctcactgcagccttgatcttccaggctcacatgatcgtcccacatcagcctcccaagtagctgggactacaggcgtgtaccaccccacctggctaatttttgtattttttggcctcccaaagtgctaggattacaggtgtgagccaccacacttggccttgatttatgtaattttaagccttgaagttaggtaggttaagtatttcagttttttttttttaatgattgattttagttgggcacggtggataatacctgtaaccccagcaactcaggaggctgaggtgggaggatcacttgaggccaggagtttgagaccagcttgggtaacatagggagaccccacctctactaaaaataaaaatatggtcgggggtggtggctcacgcctgtaatcccatcactttgggaggccaatgtgggcggatcacttgagctcacaagttccagaccagcctgggtgacatggcaaaagcctgtctctacaaaaaaatacaaaaattaaccaggcatggtagtgggtgcctgtagtcccagctacttgggaggctgaggtgggaggatggcatgagcctgggagggcggaggttgcagtgagtcgagatcgcgccatcgcactccagcctgggcaatagagccagaccttgtcttgaaaaataaataaataaataaaaataaatgagggatttgagtcccgcccctagaccttatggaaccttaattcctgccttactccaaatacaaccacactgggagttcaggctccagcataggaatcttggtgacagagacattcagtgcgtagcagctgctcggaggtacagacgccccggcacctgcagcgctccctggactcctcacagcagcctcccactttgctcttagcctccgcggagaagcttgttgacttgttgggattctgctttcaggaactgcagatgccctgttgcctttttatgcctttcttaccaagatgctggtgctgaaaatgccacctgcaaaatttcattccaaaacgttgaatccagcttttaaactacagtttcataggaatacaggatgcaaaagattaggttaaattacactacacaaaatcagcaaaatccagaatgtgtggaactcaacagaacagtgattttcctagaaaaactacaacaaagaccaagggatggaattgtaaaattgtagtttaaaagagacttaagagcctcgtgaattgaaggccatctctggatctagtttggatcttgattttaacagtgaaaaaaaatatttgctagataaataaatttgaggactctatatttgatgattctaaggaattgttaattttttgtgtgataataagtttttaaaaggtctactttggtgtatgtaagaaaacgtctgtaataaaaaaactcattgaccagcctgggcagcatggtgagacccagtctctacaaaaaatacaaaagttagcttggtgtggttgtgtgtgcctatagtcccagctacttgggaggctgaggtgggaggatcacctgagcccaggaggcagaggttgcagtgagctatagttgcaccactgcactccagcctgagtgacagagtgagaccctgtctcaaaacaaacaaacagcaacaaaaactcattgaaaaagtttcacagcattgaaacttttatctattttatccacctttttatctatcaatgactgcaatcattgatgattaatagatccactatttcatctattaatcaatgattgtgatgcgttactttgcttatcctattacacctgcatttgtcaggtgtgactgtcttgtgcagaatggtttttcttcggccgggcgcggtggctcacgcctgtaatcccagcactttgggaggcaaaggcaggcggatcacgaggtcaggagatcgagaccatcctggctaacacagtgaaaccccgtctctactaaaaatacaaaaaattagctgggcgtggtggtgggcgcctgtagtcccagctactcgggaggctgaggcaggagaatggcgtgaacccaggaggcggagcttgcagtgagccgagattgcgccactgcactccagcctggggtcttcacgcggggcataaggtcgcgcacctggtaacggcg

SEQ ID NO: 923 - DNA, 16595 bp, Homo sapiens
gaagacaagtgtgaccccaattaactgctccaatttcaacatgggagaatatgattccaacatggagaaatatgacttcaacatgggggaatatgatttcaacatggagaaatatgacttcaacatggaggaatatgatttcaacatagggaaatatgacttcaacatgggggaatatgatttcaacatggggaaatatgatttcaacatggggaaatatgatttcaacatggggaaatatgatttaaacatagggaaatatgatttcaacatgagggaatgtgatttcaatgtgaggaaatatgatttaaacatggggaagtatgatttcatcatggaatatgatttcagcatgagggaatatgatttaaacatggggaaatatgatttcaacatgagggaatatgatttaaacatggggaaatatgacttcaacctgggggaatatgatttcaacatggggaaatatgatttcaacatggagaaatatgatttaaacatagggaaatatgatttcaacatgagggaatgtgatttcaacgtgaggaaatatgatttaaacatggggaagtatgatttcatcatggaatatgatttcagcataagggaatatgatttaaatatggggaaatatgatttcaacatggggaagtagatttcaacatgagggaatatgatttcaacatggagaaatataacttcaacatgaggaaatatttaaacatggggaaatatgatttaaacatgggggaatatgatttcaacatgggggaatatgatttcaacatgagggaatatgatttcaaatagagaaatatgattttgacatggaggaacatgagttttaggtgctaagtatgagcaacagagacgttagaccggcagaccctttggaaatgggctggccctcgatgctctgaggtcatggggaaatcttagcctcaaccaaaacaaacaaaagaaaataaaagaaaaccactcttctcgtgccctggttcaaacagttccctttacaattctaagctgatggcagcattgagtagccgcacctgacagctactttctccccttcttcaaggcctgtttgccaccagctcccttctctgagtgcagaaagcctgtgaggctcacagaggcgagggccgccagcccgatgcctgcaaggtggggtgaaaccataggcactccataaacttggccacctggcccccaaaccacctgccacccctggagtcgacggctcctcctgcaccacctcatagctaatgaaggatgcaatcacgttggccgtctggcaaatctacatgtctgccagggccccgccacagggcgcggtgggaattaatactgggaggttgtgccacgttcctgacgagtgcaacgcgggtcagggaggggtgacctttccctctccagatgccgttctcgcctagacaccagccaccctgaaggaactgaaacaggacccctgaagtgagcaggcgcgtgtgggccgctgttagcgcacagcttctatcgagacatctagaatatgtctagatgtctagaatatgtctagatgcagaactatcaattctagaattccacgacgaaatctttctcaaggttcagactccgagcctcagcgttctgctctgctgcccccctcgtggagatgggtgtctactgagctcgcggagcaggtgggtgtcacctgcgctaacaggtacttagtaagggggtccgttcgtcaaatggaaacacgccacccttatcgtgaaaaggggagccgtcagtccccactttcccctgatatccactatctttaccatcatctaatgacggaggatgacccggtgtcctagcgggattaccaggatcccaccaacgctagcctcacctccagatactccacgctcacccagcgtgtgcccaccatgttccaaccacacagaccagccgggtcctccaaaagcccgcatccctcctgcctcagaggctttgcacacacgccccctttccctggaatatgatccaccccaccccacctgtggctctcttggccaatgaaccccggttcttccttgaacctcagcacttccccgacttctgaagctcacagcccccgttagacacgttcacagctgcccgctgcgcttcctcgctgacagcatttaaaagttaggaattaccagtctctgtgcttgtctcccaaactaaaataataagcctcaacaggagaggtaccaagctgagtctgactcaccctttgtctccagccgctagtgcaagtcaggcctcccgcacagggctgcccaattttcttgagtgaagagatgagatgaatcctgcaggtggtaaacagggtggaggtaggctactgccttctgtggaagtgccttcctcgagctacgtactgcacagcaccctaataccgacgcgtggttcaagaaccactagcctcagtgtcggccgggagccggttagaaaaacacagagtgccagggcaccccaaatttctcatgaaagtttgagaggtgctgcacagtgaaactgaggaaagcatgcatggacgaacaaaaacctgtggcttttgtctcagagtccctttgctaaaatcttgccgattgcctctttccaagcatcaagacctgatatcctctgaaatctcagaaatctctaaagcgatgatatttgacagacttatgtggccttacgaaccacctggatacctcaaaggacttttccagcttaaattgatttatctgatgcccccacaattgacagagctactgcagctggcgtcacgacgttaagagctgccacaaagtctccctgttttcttgagtgtttacgttataccttcaatgattgaccttccagagacacgatttcactgaggcttagaacattgaattatttcaagacacagctccacacacacgtattagttcccctaaaaacctggatattaggtgcatctgaactaccctaggtattcagtggcacagcgtctgcctcggcttaaaatatgacttcccaataacgttgttatttctacgattcctttgctggctgtgcatgcagatatctgcggtttcatgtgcctctttgcaaaggcaatcagcccaagcagccgagcgtaaacgcatttctagtcgtctgtgctgctcagggcgtctcagaagacacaccagtctttcctcccctaagttgtaatgctctgaagcacttaaggatttcattagcaatgaactaatcgctgttctgcaagacctgaaaagaaaattaaaatgtgacccagaaaaggacaccgtcctttggtactgcttaggcagccgaatctctcttgttccaaacgacacctgcttgatgtggcttttcttccgtaataagttacaaatccgtactgcgatcattaatcatgagagcctcatccacgtcccctttttgagaaggtgagctggaggggtgattaccgcggaccatttgaacaaaggcgcgtaagagtgtggccacagcgtggagcgtgagcgtccccatgtgtcgcgaaggggaatttattccatgaatgtcgcaatcgccaattgcacagcgattctgagaggcggcagcccggccgggtcctgcgtgccggggatgcggaggtgcattagacagtcaggcgccctaccccatagcacatatttcagctggacagcaaatatctgtgtgccccacaaacaagtcccagaggacagggacctcttgcttggtttaccaagaatcactgagcgtctagaaagggtttggcacaggtgaccaataaatatgtatcgaatgaacaaatacaaataaaaagacaattacgcattttgggcaaggcatgttggctcacacctgtaatcccggcgccgtgggaggccaaggtcgtcttgagaccaggagtttgaaaccagcctaggcaacatagtaagaccccatctctacaaaaaattaaaaaataaaaattaaccaagcatggtggcacgtgcccgtagtcccggttactcaggaggctgaagcaggaggatggtttgagctcaggaggtcgagactgtagtgagctatgatcacaccactgcactccagcctgggtgacagagcaagaccccatttcaaaaattaaaaaagaaggaaattatgcattttaaaaatgtggttgcatgggccgggcgcggtggctcacgcctgtaatcccagcactttgggaggcccaggcgggcggatcacgaggtgaggaaatcgtgaccatcctggctaacacggtgaaaccccgtctctactaaaaacatgcaaaaaaagtagctgggcgcggtggcggcggcctgtaatcccagctactcgggaggctgaggcaggagaatggcgtgaacccaggaggcggagcttgcagtgagccgagatcgagcctctgcactccagcctgggccactgagggagactctgcctcaaaaaaaaaaaaaaaaaaaaaaaaaaaaacaaagtggttgcatgtttttcttcttgagtttgaagagttctggtatattctggatacaagtcctgtatcagatatgtgactttcaagtatttttgcccattctgggatatacatacattttcattctcttagcatcatttgaagagaagaaattcttgattttgataaagtacaatttataatctttttttatttatagatcatacttgtgtcatatctaggaattatttacctcacccaagataacaaagattttctcctatgttgtcttcctgaattttagcagttttaggtgttacagctaattctattaccttttttgagttaattttatagatgatacaaaatattaattgaggcttgctttttctgcctatggatgtccaatttctacagcataatttgttggaaagattatcttttctccgttgaatttcttttgcagctttgccaaaaatcaattaaccatatgcctatgagttcatttctggactctctactctgttccattgatctttttgcctgtctttatgccaataccacactgtcttaattatgataactttgtagtaattctaaagtcgggtaatgtaagtctaccaactgtactgatctttttctaagttgttttggttcttctaggtcctttgtactaccatttaaattttataatcgccatgtcaatttcttcaaaatctgctgagatttttattggaatggcattgaattgatagatcaatttggggagaattgacatcataataatactgaaactttcagaccaagagcacagtctatggcccattcatttagaccttctttctcttagtagtgggttgtagtgcagtgtcctttacatcttttgtgtctacatcatttttatgcctttgtaagttatatttctatttcaatttctgcttgttcattatgattacagaaattcaatacatgttgtatatagattttatatccttttttttttttttttttgagacagagtcttgctctgtcacccaggctggaatgcagtggtgcgatctcagctcactgcaacttctgcctcctgggttccaatgattctcctgcctcagcctccccagtatctaggattacaggtgcatgccaccatacccagctacttttttgtattttagcagagatagggtttcactgtgttacccaggctggccttgaactcctgagctcaggcaatctgcccacctcggcctcccaaagtgctgggattacaggtgtgatccaccgtgcctggcccacttttcaattatagcagcttttttgtagatcatatagaattttctacatatacaatataccatctgcaaataaataatgcctttacactttccttcccaatccagttcccttttatttctttttcttgccttattgcaagagcaattgcacattgcactgcacctccagacaacatcgagtagacacaatgagaacaggcactcacccgtgccttgccctgatcataggagaaagtctttttagctgcttaagtataaatatatattaactgtaaattttccatagatttctttcattatgatggggaagctaccttctaattatagtttgcagacagttttaatcagaaatggatgttgaagtctgtcaaatgctcactaggcttctattgagatgatcgtgtaatgtagctcctgatatgtttaattataatgattaatttttaaatgtcaagttaatcttacatttctggggtaatgcctactggctcatgaggtattatcctttatatatatgttaattgggattggctaatattttaagaattttactcaaatattgatgttcagtgctataactttccctctaagaatgtaatgctataaatttccccctaaagccactttaactcatctcataagttttgacatgctgtgttttcattctcatttacttcaaaatgctaatttttcttttggttccttttttgacttatgggtagacatgtgttattgagtttccaaatacttagagattttgctgagttttttttattgatttccaatttttccaactttttattccacatgaccaaaaaatatattttgtaaaaaaaaaaaaaaaaaaaaaaaaaaaataaaaaaaaaagggccaggtgcggtggctcacaactgtaatcccagcactttgggaggccaaggagggcggatcacaaggtcaggagtttgagacccagcctggccgatatggtgaaaccctgtctctactaaaaatacaaaaattagccgggcgtggttgcgggcgcctgtactcccagctacttgggatgctgaggcagaattgcttgaacccaggaggtgggggttgcagtgagccaagagcacaccactgctctccagcctgggcaacggagagagactctgtctcaaaaaaaaaaaaatatatatatatatatatatgtatatatatatgtatatatatatgtatatatatgtatatatatatgtatatatgtatatgtatatatatatgtatatatgtatgtgtatatatatatgtatatatgtatgtgtatatatatatgtatatatgtatgtgtatatatatgtgtatatgtatgtgtatatatatgtgtatatgtatgtgtatatatatatgtgtatatatatatgtatatatatatgtgtatgtatttatgtattttgtgtgacttgaagtcttttaaatttactgggacttttcttatggccagaatatggttttccttggtaagcgttctgtgcgcacttgaaaagaacgtgtattctaccattgttgagtagatcgttttaaaagtgtcaacttggatgatgatgttcatgttgttcatgatgatgttcatctttactgagtatttgtccacttggtctatcagttgttgagtgagggtgttaaaatctctgacaatatttgtagtttttctacttcttgcacatctatcagtttttgctgtgcatattttgatgctcttttattaggtgcatgaatgtttatgataattaagatttcttgatgaatttatcccctttataattttgtaatgatcctcttaattcctggtttttctgctacaaagtctactatctctaatgttaatatagtcaataagcttccttgctattagtattagcatactgtaactttttctattcttttacttttaacttacttgagcctttaaatttgaagtgagtttcctgtaggcagcatactagattgtccaatttggcatctctttctttcaatttgaggtatttataccatttacatttaatgtgattactggtatggttagatctaaatctattatcttgccatttattttctatttatcctatctattctttgttccttcttctttttctgccttctattagattaaatgttttaaatgattctattgtatttccatgctttgcttattggctataattctttactgtattattttagtagctgcattagaatgtaccacattcatcttacacctactgcactccaccttgaggtaacattacatcacttcatgtatggtataaaagccttataaaaatacacttccatttctcccttattggcctttgtactattaccattatacatttcacctctacatatgtcataaacctcatatgacattgctttaaacaatcgattatgatatgaagaaattttaaaagtaggtaaaatgtttatatacccacagagtgaccataaccagttttttttcccttgtatagatacaggtttccatctgtatccttttgcatttcttgtagtacaggtctcctggcaattaattctttcagcatgtgttggtctaaaaccttctttcgcctttgtttatgaaagatattttttctggctgtagaattctaaattggcatttggggggtttatttcatgatcagtgccttaaagatgctgctccactgtcttttccattaacattgtttctgatgcaaaatctgctgtcttccttatattttttcctctcaacaaaatgtatctttctttctccctttcctgccattccttggctgctttgcagattttctcttgattactagttttaagcattttaattataatacacattgctgtggttttattcaggtcttttatgtttggggtttattgagcttcttggacctgtgagttcatagctctcataaaatatagaactttttcagcaattatcttctcaaatgttttgtctgtctaccccgctccttttatatctacagatggtccctgacttacaatggtggacttaacatttttcaactttatgatgggcttgttgggacataaccacatcatatattgaggttatctggatttaacagtggttcaacttatgactttttgactttaagatgggtttattgtgatattgaatgaattttcaacttacaatattttttacttatgatgggtttatcaggacgtggccctattgtaatttgagaagcatctggacacttgcagtaattccacagattaccaatgctatgattatttttattttgtcctttttatttatttcattttgaatattttgtattgctatgtcatcaagttcactaatatttttttctgccattaatcctatcaaatgtgtgtgtgtgtttcttttagagacaaggtctccctccatcacccaggtggagaacagtggcacaaacccagctcactgcagccttgacctcctggactcaagtgattctcctgatttagccttttaagtagctgggaccacaggcatgtgccagcatacccagataattttttttatcttttgaagagacagggttttactatgtttcccaggctggtattgaactcctgggctcaagggatcctgcaaccttggcctcccaaagttctgggattacatgcatgagccactacacctggcctgtatttttttaattgaattatagttttcatcttgagacattgtatgggtctttataatattctctatatcactgcttaccacgatcagtctttcccctagcctcttgaacatgtagaacatatttacaataactgaatgtcctttactaccagttctatcatctcttgtcatttctggactctttttttttttttttggttgattgatgtttctccttaacatgcatcacatggccaggcatggtgtctcacgcctgtaatcccagcactttgggaggtcaaggaggcggatcacaaggtcaggagatcgagaccatcctggccaacatggtgaaaccccatctctactaaaaatacaaaaaattaaccaggcgtggtggcacacatctgtagtcccacctatttgggaggctgatgcaggagaattccttaaacccacgaggtggaggatgcactgagctgagattgcgccagtgcactccggcttgggcgacagagcaagactctgtctcaaacaaacaaacaaattatcaaaacaaaaacacaaaacaacaacaacaaaaagcatcacatttcccatcttctttgcattccttgtattgttttcattggttgtcaagcagtgtaaattttacgttgttggtggctggatatttgtgtatccctataaatattcttgagctttgtactgggatgttattttgccctgcgatacaatttacttggaaacaatttaatccctttaggtcttgattttaaggtttgaggcaaggggagggcagcttttaggtctaaagtccaattttacagcatttctaaggtttcaaaaaaagccttctgaggactttacctaatgcccataaataggaagtttttcatgctggcaagaacagaaactcttcccagccctgtgtgtgctctaagatttgtcctccttaatccatttgggtggttctttccctggcctcagataatttcctcacatgcacttatcagtactccggtaaaaaacacaaggagggccctctgcaggtctatgaagttctctctgtgcaactccctccctgtaccctccctgaaaactcaattacctctcttgacccccaagtctcaatttgggacggccgggctccacctgggccacccacgctgggccatggcctgaaaaccctctccaggcagtaagctggagtatttgaagggctcatccatgagttttccatccctcagggatcactactttcattgcttaaagtccagtctttgaaaaccattgttttacctattctgtccatttttcacttgtatcaggtgagaaagtaaatccaatcccttttgctcccttgtggctagaagcaagtctagacttttcactctatgtaaataaatactcttttttgtctttatgtgtgtatttctttatttctattgacttggtagagatggggtcccactatatttcccacaccggtctcaaactcctgggctcaagtgatcttttacttcagcctcccaaagtgcttggattacaggcatgagccaccacatctgtctaaaatacttttttgtatttaagccacattaatttagattttctgtcatgtgtaatttaaaaaaaaaacctgaaaaatacagccatccaatctgaactatttcatttcactttattaaagtgtcataaattatgtcaattaaacatgaatataggggtgccaagaatctttcttaaatgccaatatttccataggaaataggagctaagtgctatcaatagtttcacctactcagatgaatttgtttctggttgctttcctcatcatagctagctgagattgaccaaactaaaaatgataagtttagctgaggggaaaaaaagaaaaattcaaaaattgggggaggaggtagagtaagctttggtagaatcatatacttgggtgggaagtgggaagagctgtgttccaagtgagactattagtgagagacattttggcaaagatccaggaagatgccagatcatcaggatcaaacatgggaaaccgccatgctacagcctgaatattggcattccccccaaaattcatctgttgaaatcctgacccccaagatgatggtatcaggaggtggagtgtttaggaagtgagtaggtcataagggtggaactgtcacgaatggaattagtgccctcatgaaagggaccccacagagctgcctcactctgccaccacctgaggacacagcaagaaggcatcatctatgaagcaggaagtggcccctccccagacactgaatctgccagtgccttgttcttgaacttcccagcctctagaactacgagaaataaatttctgttgcttataagccacccagtttaatggtacttataccattaaatttatagtagctcagatagactaagacatgctattttgtagatcaaaatattaaaatattggtaatttcatatagtttcatgaaatgctgttttcaccattttgcaatgagctggctaacccactcaaagcaccttgcttccagggtgtacaacactggctggtatgcaccagccatcctgtgagtggatttgtttattcaaccatgatcctgacattagggataaggcagtcaacaagcccaaaggattctggtggagcccatggcaatactaaagggagggtggccagtaaaaggcatctgaacagagagccgaacattcagcaggaaccagccactcaaaaacctggagcaaaacccttctaggcagatggattaaaaaatgttaagataccaagaagggtatgagccgggcatatttaagaaatagaatgggccgggtgcggtggctcacacctgtaatcccagtgctttgggaggccgaggcgggtggatcacgaggtcaggagatggagaccatcctggctaacacagtgaaaccccgtctctactaaaaatacaaaaaattagccgggcatggtggagggtgcctgtagtcacagctactcaggaagctgaggcaggagaatcgcttgaacccgggaggcgaaggttgcagtgagccaagatcgtgccactgcactccagcctgggtgacagaacgagactccgtctcaaaaaaaaaaaaaaaaaaggtagacagaatgaggatgtggctggagcaatgtggagtctgacaggaagaatctgaaatgttgagatgggtttctgttttattctaagtgctctcagatgccattaggagtgaagaagtgacatgatttggcctacctctttaaaaactaactctaccccctgcttcaataatatattcatggactcatctaggaacttaatcccccacttttcactttcctatttaaacacacccttacattttaggttgtcttaggccaggcctggtggctcatgcttgtaatcctggcaccttagaaggcccaggcagaaggattacttgaagtcaggtcttttttaaaatatatatatatttaatatatttttaagactagtcaagtgcagtagtgagaaggagggaagggaagaacgaggactttgatctgtaactgaccttgaacaatcaattgagataacgcactacttttggaccaaccaaggccagcaattcaagaccagcttgggcaacatagtgagaccctgtctctaccaaaaattaatttttaaaaaattagctaggtccagtggcctgcacctgtagtcccagctactcaggaggctgaggcaggaggattgtttgagcccaggaagttgaggctacagtgagccaagatcatgccactgcactccagcctggatgacagagtgagaccctgtctcaaaaaaaaaaggaaaaaaaaaactgtcttagtgtgagacattttcaaagcacaactctgctcccaaggagtttatctttcttctctttcttcactaaagaaagaaatttctggcataaattgttatttaacaacccatcattaaaaggcccacattgagaatggggttttcaaagatgagagatatggtgtgtccaacgtttttggggagaagctgagagcttcagagaggaacatgcagctacgttaccacattgaaccctcacgctccttgctgactttttccgagagaaggaaacagcattatttttcctccccaacaaacttcagaaccttggagatttgcccatctgcttagagaacatcaaagaccagacactgatgacttttcttctgtgggaacactgagtacagacctttctttcccatcatctgctgttctcatcatttcaagcccacttgatacaaatagtttatgcctcaggtacaaggttgaagtcagtagataaattccttaaataattccggactatagacaatacagaatacagacagatcctcatttacttttttttttttttgagacagtctcgctctgttgcccaggctggagtgcagtgacgccatctcagctcactgcaacctctgtctcccgggttcaagtgactctcctgcctcagcctcctgagtaactgggattacaggcctgcaccaccacatctggctaatttttgtatttttagtagagacggggtatcaccatgttggccagacagctctcaaactcctgacctcaggtaatctgcccacctcggcctcccactgtgctgggccctcatttccttttaaaatgacagggccaccaggcctggtgactcacacctgtaatctcagcactttgggaggccaaagcaggtggatcgcttgagtccaggagtttgagactaacctgggcaacacagtgagaccccatctgtatttttgaaaacagaaaaattagccaggcatggtggcacacgcctgtggccccagctactcaggaggctgaggtggaggatcccttgagcccctgagttcaagtctgcaatgagctatgatcacgacactgcactccagcctgggcgacagagcaagaccctgtctcacacacacaaaaaaaagggcaaatttttctaacatgtactagtgttctacacaccagtcttctaacttccttaatcctcacagaagtcatgtggaggaaatgttaccatattctcattttacaggcaaaacaatcaaaggaagagagcaagtgtcctgtgcacacagctggtaagaggcagggggtggggccgaacccaagcggccggctcccagagcccacgtggatcagcccgtgcccaggcggccggctcccagagcccacgtggatcagcccgtgcccaggcgggcggctcccagatcccgtgtggttcagcccgtgcccaggcggccggctcccagagcccatgtggatcagcccgtgcccaggcggccggctcccagatcccgggtggttcagcccgtgcccaggcggccggctcccagagcccatgtggatcagcccgtgcccaggcggccggctcccagatcccgggtggttcagcccgtgcccaggcggccggctcccagagcccgggtggttcagcccgtgcccaggcggccggctcccagatcccgggtggttcagcccgtgcccaggcggccggctcccagatcccgggtggttcagcccgtgcccaggcggccggctcccagagcccgggtggttcagcccgtgcccaggcggccggctcccagagcccatgtggatcagcccgtgcccaggcggccggctcccagatcccgtgtggttcagcccgtgcccaggtggccggctcccaaagcctctgtggctcagcctgtgtgatgccaccgcgcctgggctttacaccagaacctgacaatggtcattgaaaactagaaaagtgtggatcaatcacccatagaaatacaggcacaaaaatgaacaaagagaacagaaataaatcagataaacactgtgaccaagcatgaaactgaagcagggctttttctcagaaattcaagaatgactgatgttcaggaatctgtcaacatttaaaagttacatcaaataactaaggaagggagaacaaatttcataggaagagatgctgaaaaggcagttgataaagttgagtaactatttctaacaaagtctttctaaataaatttcttaaaggttaaaaattacctgtcaaaccccaagaatacagataatttaaaacagcgaatactggccaggcacagtggctcacatctgtaatcccagcagttcaggaggctgaggcaggaggatcgtttgagcctaggagtttgaccccagcctgggcaacatagtgagaccctatctctatcaaataatttttttaaaaaacagtaaatactaataccttttcatttattatcaattagcaatttcagcatacttaagaatatgagaaaataaaataatcagtataaacattagaaatgtgataatataatctcttttgctctctatgattacataccttgaaaaagcaaaatacctgaaaaataaactaatgaacaaaagaaacaagagtgtgtgaagacacttggattaaagataaatacagtctttaaatttttttctgtaagttagcaataaccagataacacttaaaaatgaagaaaaattggccaggcacggtggctcatgcctgtaatctcagcactttgggaggctgaggcaggcagatcacgaggtcacaagatcgagaccagcctgaccaacatggcgaaacctcatctctactaaaaatacaaaaattagctggcatggtggcgtgtgcctgtagtcccagctactcgggaggctgaggcagaagaattgcttgagcccgggaagaggaggttgcagcgagccgagatcgcgccactgcactccagcctggtaacgaagtgaggctctgtctcaaaaaaaaaaaaagtttcatttgtcaaaatacagttttttaagttaaaataacagaataagatgaattttaaaacatagtatcttattggagtattggaggatgtgaaacaagatctacacaaatggaaaaagatactgtatccctggatgaaaaaactaactgtagaagactgattctcctctcattattctaaatattttttaagattgtaattgaatcacattttcaattggataaaatggttttaaaacagacagtgtcttcaggtggggtggttcgccacagggggtgaatcaacagcggggagtcaag

SEQ ID NO: 924 - DNA, 14449 bp, Homo sapiens
  misc_feature (1)...(14449): n = A,T,C or G
atgcgcgactcttcgccccggctgaagacatcagtgccatgcttggactcgtttttgctgtttttgggacagtggtgccattcccctcccgtgactgactcctgcgtgcagtccctaatctgcccatcaccgccggggcactgtccacagcattctgttgatttcctccacactgtctaacacaacctgaaacaacctcatctgcccaccacgtctcatctgtgcctccctgcctggaacggagctgcaggaaggcagcgatgtttgtctggaggtgagcactgcggtgggcatttgccccgcacgtggtgggtgaccattgggcgggtgggcaccccccgaggcctcagagcagcagacgcccctccctgagcctggttgggcctgcaccacaagcagcacccaggtcccacaggtccctctccacacacagctcagtgcaggccgtgagcaagtggtcgcatgcacactgctgaccacctgcctggcatggcgtctggtaaacagcaggtggatattggtgtagatgtgccacctcgaattgctagattgggcagaaccccgctagagcccatccagttgcagacacaaacccagggcccagcagatggtgctgtctgctaggacaaggctggagagcagtcgctccatccagtcaccgtttcccgcatctggacgcctgcatcatcccctggacagccatgcagaacccgccctgtgcaggcattggagggccggggacaggaggctaaccctccatggtggggtccaggctaccccgcacagcatcctgcaaggcaagttccgcaccgcgaccacaggcggccacagccccgccactgagcactcaggggcagccgcggtgcaggagcagaagtttctgtctcactttgtttttatttcagtgtccaccccctggttgcaggttccctgttcgctggtgcgggtctatgaggaggaaacacacagaaaccaaaagatggaatcaggctgtctcgggccacttccttccgccacagctctgcctggagtgccagccccagcacaggtgaatacacagaaccagcgcctccctcctggagctttcctggggagaccagtgagggtgaacaaggaagcggatagagaactccccgcagcgtaagtgcagtggggacatttgtggcagggagtgcctggggagggtggtcggggaaggctgccccaaggagttatcatctgagcaagacccaaaattgtaagaagtagcacgcggcgctcccagggaagagcatgccaggctggaggccctgcggaggggacaagttcagcagcttggaggaccagagagaaatccaggtgggtactggccaaggtggaggtgtgagaaggagggctgaggacggctggggtcacacagcaccaagttgtaccagcccaggcacagttaaccattcattttaagagcaagtgaatcccacatgcttgacccaaggaattgctggaaaggtgctgacggatccaaaggatgtagagttcaatgccaaagggtgtggcagtcacctctcagaggctcggagcaagtggcagggcaatcaactcccctgcatttccatccacagtgcactaaatgccactgaatcatccgtccacagtgcactaaatgccactgaatcgtccactctggagtagttgataagattgttaacttatgttatgtgagcttcaccgtgaaataaatgtgtgtgtcttcatccacagctcctgcctcctaactcacacagccctggttatagccttttgttatcacgttggggcagtttaggcctcaggaagctgaatctcaagaccctaatctgactgtgggtcagaagatcctcattccagggtgggttctgcctcatcccctagaggaagaaatgctgccgagaagctgagaagagtctgggccaggcgtggtggctcatgcctgtaatcccaagactgggagcccaaggcgggcagatcacctgaagtcaggagttcgaggccagcctggccaacacggcaaaaccccatctgtactaaaaatacaaaaattagtcgggcatggtggcacgtgcctgtaaaaccagctactgggggtgctgagccaggagaattgcttgaacctggaaggcagaggttgcagtgagccgagatcacaccactacactccagcctgggtgacaaagtgaggctccgtctcaaaaaaaaaaaaaagaagaatctggacagacaagccctgctgagtttacaccacgccctgtgtatccagttgcatttctacatggttgtcaatcattcctgtccaacgatgtctccatcaaaggcccaagaggacagggttcagggacctttcagagagctgaccacgcagaggctcctggaggggctgcccagggagggcatggcagctccacgccccttccccgtacctcgtctgtgcatctcttcatgtatattctttgcaatatcacttataataaaccaggaaacgtgtttccctgactcccgtgagccactctagcaaattaatcaaacccaaagagggggttgtgggaaccccaacatcaagaagttggtcagaaggcccagacgtgcagctcatgtctggagtagggggggaggtcttaggactgagccctctccctgtgtgatcagacaccgtctccaggtagaggggtcagaatagaatcggaggatgcccctgttggtgtccgctacagcagtgttgctcactcagtggtggggagaagccccaactctgcgtttgctcacaggagtcttctatgttgatgatgtcgtggtgttgaagttgatgatgtcatggtgttcatgatgtcatggtcttgatgatgtgttgatgatgcagtgttgatgatgtccttgtgttgatgatgtcttggtattaatgatgccgtgttgacgtcatggttttgatgttgtcatggtgttgatgtcacggtgctgatctcatggtgttaatgatgcagtgttgatgatgtccttgtgttgatgatgtcatggtattaatgatgccatgttgatgtcatggttttgatgttgtcatggtgttgatgatgtcacggtgctggtctcatggtgttaatgatgtagtgttgatgatgtcatggggttgatgatgttgtgttcatgatgtcatggtgctgatgtggtgttgatgttgatgtgttgatatcatggtgttgataatatcgtggttttgacgatgtcatagtgctgatgatggtgtcatggggttgctgaggtcgtggtgtggatgatttcctggtattaatgatgcggagttgatgaagtcatggtgttggtgtggtgttgatgtcgtggtgttaatgatgtcgtgctgatgtcatggtgttaatgatgcggtgttaatcatgtgatgttgatggtgtcatggtgatgtcattgtgttgatgacgtcatggtgctgatgtcgtgatgttattgatgtggtgttgatgatgtcacagtgttgatgatgtcatggtgctgatgtcatggtgttggtgatgcagtgtggatgatgtcatggggttgatgatgtcatggatttgatgatgtcgtggtgctgatgtcgtggcgttgatgtggtgttgatgtcatggtgtttatgttgtggagttcatgatgtcatggagttgatgatgttattgtgttgatactgtcatggtgttcatgatgtgctcatggtgtcgtggtgttaatgatgtggtattgatgatgtgttgttgtggtgttgatgatgtcatggtgttgaaagtgtcatgtgttgatgatgtcactgtgttaatgtcatggtgttgatagtgtcatggtgttactgatgtggtgttgatgatgtcatggtgttgacaacgtcatggtgttgatgtggtgttcatgtcactgtgttgatgtcatggagttgatagtgtcatggtgttaatgatgtggtgttaatgatgcggtgttgatgatgtcatggtgttgatgatgtcatagtgctgatgatgtcatggtgttaatgatgcagtgctgatgatgtcatgcgttgatcatgtcatggtgatgtggtgttgatgatgtcgtggtgatgtcattgtgctgatgttgtgttgatgtcgtggagttaatgatgtggtgttaatgatgtcatggtgttgatgtcgtggcattgatggtgtcatggtgttgatgacgtcatgatgttaatgcagtgttgatatcatggtgctgatgatgtcatggtgatgatgtcacgttggtgatgtcatggtgttaatgatgcagtgttgatgatgccacggtgttaatgatggtcttggtgttgatgatgtagtgttgatgtcatggtgttaatgatgtggtgttgatgatttcatggtggtgttgatgtcatggtgttgacatgtcatggtgccgatgatgtggtggtgttaatgatgcagtgctgattatatcatggtgttgatgatgtcgtcgtgttcatgatgtcatggagtgctggtagcgggacagcagcttgagtttcttcagagcagcttcttggaagtgtgtattcactcctgcccacacctccaccccagggacttaaaacaatctcaatgccagaatatccataccttgggaagtcactcagccatcaaaagggatgaagccccgacccgtgttccaacattgatggagcttgcgagcaccacaccaagggaaagaagccaggcatgtaaggccacatactgtatggctggaaatgtccagaacaggcaaatccacagagacagaaagtagattcatgtggggagggaatggagagtgactactaatggcaacagggtttgtttctgacgtgatgaatgtattttgaagctagacagaaatggtagctgcatgccattaggaatgcactaaatgccactgaattgtacactttggagtagttaataagattgttaatttatgttatgtgagcttcaccatggaataaaataataagtgtatgtatgatagaggagacctcagagtcaggttgaaaacagaaagcacccatcaagtgcttactatttgcactattgaaaatgctgaccatgaccccatttaatcctcactctgcgagggagaactattaatactgttagctctaactcttggatgaggaaactgaggcacagaaagtggaagtgattcaggcagggacacagtgggcagcaagggttcaagcccaggtagtatttcttaaagaggtcaccaatttgcataagcttcaggccttacaaagccagtttcacattaacatcaccaccaccatcatcaccatcgtcatcaccacctccaccatcaccaccattatcaccatcaccaccaccaccatcaccattatcatataatcatcaccatcattaccaacaccatcatcaccatcgtcatcaccatcaccatcatcaccatcactatcattaccatcaccatcattatcaccatcatcattactatcatcatcaccatcaccaaaatcatcaccaccatccctatcatcaccaccattatcaatgtcacatgccagtagtgagatgtaaaacaaatgaaattatcatgcattgctgatggaagcttggaaagagagagaggaaagagagtggaaagaacaaagggaggaagagagggaaggaggaagggagtgaaagaataggggggagaagaggaaattggagaggatgggagggagggaaggcaagggaaaaaaatcctaggaggtggcttgggccctctggcccttcaatccctaggggcaaagggctctcggatgtggggcagggtcgggaggaggagtgctacagggatgtctccctcacatggcagacagaaagggtgagtgctcaggacagcccaagaatgatgtgcagggtgggcccaacctcccatgacccctgcacctccctcccagcaggacactgcaactctccatccactcctccccactaccaaaagaacacaaaaataggaggatggactgctggtgctcggtggtccacaaacagatggctccctttcaactccagcctcagcctggatcccgcctgggtatgaatccacctggcccagtaggcaaggccagatacaggaggggcacccaggcctgtctgcgggcaacaccagcagcatcaccactccatggtcagcttggggcatcctgctcttaggatcaaacactagtgtcagaggcgtcctaatcagagtgagtctgtctttaataaatgtgggatatagccatgcctgcagggttacacccccagggggtaggcactcttgggcacaagatgtttatggttgagggaacaagttaatgatgctaactaaataaagacgcagaattttatggcaatctcttaatattttaagaacaaaaagcattcttagtttaagagtaggttttgatttaaggttaatagtacattcgtaaatccttgctgaaatcagtagtaacataggaaaataatactaatagcctgtcagaagctgatcaccagcctctgtaataaagcacaaaagacctctcttcttagctctgttaacctatataaataagaatcgtatttaaggtgtgcgcgttccttctcttgcttttggaggacatcctactctgtaaccgagtggtctctgataaacgattttaactttactatactctgccactcacctggaattgttcctcatccaacatccaagaacccgctcttggggtctgggacaggcctcttattccagtgacattaggaaggggttaaaaaatgaaaaaaaaaaaaaaaagcacttgcctttcaagatgcctgcttggtccttctccaagtatcctttccttcctttcattcatgttctaaagccttttaataaactttcactcctgttctgaaactggctccgatctctctttctgcctcatgcccctcagtcgaattctttcttctgaggaggcaagaattgagattgctgcagacccgcacggacatgaattcaccaccaggaacgttttgatgccatgactcaaatacgtattttggtgctgcatgactcagatctgttcctggtggtaagacacctctatgcctcaccttcttcggctagagatgctcaacgcctgtacacaattttcttctccccttttgctctcctgtttactaaccaatgcccagaacaattccccttcgttgtaagtgactctgctgatctctcagttcaccctgatgggtggcttgcaggggtgggaagaaccctggggtctgcaccgagtggaactgaggcactgatggccccctggagacagaagacttgtgagggtggtggggctaaagcctaaagcctaaagccatgcaatgtctggggtttcctctgcttttgcaactaaaatcagctctttcccaagaacccacagtgcctagtctcctgctttctctgcgtgtgttctgcctgtggggcttttaaacactccctggtattccctggtgtccacagctcttactgcatttgtgtggcaccaaagacatgggctcccttgtggatcccccctgagatttatatttgttctcaccctaccagctcagatgacctcccacccttcccgtctgctgccgcactgccggggcagatactcactggaactccagccctgtcagctccttatgacctaccatgtgatttccatttctgtaaaaaggaaaagaaaaatgaggccgggcacagtggctcatgcctataatcccagcacttcgggaggctgaggcaggtggatcacctgaggtcaggagtttgagaccagtctggccaacatgatgaaagcccatctctactaaaaacacaaaaattagccaggcatggtggtgcatacctgtagtcccagctactctggagactgaggaggaaggatcacttgaacctgggagattgaggctgcagtgagccaagatcacaccactgcactccaagcctgggtgacagagcaagaccatcgcaaaaaaaaaaaaaaaaagaaagaaaaaatgaaaaaaggaggctctatccccaggttctttcttcaccctgggaattctccacaactcccatgggagcagggctgggagacagtgcaaaagagtcttgaagccggacaacagcgggggattccagcactgccattctctactggaatgctcagctggatgcttgaccctggagaaattctttctctctctgaagttttccttagtggagagggagaaaatgaaaaaatatgcatatgcctattttgttaaatgtaaggtaataatagctattaagattcaactatttgtaagaaggtgagagttaaaagacagtctgggagacaagcacaacaggcaggacctgacatggagcagagtgctcatcagattgggtttttctcaaccttcagtgatcaccataaattttctatgactttctattcatcccatctatatcattcatcatttgaatacttttggctgtttaattaaacacattgactcacttttcttttttacttaaatatgttttaaaggaagcctcatatctcaaccaaaaatggaaaactaatatatccattgccattaataaaaggtaacaatataataaagaaaattcaacagtatcatcaaactgcagctagcttgtacagtcagttgaaggcgtcatgcttgaggcccacttctgcctttctctttttcaaacaagaagtttagaaaggttagagattgattggtacccaaaggagactcccttgttgatttaattattagaaaaatgggtaattaaaaagtgattaacttcactatggattcaatgttatatctgttataaaaaatattaaaaacttaaaaataggcaaaaacaaaccactaggtgtgtctctgtggttggctttctattgactgaactattttacaactgtagaatagaagttcatgtagagaatacagcagtgtgcatgcttcttatctgagagcaacacaaagcttcctctatggcaatgtaatcagtgttgttcactgtagatgcaactgatgctcatgtctaaggaaagatgatcccaagtattacttacaccttattgtcctgtaggatgttacccaagtttgcatctattatcaaattcatttcagcatgcctttgttcttcacattgtcctttgaaccagccttgacatctgctgtggtctgaatctgtctccccagattcatgtgttggaaatgtaatccccagtgcaacattgtcaggaggtggggcctttggaggtgtttgggtcatgggagctccacccacataaatggattagtgcctctgtaatctggggttttcaggatgggttcgctctctcttgcccttccactttccgccacgtgaggatgcagcaagaaagcccttgtcagacgccagcatcctgatcttgattttcagcctccagaactgtgagaaagaagtttctattcttgataaattgctcagcctcaggtgttctggtctaacagcacaaagtggactaagacaacatcttacaggtaccctcgtttactgatgagttaaatacaacatcttacaagttccctcgttcactgatgagttaaatacaatcctttacatgtgcttattttatatttatagaacagttgttttccaccttttgaaaattacattttagcatccaattgtaccgaaaatcacctcctatgctggttagggtctcctaccaacctcattcaactatctcatttatagttggtactaaggcccagaaggggtcagtgccttctctgagtctgcacagcagtggatgctaaacctgagactacaagccaagttcctgattcgtttgtgtttctcttggccatccgcctccccttaatggctacccaaacctacctctctagaggttccagtcccctctcacctttctggatgtaaaatgtattcctaatctctcgcctctaccctggcaacccacactcctccttactgcttccctaattcccagataatacccaaatacagccttccttctctgccctctccttgcctccctgaaccagaacacctgtctcttaaacttaaccagggtcccacactcctctccaaatactccccgccatgacctacacacccgacacattctggccgctgccctcctctctacctcggtcccaccaatctccccagctcgacacactctgcactcgacccctcactctgtcccttaaactgccaagttgctcctgctccacggcctctgccctcacagctcccacagccaggggtcttctccccactcctccaccttcttcacatgccgtcctcccttcagttggcctctccctggccactgtggtgaacacccctacctccaccacctcctggccactctatcccaataccgtgcgcccaattcttcacagtctttctcttgctctcatttcagagctgtatggggtttcggctggctggtttactgtcgatcttctgcactagaacctaagttccggtgagcaagttccctgtttggcttgctcagggcacctagagccaggcctcgcgcagagcaggtgctgatgaatatttgctgaatggctgcacactgccttagctggtagcagcccctgggtctctgaaaaggctcgcgatgtcagacagggcgacacatgctgcctctgctgctgactgtgctacctgggctctttccttcaagtaacatctatttcatgcccagtacagctctaggtgctgagaaaatgggacttgattacatacagtggctgcagtgaggaaagaaaggggttcgtgccatggaaaccagcaggcaagagaaggtatgctctcagcccagcatcctcagctgacttgggccaccagcctcacatcccctttgtttcattgactatctaagtccactttgcattgctctaaaggaatacctgaggctgggcaatatatagagaaaagaggtttatttggctcatgattctgcaggctgaacaagaagcatgtgccaacaactggtgaggccttgggctccttccactcatggagaaaggggaaggggagcaggtgtagcacatggagtgggacgggggagtggggaagggtaggacattgccgggctttttttttttttttttttttgagacggagtctcgctctgttgcccaggctggagtgcagtggtgcgatctcagctcactgcaagctccgccccctgggttcacgctattctcctgcctcagcctcccgagtaggtgggaatataggcacccatcaccacgcccattgccgggctttttaacaatcagaccttgcagggacccatagagcgagaactcactcattaccacaagacagtgagggggagatatccaaaccacatcactgatcacttccagaacatgggcctccaagacacaggaggttcaggacccagcgtgagagcaaggacacacagccttccagaggagactcccagtgaggccaccccgcactgggggatttcaagccatctgggaaagatctggggaaagataaggtgactattccagccacctccagtcatggagaggcaggcaggtgtatgcagaaagacagaggacaaggtaaaagtgttggggggactcatgtggaaattcaacaattgtgatatttttaacaagttcctattgtcttaattttttttttttttttttttgagacagggtctggctatgttacncaggctggagtacagtagcatgatctcagctcactgcagcctccatctcctggactcaaatgatcctcccacttcagcctctgaattagctaccatgctcagctaatttttttattttttgtagagatgaggtctcactatgttgcctaggctggtcttgaactcctagcctcaagtgattctcctgccttggcctcccaaagtactgggactgcaggcacaagccctgcacctggccaccagtccctactgtaaaaaggaaaaaatacacacacacaagcacatatatattacagcaaagaaagggggctggattttcggataacttatctgtagctccgaggacaacccggttccccagggattcattaagtccttcttacatggctgctgagtcttcaccatcaacaagcccagcaacctccccaaagaaaggattctgcagcctggagagggccctcatccactgatgattatgtttcttgctcagaggaaactaagtctagctccctgctaacgcagccttgggaagccaacacttcaccgagaaccctgaatcggcccctctcagaggccgggaaggcagtggggctggcagggctaccgttctgaattcatgtgcaccgactgcgtcccctgagctacgcctgcattcaccgcactgattcaagacagccgcatccattcaccaggctctgtgtcatcaacatcaccctgtgacgtgccaacatcagggatcccccactctgagctcaggaagaccgtcctaggatatttttttaaagcacagtgagagagaaataagaaggccagtggtagtgacagacctaagagtgttctgtccctcttaggccccacgacgcgcaccgctgcgtgctgcctgggagctcattcttaggtttttaggtctttaaagaggctgtgaagaggagggtattccggatgctttgtaaactgacagactttttaattaacataacaccgtgatattatcacatccaacaaaactaacaccaatcccttactatcttctaatacccagtccataataaatgtatctgcttatctcaaaaaaaaaaaaaattcagttggttttgttcaaatcggaatctcaacacggtttagacaacctttggtatttctcttaagtctctcttctcttttattttttttaacagatgcattaaccttaatgaatcaggaatatatcaaaagagcaagcaggccgggttcagtggctcacgcctgtgatcccagcgctttgggaagccaaggcaggtggatcactcaagcccaggggttcgagaccagcctgggcaacatagtaagatggccatctctacaaaaaattacaaatacaaaaattagccaggcatggtagtgcacgcctgtggtcccagctactcaggggtctgaggcaagaggatcatttgagtctgggaggttgaggctgcagtgagccgtgatcgcactagtgcactgcagcctgggtgagagagagatcctgtctcaaaaaaaaaaaaaaaaaaaagcaagcaggatattaaatgaaggagccattttagccagggaaggggccggaggacgcagcacatcccttccgcattgcagacttgcagtctgtctcttggaagctcacagagatctccatgcatcctgcttaagatcaatggtcaaagactatcaatcccatctgcagccaggagatgggagattacatgactctgccaagggacccagacttcctttaagggattttcccaaatgtcctccctagcagtaaggccggatatcaccaaaggaggcgaagaaacgaatgagaaatacgcagtgtccaacagactgacctgtgtgcccctggggtgtcctcatggttcgggttttacagcttttacaggttttcttcaaaaacccaaatatcaaggtgaacatggcacatcctattaaaagggaacacgttaatcactgtgtgatttcagagaataaaaagatctcctgtaacccacacaaacgccaggccccatgtgaaccaggctgtacgcggcccacatagaaagaaatactaggattcacgaaccaaaggtgataaaaagcaattcctgtctttagttgtgcttcttggaaaagcttttagggcatctaattcatagtccatagcaatactttctttttaaaaatctacattaattaattaatttatttatttagttttgagatggagtctcactctgtcacctgggctagtgtgcagtggtacagtctcagctcactgcagcctccgcctccctggttgaagcgattctcctgcctcagcctcctgagtagctgggattacaggtacctgccaacacgcctggctaatttttatatttttagtacagatggggtttcaccatgttggccaggctggtctcaaactcctgacctcaagtgatccacccgcatcggcctcccaaagtgctgggattacaggtatgagccactgtgcctggtcttctactttttattttggaataattttagatttacagggaagttgcagcagtaacatctaacatctccttccctttcaccctcggttcttccgcactttgcaatctgttctgctgcttttctctcactaactccctacccggcccacctatcccccaaaacatactcttcctggcaccgtcttcaccacggggctggaaggagccgcgccat

SEQ ID NO: 925 - DNA, 18742 bp, Homo sapiens
  misc_feature (1)...(18742): n = A,T,C or G
gaagggagggaggacaggtaggcaggctatgattgggtttcattaaacgctcttacctgatggaagaaatcatccatgaaatgatctttctcaaccacaacaactgtgtctccatcatcattcttcctacactacaatgaaaaatggaaaattcagttttttaaaatttttatgtaggcacaaatagcgaactgaaatacaaaaacagttcaatacccacaagatctcaactcactacagcaccaaattgtaacagactagcagccaccactatctactccaactgaactccgcaacattttcaacacaacagatcctggctgaagcagccagaaggtggaagacctggagagaaacaaggggtggctttctcagaactaagctgcttagaatcatttagttctcactatgtaagtcaatataacacaggccagttttaccctcaagaagtgaaactgctggtgttgcatattttccataaacagtaaaaacactggccagccgcagtggctcacgcctgtaatcccagcactttaggaggctgaggggggcagaatgcttaagtccaggaattcaagaccggcctgggcaacatggtgaaaacctgtctctacaaaaaattagctgggcctagtggcccatgcctgtggtcccagctacttaggaggctgaggtgggaggactacctgaacctggcaggtttagctgggcctagtggcccatgcctgtggtcccagctacttaggaggctgaggtgggaggactacctgaacctggcaggttggggctgcagtgaccctgtctctaaaaacaaaacaaaacaaagcaaaccccagcaccacccagaagaacgaccattgatcaggagctgaagacctgggctccagcctcctccccagcagcccattagcttgtctcagtctctgcctcttgtccatgaaatagagatagtattgtcccatctccatcagaagaccctaaggataagatatttatcagtgttttataaggtaacactactttcatgggtaatattaatatataaaccaataaaggcttctattaataaaattatttctagtccctactctttttttttggaaacaaagtctcactctgtcgcccaggctggagtgtggagtgtgcantanannncactnnantnattttnnctcactgcttcctccacctaccaatttcaattgattctcctgcctaatactcctgattaccagggattacaggcacccgccaccatgccaggctaattttgtattttcagtagagagagggtttcaccatgttggacagcgtggtcatgcagctggggccatcaagtaatcaggcattccgcgcctctcccagcgcgggcattcgaggcttaagaccagatccgtggccacagtttgaacagtaacgatttgactcagtggacgtttatgtgtaacctaggtcagcctcccaaagtgctgggattacgggtgtgagccaccttgcccggcccttaaggttttaataaaatgtttaaatagaattgtttaaaatcttttaaaattttattttatcttttttttttttagacagagtctcactctgtcacccaggctggtgtatagtggcatgatctcagctcagctcactgcaacctctgcctcctgggttcaagcgattctcctgcctcagcctctggaatagttaggactacaggcatgtgccaccatgcctggctaatttttgtatttttagtagagacggggtttcaccatgttggccaggctggtcttgaactcctgacctcaggtgatccacccacctcagcctcccaaagtgctgggattacaggcatgagtcaccgtgtccagcctgtatttttttttttaatttaaaaaataaaaaaaaaatttaaataaatatttaaaaaataaaaaataaataaagatgaaaatagtgctgagtgtactctttggtggcccatacgaaacagaaccttcaagggcgtcatctgacctgtgctggggtgagtaacaacatgctttccatctgaactcattgacagcgttttaagattggatggttttatgtctggaaattctttgatccccctccattgaaaaggttgattctaattaatgtctccttgagtgtgggctggacttagcaacttatttataacaagtggaatatgtcataattgacagtgtgttactttggaaagtaggtcacaggggctctgtggctagaatcactcactctgtgtggacctggtcaccgtattgtgaggacaaacacagccctatggacaggttcttgtgacaaaaatctgaagtccactgcaaagagcccatataaacccgccagccagccaggtgcggtggctcatccctgtaaccccagcactttgggaggccaaagcaggagaattacttgaacccaggagtttgagtccagccagggcaacatagtgagaccctgtctctacaaaaaataaaaataaaaaaatttagctaagcgtgatggtctgcgcctgtagtcccagctactcaggaggctgaggccagagtattgcttgggcccaggacatcaaggctgcagtgagctatgatcctgccactgccctccagcctgagcaacagagagagacctggtctcaaaaaaacaaagcaaaacactggaaaacctgccagccacatgagcgcgccatcctgaaataaaatcttccagcgctggtccagccttcaggtgactgtagccttagctgacattttacctgcaaatttcatgagacctggatccagttaagtcacatagaaactgtgtgagataaaaagggttgattgttgtttcaagccattaactttgttaatgtactttgttaatgtactgagtactttgttacacagtaatagataactaatatgaaagaaaaggatatttcacataaaatccaggtatctggattcctttgaaaatcataataagattggaaggcattgagcctcctttcttgtgtggctacaaccttctggaggtatatagccactgccccctacagacggggcaaatgctgccagctgccattgcccctagcccgccattccctgttaaatctcagacgcaggcctcaagccatttgccccttgtcatctggtgctcagcctgttctgcatgtttgcttacctgcctgagccctgaactgtttgagttgcgaaactctactgagtctaagagggatgaaaaatgcacagatgtattagttcacccacctaatatttattgagcatctgctgtgtaccaggcactctccagggactgggacattcagtaaaacagacagaaaacgaacctgagaattaagtaacatctatgaaatagtgataattactaaggtgaaaaataaagtagttaaagaaaatacaggccggtctcacaactgtaatcccagcactttgggaagctcaggtgggtggatcacttgaggccaggagtttatgaccagcctgggctggtgacactccatctttacagtatatacaaaaattagctgggcatggtggtgtgtacctgtagtcctgattactcgggaggctgagacaggaaagctgcttgagcctgcaaggcagaggttgcagtgaactgagatcccgccactgcactctagcctgggtgacagagagtgagactctgtgtaaaaaagaacatacaggccgggcgccgtggctcacccctgtaatccagcactttgggaggccgaggcgggtggataatctgaggtcaggagttcaagaccagcctggccaacatggtggaaccccatctctactaaaaatacaaaaattacccaggtgtggtggcgagcacctgtaatcccagctactcaggaggctgaggcaggagaattgcttgaatccaggaggcggaggttgcagtgagccgagattgcaccactgcactccagcctgggcaacagagggagactccatctcaaaacaaacaaacaaacaaacaaaaaacatacagacggtcgaaggaaggaggtggttgtgcaggtcgggtgcccaagagaccttccctaagatggtaatgtttgagcagagacccacagaaggtgaaggaaggagccatgcagatatttggaggaagagaattccagcaaaagggaggggcaagtgcaaaggccccaaggcgggagactgcctggagctgtcctgggacagcaaggaacccagctggctgaggcaggtgagcacaggagagaaggaggagggctcagccaggtgcagagaggcgaacatgctggctttgttattgtggaagctcggggttagggtgagggcaaggagcctctgctgtggtctgaatgtttcctcccccaaaactcatctgttctgatcctaaccctgaaggtgatggtattaggaggtggggcctttgaaaggtgattaggtcaagagggtggggccctcacgaataggattagtgcctttaacaaagggacaccagggagctccctcacccattccaccacctgagttcaagaccagcctgggcaatatggcaaaacgctgccaatgaatgaatgttaaaaattcttaattttggctgggcacagtggctcacgcctgtaatcccagcactttgggaggctgcggtgggcagatcacaaggtcaagagatcgagaccatcttggccaacatggtaaaaacccgtctctactaaaaatacaaaaattagctgggtgaggtggtgcatggctgtagtcctagctacttgggaggctgaggcaggggaatcacttgaacccgggaggtgaaggttgtagttagccgagattacaccactgcactccagcctgggtgacagagcaagactctgtctcaaaaaaaaaaaaaaaaaaattcttaattttgtgcatggcacaatataatttacaactttgtgtgttttcattgctagtacttttatttctgtatatgttgttgttaaatgaactctattattaattcacttattgggtgtatttttctgggttctttgactatttccacatatcgctgtttttggtaatcttttaaagtatatttaacaatacatttatgaattatataatctataattcacttttttcaatttatcaaatccaatggagactatagcagtgaaaagtctatgaaccagaaggcaccatctttgaacaagacagtgggtcctcagcagacaccctatgtgctggtgccttgatcttggacttcccagcctccagaactatgagaaaggagtttctattgtttataagccactcaatgtatggtattctgttataacagcctaaatggaataagacaactgcccccgttagggccaacagtaatgtgttttttattttttattttgagatggagtatcgctttgttacccaggctggagtgcagtggcacaatctcagttcactgcaacctccccatcctgggttcaagcgatttacttgcctcagcctcctgagtagctgggattacaggtatcctaccatgcttggctaatttttgtatttttagtagagatggggtttcaccatgttggccaggctgatctcgaactcctaacctcaggtaattcgacctcctcagcctcccaaagtgctgggattacaggcgtgagccatggcacccagccagtaacatctttcattcagtgttacctgtcactttaggagaatctagtctaattaaggaggacagaaaaaaatgtaggaaagcataagaatataacagaacttctcaaaggttgagagatgcctggggcacttcacagacatagagtttcaaaatgtacctattacatcttccactatatagttaaattttcagtattatttttagggtttcaaaaattgtggaccattttgaattcttgcttttactgactcttctaagacataccaacacccagtgccacataactgtgctattcataagataattatagggtaccatcagcttcccagggctgccataacaaaacaccacacaccagtaacttacaataacagaaatttattctttcacagttcaggagggtagaagcctgaaattgaggtgtgggcagggccgtggccctctggcgtctcgaggggagactccgtcctgtgcctttctcttagcctctggcattgcgggcaacccttggttctccttggcttgtagacatatcactccagtcacgtggcagtcttttccctgagtgtctccctgtcgcctgtgaatgtgaggcgtctctgtctctgtgtatctccgtctctgtctttccttagaaggactccagtcaccagattagggcccaccctgatgacctcatcttaactccattacctctgtaaagaccctatttccaaaacaggccacattcatgggtacaggggagaagaacttcaacacatctttgagagacacaattcaacccacagcacaggttttagaaatatgtgtatactggccaggcacatggtggctcacgcctgtaatcccagcactttgggaggccgaggcgggtggatcacttgaggtcaggagttcgagaccatcctggccaacatggcgaaaccccgtctgtactaaaatataaaaattagctgggtgtgatggtgcgcgcctgtaatcccagctactcgcgaggctgagtcaggagaattgcttgagaatgggaagcagaggttgcagtgacccaaggttgcaccactgcactccagcctgggcaacagagcgagaccccacctcaaaaaaataaaaataaataaataaacacttgtatattggtcgggcacagtggatcacacttgtaatcacagcagtttgggaggcctaggtgggcagaccacctgaggtcaggagtttgagaccagcctggccaacatggtgaaactccatctctactaaaaatacaaaaattagccagatgttgtggcatgttcctgtagtcccagctactcaggaggctgaggcaagagaatcgtttgaacccaggaggaggaggttgcagtgagccgagattgtgccactgcactctggcctgggtgatagagggagactccacctcaaaaaacaaaacaaaatgaaatacatatatgtgtatttacatacacatgtaaatatattatatttgcttatatataaattcagaatatactttggtagaatagttcagaaccagggcacgagttgaaggctagccgggtggccgctttcccctgtgggtccccacagtgtgtttcaggagcctggtacatgacctcacctgggtggaggtggggcagccgcagcactgctggctcatctgatatgactctctgctgtacacaagagtcactgcattgctgaagcccaagttattcagaccttccactaccaatagaccttcaggcttttctagctcgctttcccacgaaaacaatgcagcagttaatagccttaaacatatgtgcttgcacactggggcttttattttatggatctttagattcctaaaagggaattgctaggccaaagaggtgtgtattttttttttttttttgtaagatgtagtctagctctgtcacccaggctagagtgcagtggtgcaatcttggctcactgcaacctctgcctcctgggttcaagcaattctcctgcctcagcctcccaagtagctgggattacaggcacccaccaccatgcctggctaatctttttgtatttttaatagagacagggttttgccatgttggccaggctggtcttgaactcctgacctcaagtgatcctcttgccttggcctcccaaagtgctgggattacaggcgtgagccacagtgcctggcctttttttctttttttttaatagagatcgggtctcactatgttgcccaggtgtccctgaaactactgggaccaggggaccctcccacctcagactcctgagtagctggaattacaggcatgagtcaccatgcccaactgaaagtgtgtgttttctatttctgttttcactagaagttgggaaaatggtgtcacaccgtggtttcaatttttaaattctatttaaaataaatagaaaatatttgattggttaatgtggaaagtccctgggtgtggtggctcacgcgtgtaatcccagtactttgggaggccaaggtgggaggatcacttgagcccaggagttcgagaccagcctctataaataagtaagtaaataaataaacaagttaaacaaaagtcaagatgtgtgaagaagttcatgctgtttccttctcattcacataaactgatacatgaaataattctctgaaaactgtggtagccaataatggccacaaggaggtccctgccctggtcgctggaaagtgtcaatgtccccttccatggcgagagagaatttgtatttgcatgaaaggtacagattttcagatggggagatgatcctggattgtgcaactctactctgtctaatcagttgactcctcaaaagtggagcctatttctgatggtggtcagagaaaaagatgcatggagaagggtcagagcggtgccacgttgctggcactgaagatggaggatgggtcaggagctaggacatgtgggtacctctggaggccaggaaaggcgaggaaatggattcttcttgggagctggcagaaagcagcccccgtcactccacggatgcctgcacctgatgtctgatccccacaactgcaagatggcaaatctgtgttgctttaggccactaactttacagcaatttctgacagcaggcatatgaacctgatacagcaagtgacatcgtattttgaaagctatttccagataacatattcggcctcatctttaaaaaggatagcttatttctttttttgagatggagtcttactttgttgcccaggctggagtgcaatggtgcaatctctgctcactgcaacctctgccacttgggttcaagcaattctcctgcctcagcctcccgagtagctgggattacaggcacctgccaccgcacccggctaatttttgtatttttagtagagacggggtttcaccatcttggccaggctggtcttgaactcctgacctcgtgatccacccgacttggcctcccaaagtgctgggattacaggtgtgagccactgcgcccagcctaggatagcttatttctaaacttaaactttgcataattgttagaaataaatttttggtgctgcaaaagaaatagcactcgagcataaattttctcagcaaggcaatttactactatagaagggtgtgtctcacggatggagcaatggtgaaagcacacctggacaagggaggggaaggagttcttatccctgacacaggtagcccctactgctgtgtggttctcctgttggctagggttggactgcacagtctaagctaattctgattggctattttaaagacagcaggggtacgagtcggagtggcaggggagtagtttggtgagaaggatggttacagaacaggtgactcaggatgactaagaacagagcaggtcaccaaggatgactaaggtcagagcaggggacaagggtgactaaggtcagagcaggtgatagaggctaggagggggttgtttattgaaactaggggcaagcagatgaagagaacgaggaagttaaactttaaaatgaagaacaaagaacgagggagctgaacatacggatacattggttctttggagaggatctcagaactcattgtactaaacaatgtacaggctaaaacctttaaagaggaatttattatattctacaataatgataagcaaggcgattggattttcagatatcattaaagcttcatacccacttaaatttacattctgtatccaggatgaggagaagacacaatgaattctaagccagccttgaacttacaagcagaagaaacactgctatggttgactgatattgtcaattctttaggactgtaaatgggggaatggggatgaattttaaattttccctattatttcataagtccagaaaaatgcaatactttgaaatcacagaattttatttatttatttttaactaaaaacatttttgtagacacaggggtttctccatgttgcccaggctggtcttgaactcctgtcctcaagagatccttccaattcagactccaaagtgctgggattgcaggcacgagccgctactctcagccaggattttaaaataggaaccttgctgggtttgtatccaaattgctgctgaacagaagcctcctcctaggggtgacaggagattgaatgggttagaatgctgtatagagaaactgcctttgcagaattataaacaacaagagaaacctaacatgacggactccatcttgcttctaacctcacaggctaaatattttttatttcttattctagcacagaggccatgataactatgaaagggatttagtttatgaaacttggaggcaagggaaactgacaccctcttgtccggagattgaagcctcattcatgaggcaaagttaaaaattatggtagtggcttggactttgctaaagaataggcacagttggctgggtgtggtggctcatgcctgtaatcccagcactttgggaggccgaggcgggtagatcacgaggtcaggagctcgagaccatcctggctaacacggtgaaaccccgtctctactaaaaatacaaaacattagctgggtgtggtggcagtcgcctgtagtcccagctacttgggaggctgaggcaggagaatggtgtgaacctgggaggcggagcttgcagtgagctgagatcacaccactgcactccagactgggagagagagcaagactttgtctcaaaaaaaaaaaaaaaaaaagaataggcagagttaaaggatgacctccgactgcttgacgtcttttcctagaagttgctgactgccctggtcacataactgggggtggggtgtcacaaaatttgtaacttccccaactgctcctatagataacagcactattgtgaatcctaaagaactggtctttgaggccggatgcggtggctcatgcctgtaattccagcactttgggaggctgaggcagaaggatctcttgagctcaggagtttgagaccagcctgggcaacagagtgagatccccatctctataaacaacaaaattagccaggtgtagtggcatgcgcctgtagtcccagctacttgggaggctgatgggggaggaccacttgagcccaggaggtagagactgcagtgagccatgattgcaccactccactccagcctgggtaacagagtgagaacatatctttaaaaaaaaagaaaagaaaagaaaaagaaaaaagacagccaggtgcagtggctcacgcctgtaatcccagcactttgggaggctgaggtgggcggatcacctgaggtcaggagtttgagactagcctggccaacacggtgaaaccccatctctactaaaaatacaaaaaattagctgggcgtgatggtgggtgcctataattccagctacttgggaggctgagacaggagaattgtttgaacccaggaggcagaggttgcagtgagccgagatcatgccactgcactccagcctgggccacagaccaagactctgtctcaaaaaaaaaaaaaaaaaaaaaagagaattggtcttcgagatcgttttcagattttgcattttggtagaccaagagatgccacctagtcctgagaatccccttcccctcctgggaacggactcacctgtgcaaacacactcctgggatttcatacccagccagtcagttgttccagttccccagacccctgcctgtcaaagtatcttttaaaaatctgagcctccaagtcgcagggagaggagcttgagaagtttctcccagttccccttgtgtggctggccctctgatgattaactcgttctttgctgtggcacctgctgttctcattggctcctccaggacagcaggcaagaagaatccgcagcctgtgatacccacacagggtgagcgcttattaaattaagccacgaatgtgatcggaaccaaagtattcactctgcaaatgaaggctgtgaagttcacaaacttgtaatttgccataactcacccaccacatttactcacccatttacttttgaatggataaacgtactaagcaaattttgcagtgtaacctttttctttattcattcactcagcaaatattaaaaacctcatgtgtgtcgggtatggtggctcacacctgtaatctcagcactttgggaggctgtgtgtggctcacctgaagtcaggagttcaagaccagcctgggcaacatggcggaaccgtgtctctactaaaaatacaaaaatcagcctgtgtggtggcgggcgcctgtaatcctagctactcaggaggctgaagcaggagaaacacttgaacttgggaggcagaggttgcagtgagccaagatcgtgcaccaccgcactccagtctgggtgacagagtgatactttgtcaaaaacaaacaaacaaaaaacaaacaaacaaaaaaccagaaaacaaaaaacagacaaacaaaaaaccttaagtgtgccaggcaccattctaggtatggaagataatttgtgaacaaagcagacaaaaatccctgcccgtaggtttttgaggaggaaggcaggtaagaaacagcagacgtccatgtgttgagcagagcctgaggaggctgcaggtgcagcgggaaaagcgcacaggggaggggatggtgagggtctcccaggtgggcaataacgtgccttcggtcttcctctgggttcccaaaacagggcttctgaaatccttggaatttccaagtgatggggcaatagcggcttttgttattcagaacaggccctttcacccgttctagtgtttatgctaatgaggtgactcctggagggtcccaggttgcccctagatggggactggttgccaggggaaccaaccttgggattagagggttgggactttcagctccaccctcgatctctggtggttgcagattgcattaatcaccactggccaatgacagcaatcatgtctcccgaatgggctctccataaaaccctgaatgacggggctctgcgagcttctgggttggtgaacgccaggaggcagtgagaggagcagctggtagggagaaggcctggacaatgcattgttgcctgggcaacacagtgagaccccatctctacagaaaaacaaaattagctagggctggtggcatgagcctgtagtcccagctacctgggaggctgaggtgggaggatcgcttgagcccaggaggttgaggctgcagtgaaccacgattgcaccactgcactccagcctgggtgacagaatgagaccttgtcacacacacacacacacacacacacacacacacacacacaaggattcatcttcaagatcattttcagatttagcatttcagtaggccaagaggtgctgcctagtctggtcctgagaccccctgcacgcccctcccatccttacctggccctgtgcacctcttctttgtggctgttcctgagttgaagcctttgtaataaagtagtaatagtaagtaaagcacttccctgtgttctgtgacgcattctagcaaattatcaaacttgaggagggaggggctgtaggagccttctattaatggccagtcagtcagacgcactggaggccccgatctgtgattggcatctgaagtgcggggccgtcttgtgggctgagtccctgacctgtggggtctggaccaattccaggtagttcagggcagaatggaatggaaccgttggacactctgctggggtctggagagctggagactgggttgctggggtagaaaagcctgcgagtctcttgtctgaagtgctgtgcatagagcagttcaaagggggtggcaatttttaaccggatgggtctgaagaagcctcacagaaacgtcatggaaccaaaaccccgaagaaggcacgggacagagctggtccctgtggggacagagcaattcctgcagaggatgccagggtagcagggatgaggcctgagaggcgctggctgagctcggagtgcgcaggccccgctgctgctgtcagggttttgttgttttttgttttttttgttttgttttttttttgagacggagtctcgctatgtcgcccaggctggagtgcaggggcgcgatctcggctcactgcaagctccgcctcccgggttcacgccattctcctgcctcggcctcccgagtagctgggactacaggcggccgccaccacgcccggctaattttttgtatttttgctagagacggggtttcaccgtgttagccaggatggtctcgatctcctgacctcgtgatccacccgcctcggcctcccaaagtgctgggattacaggtgtgagccaccgcgcccggccgctgtcagggttttgcttggaggttggcgcggaggagccacctaaccctctgcgggctccctgagccctctgctccgcccttgcccttctccgttctccctgcgtggaaagcatggctagtctccttcccccattcccatctgtcttgggtccagttcctgggaaacaggaagttattgggagggttgacactcagggaggagagaagaaagtgggattgggaagtgggtttgaccaccaaggcctcactgaggtgctcctgccctgagctctgacatccgcgctgccgctggagttctcccacttcacagcagtgggcatcgcggcatgcagccacccccaggaagcagtgcttagccagggactcaggtgaacgccgtggctccggcaacacgcggagcagtgagcagggagtccctgaggccccagaaggatctgggaggcccacagtggcatctccatggcatcatctcagtgatgcttttcccagtcgacctgcctgaaactgcacctgccccgacaccctctgtccccttttcctgcgtcatttttctctggagcacttcacacccagaacttattatatgttttgtttttttgtttgtttgttttgttttgttttgttttgtttttttgggagatgggtccttgctctgttgtccaggctggagtgcagtgatgtgatcagatctcagtacagcctcctggactcctgggcttaagcaatactcctgcctcagcctcctgagtagctgggactacaggcacatgccaccgcacctggctaatttaaaaagttttttttgtttttttttttttttttggacagagtcttgctctgtcgcccaggctggagtgcagtggcgcgatcttggctcactgaaagctccgcctcccgggttcacgccattctcctgcctcagcctcccaagtagctgggactgcaggtgcccgccaccacgccaggctaattttttgtatttttggtagagacggggtttcaccgtgttagccaggatggtctcgatctcctgacctcgtgatccgccggcctcggcctcccaaagtgctgggattacgggcgtgagccaccgcgcccagcctaaaaagattttttgtagatcccagctatgttgctcaggctggcctggaacacctggcctcaagtgatcctcccaccttggcctcccaaaacacagcagttacaggtgtagccacagtgcctggcctttctcttttatcttgtttgtttcttacacacacacacacacacatgcgtgcacacacatatgcacacacacaaatgcacacacatgctcacacacacgcacatgaatacacgcacacttccacccttgaatagaagcacacacacacgtgcacacacacgtgtgcacacgcaaatgcacacacattctcacacacacgcacatgaatacacacacacttccacccttgaatagaagctctgtgaaggcacggattttatattctatatgctatacaattctatattcctagagcatagaacggtatatggcacatactgatgtgaacccaaaagtctctgagacacagatctcaatcagtttagaaagtttattttgctgagcttaagaatgcacccatgacagcctcaggaggtcctgatgacttatgcccaaggtggttgtggcacagcttgcttttatacatttttgggagacataaggcatcaatcaatacatgtaagagttacgtcgcttcgatctggaagggtgggacaacttgaagtggtggagggggaggcttctaggtcctatgtagatttaagacttttttgattggcaattggttgaaagagttactgtccatagaaagaaatgtctgtgttacaataagcggttgtggagaccaaagtttattatgcagatgaagcctccaagtagcagacttcagagagaatagattgtaaatgtttcaacagacctaaggtctgtgttgatgttaatgctgttccgcttttcctgaattccaaagggaggagggcatcatgaggcatgtccaaccccacttcccatcatggcctgaactggtttttcaggttactttggaatgcccttggctgagaagaggggtccattcagatggttggggggcttagaattttatttttggtttacagtgggtactaaatacacatttctacataaatgaacaagattctctttaattatttgctccagttatctactgcataatcgactaccccaaaacttaatggcataatacaacaatgatttataatttctcatgattctgtgaaggaaaaataaatactcggaccccaattcactctgccaaaagaaaaacattaagctgaaagctgagtcatgaatgaaactgtctttccttttgttctgaagcagacagctacagatcaaaggttaaacacctcctcaggttgctactctgcattcaccttatctacataaagtgcagtggctcacacctgtaatcctaacaccttgggaggccaaggtgggcagatgccttgagctcaggagttcgagaccagcccgggcaacatggcaaaaaccccgtctctcctaaaaatacaaaaattagctgggtgtggtggtgggtgcctatgattccagctacttgggaggctgaggcaagagaatcacttgaacctggagggcggaggttgcagtgagctgagttcacaccactgcactctagcctgggtgatggagtgagaccctgcctaaaatatatatacaaaaataaaaaataaagtgctgatttactgggcactagatgaatacataattgatgattcccctacctgctccttttctctcgcagcatgtggatgaccacaccctcccttttcgcctgaagcctgcttttcccctttaaacactgaagccctcaaaatcatctttggagaaaggcagaggccacagatgattgcttctgtgagtctgtgtttattttttccaggcatgtccttaacctacattgattgagacctgtctcagatactttttggtttacaattctgagggtcacgaatatgggcagggctcagcttgttggttcttctgctccaggtggtgttggttggggtccactcacttgctacattaagctggcagctgggttgcagtagaatgcccaaaatggcttcactcaccagtgcttttgttttttattttaattttatttatttatttatttatttatttatttatttattttttgagatggagtcttgctctgtcacccaggctggagtgcagtagcatgatctcagctcactgcaacctctgcctcaccagttcaagcaattctcctgcctcagcctcctgagtagctggaagtacaggtacccaccaccatacctggctgatttttttttattttatttagtagagatggggtttcaccatgttggccaggctggtcttgaactcctaacctcaagtgatttgcctgccttagcctcccaaagtgctgggattacaggcatgagccaccatgcccagcctgtttttctttttgagatggagtctcactctgtcacccaggctggagtgcagtagtgcggtctcagctcactgcaacctctgcctcctgcgttcaaacaattctcctccctcagtctcctgagtagctgggactacaggctcgtttttttgtatttttagtagagatggggatttaccgtgttagccaggacggtctcaagctcctgacctcatgatccacccgcctcagcctcccaaagtgctgggattataggtgtgagcctctgtgcctggccctgttttttgtttttaatagagacagggcctcactctgttgcccagggtggaatgcagtgtcacaatcacagctcactgcagccttgacctcttgggctcaagcgatcctcccacttcagtctcccaagtacctgggcccacaggtctgcaccaccacgccttgctaattttttattttttatagagacagggtcttgctatgttgctcaggctggtcttgaactcctggacttaagcgatcctcccacctctgcctcccaaagtgctggtattacaggtgtaagccaccatgttggcctcccttgctcagtgtttattaactttctcagatttcctgtaggaagcagtaaagagtatttttaaatcttttcttcattttatgaagcaaatttgtcatcatcttttataaggcaacatcattccttagtcttcaaggatcgggtggaaggatcagcgcgggcgtcaaannnnnaangccca

SEQ ID NO: 926 - DNA, 27172 bp, Homo sapiens
  misc_feature (1)...(27172): n = A,T,C or G
tggagcactgactgctcgcttgctccttgcagccccgtggtgaagaccaccaccatatccggctaatttttaaaacattttttttttgtatttttagtagagacagggtttcaccatgttagccatgatgggctccatctcccaacctcgtgatccgcctgtcttggcctcccaaagtgctgggattacaggcgtgagacactgtgcctggcctgctgtctgatttttaatttacctttgagccaacttttaaaatcagtctccctaataaatgaggggggttgaggggtgaaaaggaggaagacatcccagcagcaggctaggtgccagaaggaagctgtcctggggttaaatgctggccaaggctattactgaaatgggtaactcacattcagatgatggaatctggctgcatttagtgagctcttgcatgtgtatatttttatgccatatactgcacttccttaaactcaaggtatttgatgcacttcacgtagtggttctcagcagggaggctgcagctagactgctgtcatttaaatacagtgtctgccactcactagctgtgtggcctagcactgggcttggggtgaggggagtgaggtgccaggggcagtgcacgtgcaggcagacccctgagcagggtgccttcttaaattcccggccccaggcgcttcacttgcctcgtcacagtcccagccctggagtgacccggagccttgtttagctctatacctcagtctcttcatctgtgaaaggggggtgactgtgacacccaccccatagtgttccaatgttggggatagctgaattaaaaggctggaggtatttaggatggctcctggcacacggcaggcgctgggcgagcatcagctgtcactcaacacacacagaggctgctttctcaagggcaggaagcaggggaccttgaagcttttccttctggtggttctggagtttccatgcatgtgctacttggaagccactgactttcaacatcaagctcctgctgcacccattttctggggctggcctggtgcttgggagcctcattcttgccttgccagggtctgcctgctggactggccactggtaggctagaggaggctgcaaggatgagtggaagggaggacctgttgccctgcttccctctggttcctgctttacttcctgttcctgcctcatttcctgctcctgctttcctttctgttcctgcctcacttcctgcttctgctttacttcctattcctgcctctttctggctcctgctttacttccttttccccctttagtttctgctcctgctttacttcctgttcctgttgtgcttgctgctctgctttcctttcctgctttacttcctgctcctttgcttcctgctcctgcctcacttcctgttcattcacttcctgcttctggtttacttcctgttcctgcctcacttcctgctcatttggttcctgcttctgctgcttgttcctgcctcacttcctgctcctgctttacttcctgctcctttgcttcctgttcctgcttcacttctgattcctactttgcttcctgcttctgcttggcttccagtctcgcccttcagctcccactcctcatcctgctcctgccactgctgccccacagcatgacttcctgttggtggcaggtgggcttgaccttaggactttagcacccagaatggggaaataggcaggagaaaggggtctcctagaaaggcggaaggcggggactctgtggctgtgggaatgtggggatgccaggagcctcctaccctgctggtgggagtgaaaaatggtgcagccactttggaaaactatttggcagcttcttaaagagttcaacagagtcttaccatgtgacccagcagttctcctcctaagtattaaactaggagaatgaaaaacctaccttcacacaaaggctttctacagatgttcctcatagcattattcctaattactatagaaacttcaaacggcctggatggccatccgcaggtgcccacctgagcaagtgtggcccatgcgccctgggactcactgccccgctgtcagagagtatgcgctgcagcttcacgccacagcaggcatggcctccgaaatagtgcctgacatggaagaagccagatgacactgcaagacttcatggataggaaatttctgggagaggcaaaacggtagagacaaaaagtagatccgtggttccctgaggatgcgggtggggattgactgccaggggtacagtgaagctttctggactgatgtggctgccttagaactggattttggtgatggttgcttaattatacgtttactaaaagccatccaatgccatctttaccatgggtcaactgtatattcattataatcctataaagctgcttttaataaaatcattgtccaaatatttaaggtggtggatatcccagttacactgatttgatctttataaatgatatgaataaaatgatcacatgaaccccccacatatgtacacctgctatgtatcagttaaaaaaaaaaaacagtgcctggccaacatggtgaaaccccgtctctactaaaaatacaaaaaattagccgggtgtggtggcacacgcctgtaatcccagctatttgggaggctgaggcaggagaattgcttgaacccaggagctgtaggttgcagtgagccgagaatgcaccactgcactccagcctaggggtcagagcaagactacctctcaaagaaaaaaacaaaaaaacaaataaaaagcagtgattgtccccttctccgtgcaggacttgggaccgggacctgccctctcacgggcgtttggggtgttctgtgttcgctcctgcaggcctgcggagcatggggtgagcagcagagagcgctctgccacagctcccaggagaagctcgcgcccagctgtggatgcggctgctttgtctctgtggcaactgttttcttaaaaaccttgggtcaatagaatctgtgtcaatcaaatcccattttctccttgacctacgtgaccccttaagagctgtgtacggtgctgctgaagagcggcctcggggacttaaggcctggaaatccagcgtgtaggagtgatccgcacacaatggcacctgtagggcgttgctctggggcatccctgcagagagtgcttttgtgagatggagaccattcaggccccgtggaggatcccagacagcagggggctctggtggtccacgggtgggatgagcccgccggcctgtgctttcctgcacaagggcctcctgaggggaggactccagggagtttcccacaatgcccagcagctctgagtaatcctcctgggatgggagagagggagcacacggaagagaattcctaggtgaccgtggcagggacaaacggctcagcaggtggcttgtccggaagtgctgtgggagtctgagctctggtggaatcccaagattaaaaaacaataataagaagaaaacaggctgggcacggtggctcaggcctgtaatctcatcactttgggaggccgaggcggacagatcacctgaggtcagaagttcaagaccagcctggctaacgtggggaaaccccgtctctactaaaaatacaaaaattagctgggtgtgatggcacacacctgtaatcccagctactcaggaggctgaggtaggagaatcgcttgaacccgggagatggaggttgcagtgagccgagatcgcgtcactgcactccagcctgggagacagagcgagtctccgtctcaaaataaaataaataaataaataaataaataaataaataaaagcaaacccactgtgctaaaggaatgtaacaatgccctgacagtcatctcgctaagcctctcttgataagatgaggctggccaggtagtgaaagggtttagacctggttggaaagcgactgtgtctacatgaaatgggggttattttatcctcaggctgctgcggcatccacatgcctgctctgaggtggcgggacacggttcgtgaccagctgaactgagggtggggtgggaggactgaaggtttggaagctgtgaggataatgatggcactggctttgatcttgttaactgtgagatgctgctcagacacattggggtgaggtctgtggccagctttcactatgggtgtggacagagaaggggtttgagttggagacagacgggaaagttatcagggggaagtgacggccgaccacctgagagtggtttcacttcctggaggatacacatttacatatattaaaaaaagagctgagtgccagaccctgtaaaaacaatctgaaaatcagtcaaagaagacagatctagctaaaaagacggagaaatccacgtggccagagtaaataaatgaaacaatgcaatgaaagcagctcttctcatcaacaatttttatggcaattttgaaacatctaagaagggggaaagaattgttctgtaacacggacgaaccaccatctggattctgcggttagcatttggcagcatccatcatctcaccgtcactctctccatcatggaatccgtcgtagtagtctttaaccaaaagcagcttttaaaattctgaaattgaattatagactcaattctaactttcaattacacaattgaaagttacgtcggcatcctaaagtcccttccactccatagggtaatatttagatcaaatcttcctaatggtaaatgtcctagaagccagtgcagctcacaaataaagaatctcatttcaagagagcaactgtgaactcagggtaatgaaatctgtccaaatacacaggtgattgaaaaagcgtgccaacctttcattgtatgaatggagaataccttgggcctcttcaagctgggaccatgcagggcaaacctgcctcccattctattcaaagtcacccctctgctcagagatagatgtatattctgattgcctcttttggaaagacttatcagaaactcaaaagaatgcaaccatctgtctctcacctacctgtcacctggaagcccccagtgtaggggacttgctttgagttgtccccacctttctctacagaaccaatgtacttcttacatgtattgattggcatctcatgtgtccctaaaatgtataaagccaagctgtgccccgaccaccttgggcatgtgtcatcaggacctcctgaggctggggcatgggtgggtcctcaaccttggcaaaataaactttctaaattaactgagatctgtctcaaattttcagggttcacagttagttaaacatgggacgatcgaggtagccaatactcatgtgtgcaaggcactgttctcagcgccgttcacggattcccttatttcaggttcatacaaacctacgcaaaccaaaaataaaattctaaggcccccagccttctgaatgggcccttcctctcgcctaagggcattccaaattgaacctgaaaaactagttcagggcatgatggaaagcgcaggtcagtcatgcctcattttcctatcctacctttttttttctgagatggagtcttgctctgtcacccaggctggtgcaatctagactcactgcaacctctgcctcctgggttcaagtgattcatgtggcctcagcctcccaggtagctgggattacaggtgtgcaccaccatgcccagctaaattttgtatttttagtagagatggggtttcaccatgttggctaggctggtgttgaactcctgacctcaagtgatcctcctgcctcagcctcctaaagtgctgggattacaggcgtgagccactgcgcctggccttcctctccttccttttggaactcaggaaaagctgattagcatttaacatcaacgcagaccctaagtctgaaaagaaacatttacagtctattttctctgaagtctgctacctggaggcctcatcggcatcatgaaaccttgctctccacaaccccttattgtaacccagacatttatttctattgatagtaatgctttcaacctgtgaacctagaacatttgacggaggtctcagttactatttagaaagtttattttgccaaggttgaagacacacacccatgacccagcctcaggaagtcctgatgacatgtgcccaaggtggtcgggcacaggttggttttacacattttagggagacatgagacgtcaatcaatatatgtaggaagtacactggttcggtctggaaaggtgggacaactggaagcaaaggcaggaagactcgaagctgggaggggacttccaggtcactggtaggtgagacacaaatggttgtattcttttgagtttctgatgagctttgccagtggaggcagatcagatatgtgtctatctcagtgagcagagggatgactttgaatagaatgggaggcagatttgccctcagcagttcttagcttgagttttctttagtgattttgggggcccaagatattttcctttcacaaaccaactgctaatcagaaaattttaaatttacatttgacctggaagccccacccctgctttgagttgtcccacccttgcagatggaaccaatgtaaatcttacatgtatttggtggaggtctcgtgtctcccttaatatgcataaaagtaggctgtgcccccaccacctggggcacaggttctcagcaccccctgagggctgtgtcacgggtcatggtcattcatatttggctcagaataagcttcgaatattttacagagtccgactcttcgtcgatacctgtggggcatcagcgctctcatcattccgttttatggatgaagaaactgaggcccagagagtttaggtgacctgcccagggtcccacagctggtcaggggccatgctgggatttcaccagagcccagatctctggcacctgtcagcacaccatgctgcctcccagacaaagcaaagaggtgccatcttaaaccctccaagttagccgcgatctgtaaaaaaggatgatgcttcctgttggcagggatgcagcgagagaggcctgcccacaggaatgtaaatcggtgcatcccggaaggctgtttggcaacatgacccaagagccatgaaatgcgtgtgtcgactgatccaggcattttgttcccaggaataaatggccatgaaacaatgcaagaggtggagccaatgtcctatccaggggtattcgccggagaatttgacgagtgaggcaccaagcagcagaagatgcttattgtatacattatgaaatgctcctgtaatagtaatgttcacaggtcacgatttaaagaaaaatttatatgatgagaaagtgtttactctgtagaacacatcaggttacaaaacagaatttaggaaaacaaaataaaatcacaaccgtcttcatctactgttatatgtgtatacaaatacacgtaattataatgtatgtatagtccataaaataataacataaaatacattggaaaggtaggtcccaaaaataccagcaacggttatttcaaagaagggctttttggggtggacttgacattttgctttgggcttttttgtgtcttctgcaaggggcatgcattactgtattaccttaggcatctgaatgctatccttccattctcatagtggtagttacagaagaggctgcagtcagctcaaacgcttcccttttttattgcgggtgcagaggcttcgagggagagggaaagctgtcagtaggtggcgccagagggtggcagttgtctcaggctgcgtcagggctggtgcgagccagcctggccttaaagtgaagcccctggttctctgccatcccatgtgcaactggtgattttgcaatttctgcatgtgtgtggggcctggctcccctgtggctggaggcctgcatggagcagggggcatgccaagctagacagtgacaaattactaccatcgagggcacctaagcacaccttgggctctataaagcacagccagagccaagtgctgcccttaaaaatcagataatctcaggcggttgtgaagcaaagtgaaaacaggaaaatgcaaggggcggagaagctgtcggtggagagagaaacagtggagagttctgccaagaagcttatgcagctttttcctctgaggggacagagaggctgggagagtggagagctgaccctgttggtctaaaccctttcctatggagggagcaggagtgaaaatagcaaccctgaggacacggatactttaggtcagtgtagcagttgagagactttgacctggacatagaagccagagatgtatgggttcaggctctcagaaaaaatggagtcagtttctccctccattaatgagaatagataaacccagctcagctaaattcttttttttttttctgttgccaggctggagtgcagtggcacgatctcagctcactgcaacctctgcctcccaggttcaagcaattcccctgcctcagcctcccgagtagctgggagtacaggcgcccgccaccacaccccactaatttttgtattttagtagagacagtgtttcaccctgttggccaggatggtctccatctcctgacttcatgatctgcctgcctcggcctcccaaagtgctgggactacaggtgtgagccactgtgcccggccagctcagctaaattccaaaagtgtttattgactaccttggaaatgatcataatgatgataatagtaattacaattgccaccaacatttatgaaacccttactgtgttaagtacttaacatgggttattgcatttaagccccaccatggtccagcaggtggatatgactgccatcatccccgaattacacatgagggcactgaagcttaaagaggtgaaacaacttttccaaggtcacccgtggctaggtcttattgcacacttaataggagccaaggagagtgagtcacgatagggcaggttatgctgctgtaacaaacacattgaaaacctcagtggttgaaaaatatgtttatttctcaatcatgttatatgtccattatatgtcatcaagagggctctgcttgttgtagttcctaggggtctgggtggaaggaagctccatctgaaagcatttttccatgtgggtagagacaaggaaaagatcatggtaaaccacacatggactcctagagcgcctcacctgaagtgacatgcacaccaatgactgctcacagtgtgttggccggagcaggtgccatggctctgcttcagtcagtagagggggatgggcacgaatatgttcctcttgcaagaaagggaaccaagtatctggtttccttattctccatagcaggggtccccactctagccacagagtggtgccattaggaaccgcaccacacggcaggaggtgagtggtggacgagcgtgaccacctgagctccgccccctgtcaggccagcagcagcattagattctcatagcagctcaaaccctgttgtgaactgtgcgtgtgaggggtctaggttgcctgctccttaggagaatccaatgcctgatgatctgaggtggaacccctccccacctcggtctgtgggaaaaaccgtcttccatgaaaccggtctcaggtgccaaaagtttggggacggctgctctctggctcctattaacgtgcattggtttggaaaaagtgcattattttatttgattttacaacacgctgtgtcaggcgttattattatttttgttttatgcaagagaaaacagagtttctgtagcacacccggctcacatggctactaagtggagcaggtatgattcaaccttagctctgttccagcctcaaagcccagttcttcaaaaacagttatatcccatggcggggagggggtctcagtagatatgttccaggaagagtacgcttcttggtttataaaataagatatgatattaaatatttggtatttaaatattgcatttaaatattcgtatatatttaaatacaatttaaacattacatttaaatattcatgtatatttaaatacaatttaaaaattgcatttaaatctttgtgtatatattgttccattatttaaatattgtatttaaatattggacatggtatatgtatgttatatgtacatacatgtgtatatacacatatccacatatatacacatatatgtatatgtaacatgtgtatatatacatatacatatatataacatatacaatattgaatattatatatatatgatatacatatatcacttctaaggaatgtgtttaaagagaaaatgtaaattttgggtccctaagttcaacacaatattttaaacaaaatgataagtggacaaaatctcaactcacactcaacatgcaatgggtagagccttgaaatcttgtgtagatattttgaaaaggtcacccagtgtcagcaaaagaaccgggcatctcaccaggcatctcagacgttatggcactaagggagaaatcctggagctaccgcattcaaaacgacggtttgtaacaatctcatgaattgcttgatggccagggagtgatgttctgagatttctacctactaacacaacaacgcgttgtgtatatttagggcatgtactggttttcagttatgttttaggaaattgggtggcacgtttgggtttatgtgtagcatggaatagcttagtaatagaaagaaactaggattctggagaggactttcacaaagaaattccgatattttgggaagagattgttgaggtactaaatgagagatgaatagtggaatcaagtatgtggtacagttgaaaaatactacaaattcttgagtccctgacatcaagacatagaatgggaaataagacctacgcacctgtctgtgtgtgcacaggtatgcatgtgtgtgcacatatgcttatgttcagatggaggctgtccgtctgaacttaaaaaataaggactaatcaaaatatcctccagggactctaagaaataaccgagacaggggttggggtggcctaagagactctgttatgtacgctgtggtaataaacctgtgaacagcacattgctatgttaattcacacttgtagacatgttggcaacacatacggatatttagtctttggaagactctggggaaatctcctgtgtgaagcataaaacccctagcattaccataaaatgatgtttcttctttccaattatactgggctttttggaatcgtcgtctcttaacttaaaggattatctttcagcggtagaatattcgatctttgagcaataggttgttgcatgagatgtatttacaccaagatttcatcctggccctttcactggtaccattctttctttagctgcttctgccccaagagtcttatcgtcctctcattccagtgttgtgtattttagttgctgttgtttctggatcatgcattaagcagtaagcatgatattgacagttttctgtgtcctttcctgaggtgggctggagaggatctgttcctggaactagatttcctttctggatctgttgacaaatgaatctcacacacaacttctctgctggcatcagcatttgctattccccatggagtccagggttcatagcttttctgggcatgaaccctatgatctatcagccaactggacaaacagaccaggcagaagagctgctcgcaaagccagaaacgtgtgcatgagctgctgggtggctcagggaaggtgggctggagcagcttggcgcttagttaccagtctcgtggagaccctcgctggtgttttaaacatccttcctgctgggctcacctcttaaacacatcagcagtatctcagtagcgaagtagatgtggaggacgctgactctgggaaggagaggaggagtggtcagcctcatgcagagccttcccccagtgggaatgtcacctgaattagggcctaagagctgctcatattttaactgaaaactaccttgtggggagaaggacaggaagaaaccctaagaaaatatagtgcggtctattttactacaactatatctggagcttaaaatgaaaaggaagaaaattgttacattcgtttaaaatgggtttgagcaaagcaatagaatacatggctaacagtggcttaacacatagggctttgtttttctcacaagaggaggggtttgaatatggtcaactgagagcaaggattcaatgcatcgaggatgcctggctgtcgttcttatgattctctgggcctttgcctcgtggttgaaggatggctgccacagctccagccatcacatctgaattcagaatgggaagcaggagaatgaggaatgagggataacactaatttcatttgtttcctcttataaggaaagccagcactttcccagaactctctcctctctatgcccgtcagatttttgcttagacctcattggccagaagagtgtaacacagctacctgttgctccagcagaatcagggttcactgccaccctgaattaatcagtatatttctgtttatataggaaaaggggtgaatggatatcagaaagcattagcagtatctgtcccattaggggtactgagttttgcctaatgactttctcctcttctgtttaggagaactgttcaccctgtacctcaccagggagagggcgatgccctctgcaagggttctctccaccaaatccaaaggtcatcagtgccacagagaatcccagcccctccagcaggtgcccagggatgccagtctggacagacacccagaaatcagtctactgaaggtgaacagtgagggcctggggtggggtcggtgttcaggtagctcagagtaaatgccctttgcattactggcctgtagataaatgagcctggagagcatggcccccaggaatgacacaaagaaaagagctttctctgtctttgggatgatttagagatttttctactgccttaaaaaacttttattattttgatataatttaatgcagaaaagcagcaagaatagtgtaaataactccttcaaacctttatccagaattattaaactgtttatattttgccccaattttttatcattggtttcttggtatctatctatctatctatctatctatctatctatctatctatctatatctattaatcatctatcaatctattgatcatctattatctatcatctggctattatctatcatctgtctacctatcacctatctattaccttattacctatcaattatctatctatccgtcttctatctgtcatccctctatcgtctgctatccatacagagagaagagagggaaatagaggaaagagattttcccccagaattatctatttgaaagtaaattcagatatcttatcctttatccttaatatttcagtgtgtttttttctaaaaacaaggagattctcttataccaccacaatacaaagttcaaaatctgaaaatctaatactgatacaatactatgacctaatctgcagtccctattctcatttgatcaactgccccaataacttcctaatggccactntgtttcccagtccagaggccgacccaggatctcacactgcatgtgttggccacgtgttccagtctccttccatctggagcagtccccgtctctttgacccgattgaagagtatagcaagttactctgcaggccgtccctgggtttgggtttgcttggtgtttcgtcatgatttggtttagttgtgcgtccttggcaggcccatgatatgtagataagttactgtggaagtgacgtcctggcctcagtatccctatcaggacgcgcaggactttggtcggtcccgctgctggtgatgttgactttggtcgcctggttcaggtagtgtctgttatagatttcccactctgaggctactggtttcccctttgtaattaataaatagttcatggggagatgctttgaagctgtgtaaatatctggtatttcacccatatattagaggtgcagcccccatagcttttttaccagtagggatatctaaaatttagaaatctttgatcattcctgccagtagaggtatgctaaatatatgtatatgatcaaaatgtttggaaaaaactttgaccaaaaacaaacaaaacatttgaccagggaacagcaaacgttttctgtaaagaatgagacagtaaatattttaggctcagctggccttatagtctctgtcactactagttaaccttgccataagagtgcagaagctgccatggagaatatgtaagcaattagctgtgacagcgttccattaaaacttcatttataaaaacaagcggtgggccagaattggttcatgggccatagtctactgatctgcaccttatgccacagtcaacttgtttggccctgaaaactcagaattcctccttaggggtgatatttctactctctagcctctgacctagaagctttagggtcttaattgctggcacataaatttgcaatgaaggaatcaaattgtgcagcagcctgttgtatgatctcaagggcgctgacatcaactgggcttagaacggccaagtcccctttgcctgtgtcaagaggttttcctctagaaacttgtattagtcttttctcatgctgctaataaacacatactcgagactgggcaatttacaaaggaaagaggtttaatggactcatagttccacctggctggggaggcctcacaatcattgcagaaggccaggagaagcaaaggcatgtcttacatggcggcaggcaagagagaaagatcagctctcgtgagactcgttcactcccacaagaacagtatggggaaaaccgcccacatgattccgtcatctccaactgggtccctcccacaacatgtgggaattgtgggagctacagttcaagatgagatttgggtggggaacagccaaactatatcaaaattattataaagaaggacctcaaccaagagctgacacacatgggttttgtttgtcttgtacagttttaaattaatctgagttatttttggtgggcatgggctcctccagttcccacgagccccactccctgcttctgcctcccgcctccccgcatttatgggttccgcttgaccgtgagatgatgtttcttttccacctctttgtgaggtcttgacaattagggaatcattttctagaattcctatctcttgcagccataggatgctaaatcccaaaaggaaaattcaccaaatcaggatgtttatatttagtgcctcaattagccacactccaagaagagaattttcatcattgtaaggcacactccagggaacccagcgcttcagaaggatgtggctctttgcttagtttgtttagctctgtctggttgtgcagattgggcaacataacctggatcggccaggacacttctggatcaaagtgttgcacccacagccggttcttggtggcacaagagcccaggcttctagtcccagggtgtttcgggtgggcgccagcaagtcagcagccgaggggaatgagtgttctaggcttgggggttggttggagacaatctgttagtttattttctcagagagggaggtttgtgggcaattcccacagtgggactagattgagatagtcaaccttctgtgtgatagctgccacacaggcttgaccagcagtggggttcttgctcctggatttccagccaatggggcaggggtgtcagccagtgaaacacacaacgtgaagatgtccggcactggcggaaacatgcagcgtgagcacatgtaggaacgtatctggggagacgtatatatgtggactctgtaggaatctgtctatcggggaaggatgtgggggtgctggagacccacatctcaagccatctctgtgtattctgtttttttttcctttgcaaagaggattgatacgtattttaaaaagttgaagtggatgtttcatgctcatgttttgcagccctgattttggggttttggaaatagtccagcaaaagtttgcctgattccattaaaaaatccaaatacagactttctcatcgcaagagaaccttctctttaccagagcactgggagcacccagaccgtggaggggaccctcttagggggaaaggtcaaactggagtcactgagctgaagccgctcggtgtcaggtggaaccaagtgtccccaaagggccctctcctgggcttcctcccgtgggggcccctctgcggggatggggtcactggccgtctctcacgccctgctttccctctcatgctgtatctgtggtctatccttatgcctggcaggtgtcaccaactttaagttgtgcgacttggggctcacacactcacacccttccagggtgggagggacgaacaagcgggtgaagccagacagaggatgctggggtgggcaggggagcggagggcccaaggacagtgggcaccccctgcccagaggctgccaactgctggcctgagggcagagggccagtgtccctagatctggtttttcaagagaagtcagaaatctggaattgcgtgtgcaacccccagatttttaaatcttgccatcaaattcagtttaaaaattgggtggaccaaaatgtatacaggctcagttccacctcaggctgcaggctgacttgtggaatcagttcaagggcactgtaaggtcatagttatcctggaggacgtgttagtctctgggtttgctgaataatccagctgtgccagttaggcctgggcgcagctgcttctacaggcaaaaataatagtggcttagacatagacgtttactcctttctcatgtaacagaaatctagggctgaggtgggcagatcatctgagctgaggagttcaagaccagcctggtccacatggtgaaaccctgtctctacaaaaaatacaaacattagctgggcgcagtgatacacacttgtaatcccagctacttgggaggctgaggcaggagaatcgcttgagcccaggaggtggaggctgcagtgaacaaagatcatgtcattgcactctagctggggcaaccagagtgaaaccttgtctaaaaaaaaaaaaaaaaaaaaaaaaaattccagaagctagtttggcagctccaagagggactgagcttttatctttttgctttatcatcctcatgtgaagactccattcttaaggtgacctcataggccagtatggtggctgaagctccagccatcacatccacattccaggtggtagaccagaagaaggggaaatgggacaagaatgcccctcccagaggggcctacctttaagcagcctttcctgcagtttgacacacaatctcctcttatactcattggctggacttagatgtgcaggaacttaattaaggaacttaatttttattctggacagcaatgtggccagataaaaatctgggttctattactggagacaattataagggtaaatattgtgtggataaagaaaatgtggcacacatacaccatggaatactatgcagccataaaaaaggatgagttcatgtcctttgcagggacatggatgaagctggaaaccatcattctcagcaaactaacacaagaacagacaaccaaacaccgcatgttcttactcataagtgggagttgaacaatgtgaacacatggacacgggaacatcacacaccgagacctgtcgagggtggaggggctgggggagggatagcattaggagaaatacctaatgtagatgacgggttgatgggtgcagcaaactgccatggcacatgtatacctgtgtaacaaacctgcacaacaaacctgcgcattctgcacatgtattccagaacttaaagtataataaatttttttaaaggtaaatattatgtagcatctaacttttatttttaaaaaaggaattcttcacttaggtgatctcatgggggaggtcagagggaggcactggaccagtttgaggggacagcgcatgactccctcctgcctcgggtctgaactttcctgcagtgaccacccttcctcccgggtcataaggaattctaaaaacaacaagcagaccgacaaaaatgacgatggtgatggcgcgggacttacctgcagcctctgtctgccgtctcctgcttctccctaggtctcagtgcagatgcctcctgcccagggcgactttctgcatccctggagtggctcgggacccctgttctgtgttcccacagctctcagcacttttccttcatgcacgttgctgcagtttgcaatgacagcttctgcgactagagtgctgatgccagtccctccccaagggcaggcctgagcccactgctttcaccgttgtgtgtcccagtgcaggagcctgcacgtaggggccacgcgacaaagaattgctgaatgaatgagttaccacaggacccgatataaaaataaagggaactataagaccagatgataagcaaaataaaaaaaataaaactggagaactaagagagctaaaatcatgtaagtagaaaaatttaatagctcaagagctagatctcaaggcatcttctttttaagataaggaaagctaaaggtgggaatcagtagcggaagaacaaaaggaggaaataaaatagttaaaacaggggcagtagagagacggctggctccagctctgacgtgtaggaagcccagaagccatcatttacttccagcaagaaacagctgaacaggctcagaacccgaggatgtcctcggccccctcagagaacaggttgtggatgagccaccaccccgaaatctggaaggatgggtgaatgcaggcctggggcagaagtcgtggaaacctcgaatgagtgggggaggatgggaacaccccggtggtgactttgctgagctgctggaggttgagtgtggaagcttgagagtgagaaaccctggggcctccctcctaggggtccctcacactcctgcggttcaaacctccaggaagcccacacgttctcacaagtgaaggtccaagaaagatccccgttggctctggaaaggggagcagaagagtcacccttgtggaatctgcccagagtgttctccccaacacaggcttgctccgaggcctgccgaggctggggaggcacttcttccaccccggccctctttagcctccctgtctcacccaaggggaacagaaaagctacgtcactggaggaacacttgtgaaggtcatagcccctaaaaacggagactccatcgtgggatgactggatgctttccttcccccacacctcaccgccacacatacacggctccggtgccgtaaccctgggttccagccgaaagggctgcaagatgtggaccctccctgaggaggaggacttagggaagccccaggtcaacaggtgagacaccagcagggacgttagaggagccggaagcctccggcaccggcagctgcagcaaccagtcagcacaacccaggcccagccatgtacgtcctcaggctgcagccctgctcacctcagtcctgttacctggcacagcatgtctggtctcaacagaaaattgcaaagcctgtaaaaagggaagagaaaaatacagacaaagtaaccatcagagccagacttaaagatgacacagatgttggaattaccgtacaaggatttaaaagaactacgattgatgtgttaaaggctgtaatggaagaagtggacaacatgtaagaacagatgggtaaatgtggctgcaggtacagagtttcacgtgtgcaggatgaatacgttctggagattgaatgagcggcatgatgattatgtttaataatactgtattgcagacttaaaacctgctaagagagcagatctgaaatgttctcatcacacacaaataccaaaaggtaactgtgttgctggctgtgttagcttgatagtggtaatcatttcacagtgtgtaggtggagcaaaacatcacattgtataccttaaatagatatgatttttatttgtcaattatacgtcaataaacttgggggaaaaaagaacagatgggtaggtagagaaatgaaaatgctaaaaaggaatcacagaaaatgctagaaatgaaaatcactgaaacaaaaatggtgaaatcctttcccggactcatcggtagatcgggcgtggcccaggcgagtcagtgaacttcaaagcaggtcggcagaaacttcccaacctgacatgagaaaaacacaatgggaaaacaaacagcaaaacaagtcaagtcgaaacaacattcaacaactgcgggacaatatcaaacgtgtcatatacgtatagctggaatattagaaggaaaagagattagagcagaataaatatttcaagtaataagggctgataaatttctgaaattaatgtcagaaccgaaccaaagatcctggaagctcagagaacaccaagcgggaaatataccaacagacatggctggacatggtacagtcacaccgcggaaaaccaatggagagacagccttgggagaagccgggggaaatcacctgacttgtgcaggaacagggataagaattccaggggaattttcaccagaaaccacatacgcaagaagagagaggagtgaaacatttaaagtgtcagggacacacacacacacacacaccccaacctagaattctatatccaccaaaattatccttcaaaaatgaaggagaaacaaagactttctcggacaaaaacaaaaacagagggaaccagggaaatgaaaattaaaaccacagtgagatatcacctgatggccattattaaaaagccaaaaaacaatagatgttggcttagatgcgttgaaaaaggaggatgtgtacactgctggtggacatgtgccttagttccacctctggaaaacagcatgcagattccttaaagaactaaaaggcggtcccatcactggatccagcaatcccactactgagtgcacaaaggaagtcattgtaagaaaaacacacacacacacagcggtgtgtttattgcagcccagttcacaattgcaaagatatggagccaacccaagtgcccgtcagctgatgagtggatggagagaatgtggtatgtctacaccacggaatacttcgcaaactcagctgtagaaaagaatgacagaatttctttcacagcagcttggatggagcgggaggccattcttctaagtgaaataactcaggaatggaaaacaaggaccacgtgttctcacatatcagtgggtgctaagctctgggtatgcaaaggtcgacagggtgatagagtggacactggcgactcaggaaggggaggctttgcagggagggaggaaaaactactcattgggtacaatgtacactacttggatgacaggtgtgctacaatctccgacttcaccgatatacaattcatccatgtaaccccaaaccacttgtaccttgaaagctatagaaataaaaaaaaatgtataaaaacagagagaagtcaccaccaccagacctgccctgcaagaaacattaaaagaagttcttgcgggaaaagaaaaacagtatgtcagaaactcagatctatagaaacaagagtgttggggagggaatacgaggtggtaaggtctttgatttttcttactcttaattgatctaaaatagaatgtcttgcttggcatcataatagtaataatgcattggatgattctagattctggttaattgaagtaaacggccatgtcacaaggaacgggagacgtaaaccaggacgccccaccacaaagagtctgcactcactcgggctggagccgtgttattccaaggtggactatagttcaggtgaatgtccgtggagagctccagcacaggcactggaaagatttcgaaaatgtatataagtgaaggtcaaagagagaaatcatatcaaacactcacccaaaaccaataagggcagaaaaaaggatattaagaaaaaagtatgaacgacactatgtccacaaatgtaataattttttttttttttttgagacggagtcttcctctgtcgccaggctggagtgcagtggcacgatctcagctcactgcaacctccacctcccaggttcaagcgattctcctgcctcagcctcctgggactacaggtgcgcgccaccacgcctggctaatttttatatttttagtagagacggggtttcaccatgttggccaggatggtctcgatttcttgacctcttgatccacctgcctcagcctcccaaagcgctgggattacaggcgtgagccactgcgcctggccaaatatgagaatttaaatgaaatggatcaattctttgatagacccaatctgctaaaactcactcaagagaaacaggtgatctagatagtcccatatctattaaagaaacacagtgaacacttaataagcgtgcaaaacaagcacggcccaggtgctgcagccaacatcatagttagtggcgagaaactggacactttccctctaagattggggacagggcagagatgtcccctcttacctgttcaactttgtatactgcaagtcccaggtagtgcagtaagatgagaaaaggaagtaggagatgtacagattgggacagaaggaatgaaactgtctttatttttattcgtttattttttttgagatgaagtcttgctctgtcgttcaggctggagtgtagtggtgcgatcttggctcactgcaacctccgtctcctgggttcaagtgattctcctgccccagcccctccagtagctgggactacaggtgtgtgccaccacacctggctaatttttgtatttttgtattttttttttttagtagagacagggtttcaccatgttgcccaggctgactcctgacctcaagtgatctgcctgcctcaacttcccaaagtgctggggttacaggtgtgagccaccacacctggcctcaagaaatttttaagcacaaagtacagtattgctgactgcagacctgatgtagtgtgccagatctctagtgcacactcacctagcgtggctgagactttacaccattgatccacagctccccgcgctccctctccagcctacggcagccaccactctcctctctgcttctgtgaggcatttgacagtttcagagacctcatctaagtggcatcatacaagatttgtccttctgagactggcttattccacttggtgcaatgttaaggtccacccgtgttgttgcgtgttgcagaactgacgtcgtttgaaaggctgtgtagtattccacggtgtggatcgtggaccatgtctggtgtatccattcatctgttgatggacgtgtcagttgtttccacaccttggctgttgcaaacagcgctgcgtgaagtccacattctgtctatggaagtcttgcagggtggggaagagcacagtggtgggaagcatgcgcagaaagcaggaggtggtcgttgtgagcaacgcacctaggctgagacgtgcactgggaataggacattgcgtgaggcatctgcaacggcccagcctcttgtaacagccaggtggcccctacctggccgatagctattgatcacgaagccagcggcgtccttagcccagggtactgcgcaaacaaccaaagcttgctcaggaaagactggatagttcgacaaataactcagacattgactacagacgtcactggggggattctgccctgagtccctgtgaagggattggccaatatcctcaccacaggctggacaccaaaccccctggcctggtctgtcttcctcttacgttgttcaagatagactcctgctcattccacgtggcgccgtcttgttccctcacagttttctgagatcagaatcattatttggtaaagatcctggtttaggaacattctagattagctctcgggatggcctcatccatggtgttgtgggggctgctttctccaggaagccctcctgcttcctgctttatctaggccctttgggaggggctctgtgcccccatggctcttgggacagggtcctgtgtgttccttgtattcagttggaagaaacctccatccaccatctttatcactttaaactgcacattgcatactggagacctacacacaagagaaataatgggaagatgccacataaacacacagatctccaatttgtcttaaagactcagaaggttcctttcttaggtggcgacccacctggtggccctgagcaggtcagtgactgtgtgctcttgggtccacccccttcacttcctgctctgctccgtggcccctgaaaatacacccccaggctctcttgctgggtggccgcagggaggatccatgcaggaagctatggatctccagagattggcgagtggggcagagaagggccagggcatttctcctgctgtctctgctcagagcaccacctatgcccgtggatctcttgtggccccagctcccctggacagcaccttcttctgtggctccagcttctggggagcagccccgtcctgggctctccctacctacccagcctatggtgttggcttcctgctgtggtctctggggtgcctctctatcatggctgagttgtgtcttcccagatctatacattgaagccctaattcctagcaccttagcatgtgactgtatttggagacagcgtctttaaagaggtgatttaattaaaataaggtcatgagggctggctctgacccaataggaccagtgttcttacaaagaggagattaggacacagatatgcatggagggatgaggacacagggagaagatgccatctgtaagctgaggagagaggcctctggaggaaccagccctgttaacaccttgatccagaacctccagccttcagagctgcgagataatatgcctctattgtttaagccacgtgtctgctgtattttgttatggcagcctggacaagctcatatactcaccatcctctgtttggcaatggatatcaagttcctccgatgaaactacctagtgttttcttatcacttttattatagtagaagtaagaggaaagtgacatatctttaatcctatgtgtctatcaaaagctggaagatacgagaccccagggcgacacgtgtctcttgctaggtgttgactctcccatgtgacctgcttagtccctggtcagcatctgactttgcaaaccctgatttaagctttcaactgttctgctaaagcagtatcaagaaagacgagtgctttttatttgagtttattgggtttcctgacgagctgggtaaactgatgctggtttcatcgctggggccttctctgtaattggtgggacacatacatttttgaaatttctgtaccaaaggaaaaaaaaagtccaaaatgtctctactgctccttgttcatgaacatgggtctcctctgcttttaggtgaaatattctcagtgttttttttttttttcacgtaatcaaggagatgaaacaattcagagctgtctaaggccgtcagaaatgtctccaaccaatctccttcagggtttatctgtgcttcgctatgttgggcttcaaatcattctttttataatttttggagaaattccaaagtctgtaaacagctcttgttcttaaagggactgaagaaaaacacacacactctaagcagaaggaagataaaataagagaaaccgcgtctctgggacttctgggtttgaacatgatgtctttgtagatgtgagcacaggggctgagcctgatgaagcgccaggcacgtgggttctaagcggctttttgcttctctggggaagtgtattaagagtgatgcgtggaaacagccagtggccagcgtgtgcccctgccccttcccgggttccttctctgcagggcagctgccttcttgttggctgttaccaaacgatttcatccctgagccagtggagaattgtgatgtttgactttgcgctccgctgggatgactgttagagccagcttttaaaaacagcagacaccaggccgcgttgctctgcccagatccctccagtgactcttgtcttgctcacaatgaagcaggagttcttgcacatctaaaagccacaccagctggcttccgggtcccttctctccctcccttcctccctcccttcttccttccttgtaacccatccatgctggcctctgcagttcctcagacatgctgtacatctcctcctggggcctgtgtcctcactattccctccaccaggcacgcgttcctcatgcacaccggctccctcattccccagatcactccctccacggccaccttcccaggccctcccgtgccaccccaggcccatctctccccagtccctggtttcttagcactgattgtaactgccttgctagtgttgattggtatttgtttactgtttgcttttccgtcctgagcacagaggcccggtgagagtaggggccctatcagcgcctctgctgaactctgggcaccgcgggcagtgcatggcacagagtcaatgcttggaaagatgtcctgatggaatgaccccgtcctttaagtagaggggccaggcagatcctcacatcagccctgaggcacgggaagacctgctgtcctgcatccactctgcaagctgaccagcctgggcaggaagaatgcctggaagcagtttcagcgcaggggtggggaggaggggtggggcaaggctatgtacacaaatgtaataattttttttttttttttgagacggagtcttnctctgtcgccaggctggagtgcagtggcacgatctcagctcactgcaacctccaccttccaggttcaagcgattctcctgcctcagcctcctgggactacaggtgcgcgccaccacgcctggctaatttttatatttttagtagagacggggtttcaccatgttggccaggatggtctcgatttcttgacctcttgatccaactgcctcaacctcccaaagcgctgggattacaggcgtgagccactgcgcctggccaaatatgagaatttaaatgaaatggatcaattctttgatagacccaatctggtaaaactcactcaagagaaacaggtgatctaaatagtcccatatctattaaagaaacaccagggacacttaataagcgtgcaaaaaaaagcaccgggccaagttggctttgtcaaagaaccccccccaattattatgggaaatggaatttcctttaaatgggaacaggcaaaaattcccttttaccctgttcaacttttgatactgcagtcccaatttaggccataaaaaataaaa

SEQ ID NO: 927 - DNA, 27407 bp, Homo sapiens
  misc_feature (1)...(27407): n = A,T,C or G
caccccctttgacgcccgcgctgatccttccagccccgtggtgaagacggtgtatttccacacacaatcaatttaaaacacttttatcaacccaaaaagaaacttcacacccaccaccagtcattccccatttcctctcctagcccaagacaactgcattctactttttactcctgtacattttcccattttggatgtttcatataaatggaattatacactatgtgttctgtgactgacttctttcctgtaacacagtttttccaaggtttcaccatggggtgggcagggtgtggtggctcacatgtatactaatcccagcgtgttggttgggaagccaaggtggaaggatcgcttgaggccaggagttcaagaccagcttgacaacatagcaaaaccccatctctgtaaaaaaaaataaaaataaaccaggcatgggtgtgtgcctataatcacagtcacttgggaggctggagcaggaggattgcttgagcctaggaggtcaaagcggcagtgagctgagattgcaccactacactccagtctgggtgacagagtgagaccgtatctttgttaaaaaaataaaaagggctgggtacggtggctcacacctgcaatccgagcactttgggaggctgaggtgggcagatcacttgaggtcaggagttcgagaccagcctggccaaaatggtgaaaccccacctctactaaaaatacaaaaattagccgggcgtggtgacgcacgcgtgtagtccccaccactcaggggtcagaggcatgagaattgcttgaacccgggaggaagaggttgcagtgagctgcgacggtgcccctgcactccaggctgggcgacagagtgagaccctgtctcaaaaaacaaagcgacaaaaaccaaaagcgtcctttgtttttgtggctgagtcgtatgtcagtgtgcagctagaccgcagttagctccttcaggcatcgggggacggacgtttgcgttgtttccactttttggcaattatgaataatgctgcttattagatgacatttgaattatgacatttattcatttacttttgtcttctgtggcacaaactatgaaaaatagtaattaacaattaggtttccaaaacctgtgtacatgtttcttcgaagtcattacacatttaactcaaaaggaaagcattaacttccaaacatggaaagtgttcaggcatctgactctcattacgtggactttattgatcctcatttaatacatgctacattcagctcaacccccttttacatgaggcggagttaaactcttagggaaaccagtgtgccgagacattgtttaccgatttcctttctgcagttgtttctcactaatattaaaatgaaattttattgtttataacatttacaaagtttctcggagtatttttatttcttcttgctcctcaatcttaggttcacttctcattgtcaatatctgcttaagaaaaggttaaaaaaattactgaaaaatgctaacaactatgattgtagttgctaacttatggttgcaaatggctttgtttttaaattgtgctgcattctgagtggggctgtggttgcgggtctttcagctgggagaaccaccacagacgacgagctagaagagatgctggagagcgggaagccatccatcttcacttccgacgtgagtgggggtgcggccctgtggctccatgtcctcttctgtagacagagctttttaaaaaccctttaacttccaaacccatcataagtttattaatattatcttttatttttgtttttccaagattatatcagattcacaaattactagacaagctctcaatgaaatcgagtcacgtcacaaggacatcatgaagctggagaccagcatccgagagttgcatgagatgttcatggacatggctatgtttgtggagactcaggtagttacagactcttgcattctccaagagagatatcagtcatgtgtaaaatcttactgcatcccactctgtctagtggatgtatctaggaaagctgttattttggatccaccaaattcaggttaattgcagtgttatatgtgatgctgaaatgctgtaagcagctttaacagttgaactgttaacaggaagggactggttcagttgattaaattatggagtgttcataggtcagccttttaggcaaccataggcaacataaactttgttcatggagaattcttactgaaatatgcagatgtttgtgctagaattaagagaaaagggagatacaaagatcttctgtgtatgcccgtacatatgtatgagtacataaacacaaacacatggcacgagcttggctccataaaacagtatccacagaaggaaaggcgtatatcaaacagtgtaatggcagtgagactatgggaattttaatcttctctaaaagtatttattttcagattttctataagaagcatatattccagtaataactaggagaaatgtctgaaagaatcaaccccaagtggggatacaatctatgacacagatgcaagcttgtgcctgttcacggggtttcccatctgcccagtaacacagatagggagtganagcaggtgtggaaaggcccttctgagtgaaccgaagagttaatgcaattcttaataaatagaaaactcctctgggaggctgaggtgggaggattgtttatgcccatgagttcaaggctgtggtgagctatgatcatgccactacactccagcctgggtgacagagtgagaccctgtctccaaaaaaaaaaaaaaaaaatacacacatatatatgtatgtatgtatatattgaactctccatgtaaagtacgggatggatcacagatcacatgctctgtgatgtgcatgggtatgttcacactcgctctttgtctttgaataaggtcttctcgttatttttcaaataccatggagataagactctgttgctggttaggattcagctgaccaccaggtgaagcggaagcatttatatcaaaccatcctaagtaaatggtttcctcacttgtcctgagcctggtttcggatctgttttggctggagtcatcccctaagtaggttcacatctgatgggcttattttctgagactgcctggattgtgtaaggataggaatccatccacacacaggattgttcctgcctgcttcagcaaccttgttaagaaacactgtattttgaagaactttataatgagaatgtgtgtgaaaaactcaggcaccatgcctatttttttttttttttttgagacagggtcttgctctgttgcccaggttggagtgcagtggtacaatcttggctcactgcaacctctgcctcctgggctcaagcagttctcctacctcagcctcccgagtagctgggaccacaggtttgcaccactacgcccggctaatgtttgtatgtataagcatttgctagaggaaaccaacagctacacagagggcagggatgggacgatcttactcctttttgattttgggggccccgttgccattcattatatggtaagtggagtgtggggagtctgattaccattggttacttatttccaggaagcattccaaaggaaaccagctggacagaaagaacgagagatgatttctgtaattactaaagcttttgtagtaccttagacttcaattgtaattgctctataccaaatgcattgcattaagctccgttagaaaaatggctgcatccctggctttgtttcactgtttccttttagaagtctgttggtattgcattatattgactcatctaatgcaaatgtgtgcatagtcagagattactagtaagttgaagtttgtgactgagtgagttaactctccgtcattcttcaatgctttacgattcactgctgcaggttgtgtctggacagacaaccaggtaatacgttacctccctcacactttgctgaattcacctctgtttacattttgctcattaatgtagtcagctgagtgtcagatgtgagctatgctcagtttactgatttaaagaagtagttacaattttctactttgtggaaaagatgtcattctttgtatattgtctgtctgtgcataatggtaaaatactagttcaaccaaaagctggctgcctcccttcaccctgcccatctgtcgaaagtgtctgcgtgttaaaggtatctcagaattgacttgaggtgcctttaattatcaacatggtggcccattccttttcattctttttaaaatataaattgagttttgattgctttgcactggcacatgtataatggcctcatcttttatctttctgtaaatgtgaaaaaaaccctcagtatccattacatgcacatcgtgtttatataaaacctttgttctatggttgtcttaaagatacatgattaagccatttgaaaatgtcttctaagtttgaaactttttgttttaagggtgaaatgatcaacaacatagaaagaaatgttatgaatgccacagactatgtagaacacgctaaagaagaaacaaaaaaagctatcaaatatcagagcaaggcaagaagggtgagtttggcttcgaagaattaagctgcgtttttctcttcatttggtttcaagttgtaatacattgatgtaagcctgcctaaaaggtattccaagaaataattaattaataaatgttttattttaaaatggaaataattttttttgctaaaaatttaaaaggtttattagatgaattatttgtagttcatcttttgtgttctaagtaattgaaaccctagggctgggtgtggtggcacgcctgtaatcccagcacttttttttttttttttttgaattggagtttcgctcttgttgcccaggctagtagagtgcaatggagtgatcttggctcactgcaacctccacctcccgggttcaagtgattctcctgcctcagtctcctgagtagcagggattacaggcacccgccaccatgccaggctaattttgtattttcagtagagagagggtttcaccatgttggccaggctggtcttgaactcgtgacctcaagtgatccgcccatctcggccttccaaagtgctgggattacaggcgtgaggcacggtgcctggcaccaaattgttggctacacatttgatgcagtgaacatttatttttaatttaggttattcgtgacttcttggtttggaggaaagaagagaattatttgagaccgtggacctgcagtcttaggtagcacccacttaaagggatcctcaaaagaagggaacccctttcactcaagatgcacagactttgcattaaaaagggttcagggaaccctgtgtgatttttttgttacggggcaaaaatttaaaacttactctcctaacttaggcattttatgatagtgcccctgacactggagagattatgggtttttcacattgtcacctccttgtgctaatacacagagatgctgattttcaccgtgttaggaaaaaatggagtgagacggtgtgtgtggatgcacctccaggcgatggccctgagacgcacccccgggctgcaggctcagccgccagggcacaccctcactcacacccccgggctgcaggctcagccgccagggcacaccctccgcttttcctgggtatgtctaagtatgctcgtcatctctgaaatgccagacatggtttctcatgttatttcatttattgctttgaaaaaattggcccctaatgtaaactgaggtgaagagatacctgtataaagtgcttaacttagttccaggcctaagtcagctttcattaaaaacaggcagtcctgttccttttctccatgacctgaacacgtcagtctggtgaaaacgatagtgaaagttcgttggttttacaaagggggaaggtggtgggtgtgatacgttttcattctcctctgtggatgagcaagcctggctctgtgaggtgcttggggtctgtgcggtagctggcgtataaactcgtcagagacgtgatgcctgtttcagaaatgacactgtctttttgatgagatgcctgctaatggaaccctcctggcttgtctccctgtccccttgccgctcaaatgctttgctgctgcccctggctcatgtgtgggtcgtccccactcctagtgtcctgcatttattcccgcggagccatgtggccctcatagggaggccaggcaacgtttgtagaagggttttttttttctgtgtgctatgtcaggagcagtgaagaagtaactgcctagaacataaaagaaggagcgaaaggccaagtactgagtgtgtcggggcttcatgacgaggcagtggggctctccgtcactgagctagcaggcccgcacctctgtacatgcggaaaactaactgcatgtctcagtcatcagaaatgtggcaaaatgacttggtcgtgctgtccccatggatgaaacctgaaataacagttacatagcagcttatcgccaagtagtctgaccttattaagtcactctctcaagaagtcgcccaacagtattaagcagtgtcctgtaacttagcttctaaagtgagttctgatgggttgttttgctttattttattttatttttttgagatggagtcttgctctgttgcccaggctggagtgcagtgacacgatcctggctctctgcaacctctgcctcctgggttcaagtgattctcctgccacagcctcctgagtagctgggattgcagacccacgcccggctggtttttgtatttttagtagagacagggtttcgccatgttggccaggctggtctcaaactcctgacctcaggtgatccatccgcctcggactcccaaagtgctgagattacaggcgtgagccaccacacctggccaggtcgttttattttaaatgaaggatgtcttttaatgtggcaatatgaaattaaccatgcatgatataatcagcttgcttttctttgacagaaaaagtggataattattgctgtgtcagtggttctggttgccataatcgctctaattattggcttgtcagttggcaaatgatggtgtggataacgtcagtgtgcatgcctctctgccagggtgggagtaagtaactcatcaactaatttacttattaacttttgcaattaaccaataatagtatttgcttaattgtaatagacataaaactaataaaagcttgccagccacgcagtacagataatgccatctagtgatacatctgcctgtgtgctgattcgagtgcccagccactgtgtttactgagaacaagcacaggctgggcggtaactcatttttaaaccaaggtcaccttcttatcccgtttttaaaagtgtttttgagacagggtctagctgtgtcacccaggctggaatgcagtggcgtgatcatggctcactgcagcctcgacctcctgggctaaaactgtcctcctacctcagcctcccgagtagctgggactacagacgtgcaccagcacactcggctaatttttaaaaaaattatttttagtagagacgagaactctctgtattgcccaggctggtctcgaattcctggccctcagcctcccaaagtgctgggattatacatagacatgagccactgtactcagcctgaatcttttgtttttgatctaagaccattagctctttacatgtagtggatccttcattaaatgtcatagaaattcagtgaagattaattctcagttgtaatgttttgtctcctgagttttagcttttagagtaattgcaacactgaaaggtactttataaaatacactaacgcatcattttactatggaatcgagggcatggatgaacgctgagaaaaacattgactgaaaggaacatccttcgacctttctataggcagcatctattttatttaaaaatatttcctttaatattaaaaggaaaattacgtattatatttagttagcatgcctgttaattcttaaagaattctgaatataaaaggtatcagtttatttaaagaatcaaggtgtgagtgtcacctttcctaaacttcagcaggctttgtggtttccccctggttttcttctgcattgggagccatccttgcactggccctgaagtggcaatgctgtcggtgtgttacaggtggacacagcagtgatttctctgtaaatgtttggcacaattcttgtattagacagttgtgaactgttcccaggtgtctagagtgtggcaagtcatccccaatgaatttattcttgggttatggaagtgactgcagacttgatagtcacccaaggctttttaaaaagttaacatacagcagaaaggaatcacgagcatggttaagtctcactattgctttgtaatctttaagatttattccttcaacatggcaacaccctgtctctacagaaaaaaaaaaatccaaaaactaattgggcatggtggcacacgtgcctatagtcccagctacgccagaggccgaggcaggaggatcacctgagcctggggaggtcgaggctagagtgagtctagatcgcaccacggcactccagcctgggtgacagagcgagaccatctcaaaacaagagattgatatcttaatgtgagcatctgttacgctcaccatgcagttaccagatgagaagttttccagttagtcttctgacatttatgcaaaagccacaaaattacacctgaaattactctgtaaggagctctgggatgctgcgtgtgttaacattccattatttggcagtcagaactctcttaccgtctatttttattaggcaggatgtttgtgtaggatgtttattaggcaagatgttctatttttttcttcttagctttgctgaaaatattgtacgtgatttttcttcattgttatagtagtatttttcaatattttcatgattctaacatgtactttctgagttttttcctagtagctataatatggttagtttaatgtggttacactaaagataaaattacaatttgtagcgcggacacagtgaaatgcgcgacttttcatgggcactacttggcattaaggttgactaaaagaaggctcctctcagtgtgacccctggggagtggggcttgaagtcctgtgccccgggcctggctggccatttcaccctagtgtctgtaaataagaatgaacatagaaggatcctcattcataaaaagcagaccaaaatgaataccagcagttatctttgcataggaaggcagtggttaatgtccttaacttcacttttaaaatattaacatagcctttcatcctttagcaattggccttcctggggctggctgctgcccctccctgcagggtgtgccaggtgcaggcctgtcaccccggagcatgggtgggatgggctgctttaaggagacaggtggagtcttacaggtattcggtgagagggccctggcccagacctggagctggactccccagggtgtaccctttccactctcgctgtcaccaggagattagatgactcctgagtcctgtaccctagactccatgtagttgacagtcatcctgaaagccagatgtggcaggaaagtgcacacacatcgagcacccagacacgtggcaggcagcacaacagcagcaggagatgagagcacgctgcgtggagctgactccaggtggcccagctgccagcacactcacttgctgagcgggagggcgcgcgcctccctctggagggagggaaggcatcacagagaaaaggaagaagaggtttctctaggaaggtgctgagagtggggcgtaggagcgcatatagaggatgagagagtggctggggctttgcaggaaatgtgcgtgatgttaacagggaaccagagtttgagggaggggccctcctgcaggcagctctccccggtcctgaggagtcactgggaggctcaccggggcctgccatgcgcctcttgataaccctgtataactgactgagccggcagtcttggaactgtccaggctcagcaaacaggatttcttaggtaaaagcactcgtacatttggaactgtaattaaaatgatggatctctgctgttcaaaaagagaactcaaagtcctacagcgcggtgcctcctgttgtgtcttcctttccttccctcagacaagcttcctggaggagactccatttattaagccaaaggtggtctcgctttgccttgtgtgaggatacttgttaattttaaaaaagttaaatgctgtgtcgcaccctgcttccagaccatcagtgcagtagaagaatgaatgaatgtcttgttgatttcttacacatttgtcatatttaaatgtaaaaaatggataaggccaggtgcagtggctcatgcctgtaatcccaacacttcggaaggccaaggcaggaagatcgcttgagcccaagaattcgagactagtctgggcaacatagcaagaccccatctcttaaaaacatattttttaattagctgggcatggtggtgcatgcctgtcatcctagctccttgggacactgaggtgggaggattgcttgagtccaggaggatgtgtttgcagtgagccatgtctgcaccactgctctccagcctgggcgacagagtgacacctcctttcagaaaagaaagaaaaaataggatttttcagccaacaagaaattcgtttaaagttttacaaatatgtgtaattcatccaattaaaagcaatcctggagttttattatgattaaaagaaagtgtcggccgggcctggtgcctcacgcctgtaatcccagcattttgggaggctgaggcgggtggatcacgaagtcaagagatcgagactatcctggccaacatgctgaaaccccgtgtctactaaaaatacaaaaattagctgggcgtggtggcgggttcctgtagtcccagctactcgggaggctgaggcaggagaatcacttgaacccggaaggcagaggttgctgtgagccaagatcacattcttttctatgacatggaggagtcctttcttgataatggatgtattttttaaactatcccaaatcccagaaggattagttagcaaatgccattgttgatttctttgatacattgcaaattaatgtttttctttatcttgcagaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacccttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaaattgctcttgtggctgttactgtgtgtcatgatgtaatttttggagtatttggtgatttgttgatgattagtgtatattacaagcttctgtggttcacggctcagttgtcagtaccatgtattaagggacttgctggaattcttgctgtttctaacagataccaagtcagtgaatttgggctctatctcaaagtcactctgtttgaattcttttgtcaatttgacacattccatttgttaatggggggatctccccgccccccactatgttctgagttatcctctatacttaatcctcattcagagtttttcttattaagtagaatttctttacttcctcaactgaattctgatcatattggaaagtgacagttgaaaaccactattgaaaaaaaagagaagatagaactggagaaaactaattcatggagacagagccctagatgttaattttaatctatttctctatttctcccagaatgaatttccttccaaatcagtcttgacgtgtacagtcaataatttatttatactttttaaagacactgtaatcctatagtatttattgcctaaatgactttttatgaatgtcttcagcaaatctacactcacatcctttcatgagtttaaaaagtggattaaaccgaggtggaattcaaactggaaaggttgcatgtccactagagtagcagaaaaacctggaaaaactgctggcctcgtggcgagtcccactcagccccgggaaggggtagggctgggtcccccacaccgtggccagtgcgcagacccctcctcccgcccctgcccgcgctccctgactcctgcgctctgctaatgcaaacgcgagtgccccaggcgtgggtctgtggccggtgcctgcacctgcggagttgccgaggttttcctccctaggagcactggccggctccttattttagttgccacaacaacactcactgttaaaagcgagccctaaaggaaagaacagaccatacaggggcgcacacagcttctcaaatgaatagaaaccaggccctcggcgcagctgaggaagagcctaatgcggatcttcctagttggtttcacatggaaccaaatggacctggtaccacgcaaccttttgttaagttctgctttgaagattttgttaaaattcgtatgtgtgcggtgtgggaggggtggagcgtcacaccgggtttaaggcaagaacatttagacatccagaggcaggagccctccggagacgggtctgattgtcctggcgtcagaggagctatggaaatgcgcgccaggctctaaatgactggcaggtggcaggctgtgatgtggacagccctgtttcattgttttccatttgagcagtaagagaaattcaaggcggcacttggccctcctcttctgactcacagtctttgaacaagagagtgcagattcctaagcctgagaaaacagggcctctggcttcttggcagggagaggttccagagagtgcaggggaggccctgcctccttgggtggggtgacctgggcctcctgggacctcagttccctgcctgtgaaaaagacggacggaggtagagaatcccagggtgcctttccaggactaaagacggtgccttctttatgtaaattccatccttcgcaagttcactgtggagcgctctcccggggcccagtctctaggcgcagaacacccagccaggtggtagctctcctttgcaaattgtactttttaatgtgtcgttgagtttgctaaagcaggttgccctgtgagtagagtacaaggctggtcgtcaggcggggagagtgacaatgttttgaaattgttgaatttcctgagcatgcaccaggctcagtgtcttggagcagtgcgggaaggctggtgttgcggcggcctgaagaagcacagctgcagatgctaacgcaggcctggtgagcaggaagccggggcgtggctcaagcggaggggagaggccggggcaggtctggcccggccatgggggccgggctctgagctggagagcaaggtaaggtcctaagcgtcatgtccggaggagtgggcagacagcgagggttgcactgaagtggcgggagactggagctctgtgacggcctgggggtgaggccgtggaaccccggggtggtgtgggcagcggactctccagctgcttccctttccccctgtgtggcgtgggcagctgggtctcttaggactcaagccccccccaaaagctcatgtctacaagctggtgtggccctcgggtcaagtagggccaggtcccatgggaccaagacatggcccatgcagctcccaacattccctgtgtccttccgtgctcccactaggaattaggacccagacgcggaaacactcaagtgtagatccctgccctgggcgcgggtggccggcccagtgtggggagggagggcctctttctctggcaggccagcagcaggcctggagggaagtattgtctgccattccttcgtcgtgtttgaaaaagtgctttactgaggtataatctaccatacattcatccatcataactgtgtaattatatgattttagtaattaatagaattgtgtaaccacaaccctcttttttgggaacatttccatcaccccaaaactaccgttacgcccatttgctgttaatcccagctcccaccccggcgctaggccacccccggcgatgctttctctccatcagtttgtcttttggacgtttcatgaaagtagggtcaggtatgagagtcttctgcatctggcttctttcactcgcagcgtcaccgaggctgtccctttgaagcatgcgtgggtagtcggtccccttttgctgctgagcgtcctttattgtagggggacactttgtccctttgccacctcacggacatggaactgttgccttttattttattttattttattttattttgagacggagtctcgctctgtcgcccaggctggagtacagtggcgtgatctcggctcactgcaagctccacctcccaggttcacaccattctcctgcctcagcctcccaagtacctgggaccacgccaggctatttttttgtatttttggtagagacggggtttcaccgtgttagccaggatggtcttgatcttctgacctcgtgatccgcccgcctcggacttccaaagtgctgggattacaggcgtgagccaccgcgcctggccgccagttttactatgatgaataatgctactatgaacatctgtgtacatatatttatatggacttatgttttcattttccttagtagctttctgggaatagaaatactgggtcatatgtaaatttatgtttaacattttaaggaacaactgaactttccaaatgctgtgtcattttacttccaagtaaaagggaatgtataaggattccagtttctccacatcctcaccaactcttggtattgtgttatgtttttaaacctatctgtgctagtgggtgtggagtggtgtctcactttggttttcatttgcattttcctactgatgaacaatgttgacatcttttcatgtgtttattagccattcatagatcttttaaagtaagatattaactcaaatcttttgcacattttaaatttggctgtcttatttttgagttttatttaattttttttttttttttttttttttgagacagggtcctgctgtgttacccaggctggagtgtagtggcacagtcatggctcactgcaacctcgaccttctgggctcaagcgatcctcccacctcagcctcctgagtagttgggactacaggtgcgtggcaccatgtctggctatttttaaatttttttgtagagatagggtctcactatgttgcccaggctgtcttgaactccagggctcaagtgatcctcctaccccagcctcctaaagtgttgggataataggtgtaagccactgtacctggcttatttttgaattttaagagttctttatatattctggataaagttattgtcttatgcaatcttatatcttttaaagaagttaagaaaataaaggagaacgtatatttgcagagtgttttatgttaacatagtgaccatttctggtgctcttcatttctacctgcaggcttggatcactctctagagtagttttcttccagcctcaaggacttcctttggtatctcttgtaaagcaagtctgttagcaacgcattctctgtctttttttcatctgggaatttctcaatttcaccttcagttcggaaggatagttttgctggatattgaattcttggtttacagttttttttttctttcagcccttgaggatcttatactaccactctccagcctcctctgtctcatgcatgaatttggctgttaatcatattgatgctcctttatatgtgatcagtcatttttctcttgctgctgtcaagattttgtcttgtcttttagaagtttaggtgtagatatctgcatattctgtttttcatcacattttggaagctctgggccactatttgctgaaatgctttttctgcgtctttgttttctttcctcctgccactcccactgtgtgtattctgggatgttggatgctggcctatatgtctctgaggttctgtttgtttttcttcagtgttttttctgtcttttcttaataatgggtaacctgtgctgatctaacttcgagttcacagattcattcctgtaccttcttgggtctactgttgaactcttttagtgagtgttttcattttggtgattacttttcaactctagaattttagtttggctccttttaaaaaataatttctgcatagttgagaatctctatttgttgatttattattattttaattatgtaaatatagttttctttagttctttgtattttaatttttttacctgctaccttaaactattaagcgttattagttctttttaaaattaagtttctttttgtttccaagacaaggtcgcactctgttacccaggctggagtacagtggcccaatcactctcactgcagcctcaacctccctgggctcagatgatccccactcccccaaccttagccttccaagtagctgggaccacaggtgcatgccaccatgcctggctatttttaaaatgctttttgtagagacagagttttgccatgttgcccaggctagtctcgaactcctgggctcatgtgatcctcccgcttcagcctcccaaagtggtgggattacaggcatgagccatcattttaaaaatgttttttagagatggggtcttgttatgttacctaggctggcctccaactcctgggctcaagtgactttcctaccttggtctcccgaaatgttgtgagtacaagcgtgagccaccacacctggtcttctttagttctttgatcctgtttataacagctgctttgaagtctttgctaaatcagaaacctggagacacggagagagagtttctattcgctgcttttttatgctttcatggatgagttccactttcatgtttctttgcatgtatcatttgtttaaagctggatgtttttagtaatgtagtaattttggaattggatccgcgaagatgattgttgttgctgcgtttttgattgttcatttttaattcctttcttcgttggtaacttgcccaggctcaacctgtgaaacctgtctctggtacgtaggcgttgatgtccctcatcagtttttaaatttattgtttctattttacgtctgcttcccaggggttgtccccttgtctacatatgtcagcggtcagccaatagctgacagaggttgagctgcatgcccttgagcctctgctgatgcacctgtgtgagggtggggagcgtcttcagaggggagcctgtttttgagtccgcctaggcccttactttctcctgtacccccatggtcgatgagggagtaggcgtgagcctgttcttctctatctgtatcccctttcccgccaccctcagcctcctcttgctttgtgcccaggtgccaggcctgagggccgcatccacccctcatctgcgctcggattcctgaggctctgcggtgggaagaacaagcagcaggaggggcggagggcgcgccttcactgccagcttgctttggacccacgccccgggcttggtcactgcctgaccacagttcccaccaggaagagacccaccttccctggcctccgaatattctgtttctctctggtcccttctggcctagggtggtggggacttcctgctgtcgctggtctctgggtccttaacatctgtcctttgttgcttatctctgcccccatctctgagagtagcccttccagtcaggccttttcatgtaaatcgtccttctcactggcttgtttcctgcggggatgctgaggactcaggggtggtcccaggtgtcggcccaggcagacaggtcagtggtgagatcatttgctaggaggagaaaacgcaggggaaagtgtgtttgctggtgaataatcaagagttgtgctttgtaaatggtaaacctggacatagaagtcaaaaattaaatcagccattgaagatatgaggctagagctcgggaaggaggcgctgatgacggaaaatcagggaagcatctgtgtagatggtgccccaaaccacagactagaggagaccaacccgggagaacgtgggaagagagaaggggctcaggactgggagctggggcattgcagaactagaggcctggaggaagacgagggttcagcagaggagcctgaggtggaactgaggggagggcaaggatgggaaagagtacggggtcctcaagtccaagtgaaaaaaaaggttcaagaaggagggagtggtcagtcagggaagctgcccctgggaaggccaggaagagggggccaccgggttcggcaacactgacctcgctggtgacctggacaggtgtggtttcagagggagctggggacggaagcctgaatgaagtggactcagcagagatgggaggtgaggccgtgccctgctgaggtgggaggtgaggccgtgccctgctaaggtaggaggtgaggccgtgccctgcagagatgggaggcgaggccgtgccctgctgagatgggaggtgaggccgtgccctgcagagatgggaggtgaggccgtgccctgctgagatgggaggtgaggccgtgccctgctgagatgggaggtgaggccgtgccctgctgaggtgggaggtgaggccgtgccctgctgaggtgggaggtgaggccgtgccctgccgagggcttcgttatacagggaggataactggagggaatgtgaggtcagtggagggtgttagtattttacatgggaaataatagatactgaaaagggaagaaattatatgcaagagagagggattaattatagaaaccaagaccttgagtcagtgacagggtaggggaaccagggcagcagcagagggtcgctgggcagcgggggtcgctcatcagctggaggggtccatggagcgacacctgcccccacctcacagctggaggggtccatggagccgacacctgcccccacctcacagctggaggggtccatggagccgacacctgcccccacctcacagctggaggggtccatggagccgacacctgccccccgcctcacagctggaggggaccatggggcgacacctgcccccacctcacagctggaggggaccatggggcgacacctgcccccacctcacagctggaggggaccgtgaagccaacacctgccccccgcctcacagctggaggggaccatggagctgacacctgcccccacctcacagctggaggggaccacagggtggacacccccccacctcataggcccgttggacgatcacgtgtggaataatgcaatgtgtttgggttcgtgcctggcacatcgtaagtgtgaattagtactgtgtggctttactctttggttttctgaacatttttattcttgaatagaattcgggctttatctttgcctgtagccagaaggcctatctgactacttttccctagaccaaaacaacaaaaaactacactcccatgacatctctccaaacgggattctctgtaagtagaaaaagatgactgagtttgaaaataccagtcgctccccggttctcattatcatattgtcagaagcatcctgtgacacccacaaagtttagcacgtaatcccatgcacggcaagcccaaagctggcgggctggggcggcccgtggtagagaaagctgtcacctttgggattccgcagacagcagccttggtgccactggggtagaagcatccgcgtctccggcattcggtgtcagcatctacagttagaccttcccatccttatgggctgggcccctctgctgtcctcgagctgcatccaacaccggggaaatgagtcctgacgaccgagggacgtcaccaagagtgtcaccacccacaccgagcagccacaggctccatgtccagcccctccttcccccgggagggtgagcccaggaggtgagagcagagatcggggcctggaggtgcggcctgggaagcctgttgtgggtgccgcctccctgagccacaacctgtcctggggatcggtggacgctccgtggctctgcagagctgcttgtaccacccttgctggaggaggaggttctcgcagtttgcttccgtttgtggatgagagacaggtgggttggttggttcttcccatcatggcatcacagccattccacgggaggtgatggcagctgattgttctgagtctctgctaagtggaatcaccncaagacctcgagtgcatggacccactgggctctgggcaccgcagagacgtgcacaggcctggatgtgctgactgctgggctgtcccacacagctggagccaggagcccacagtgggcagcagtaccttgacttcaggcgggcagagccgggcatctcctgtctcctccctgccctggatgggataggtttttaggagtaactttgctagagggaagattgtgagacatctgcgatcctgagctgctccggtggggcacctgccagaagacaggagcccaggctgcaggagtcgctggtgaaggaggggtgaggcggcgcccctgcctctgtggttctgcatggggcagggcccctgctgctccgggcggggaaagaaggtaggaggcccttgctcccatgactcactccaggctctacacacgttggagttttctgtttctttctgagcttctaatgcaggaatcacaagctcagatccctcacagatgctatgttttgcttcggcgtgcatcctaggtgggattcttagacatgggaaacacacagcaacatctggcccttccacaaagaagtacgtatgctcccccagcaccctttgttttttgagatagagcctcactgtgttacccaggctggagtgcagtggtgcaatctcggctcactgtacctccgcctcccggattcaagtgatcctccgacctcagcctcccaagtagctgggtttacagttgcccagcatcacacttggctaagttttgtattttttgtagagatggggttttaccatgttgctcaggctggtcttgaactcttgggcttaagcaatcctgcttcggcctcccaaagtgctgggattttgggtgtgagccactgcgcccagcttactctcctacttttttcatgaaacatgcagctctttggtttttcagatatttctacaactctgactgaatgccagggaagattctatgtgccaagatccagcagtgaatggtcccggtaaaatcactgtcccaacaaggtgtaatctagaggagggagacaggaaacaaacaaaatggttaagtcaaatgtatctgtgctgggtggtgataaaaattttggagaaaaataagtctccgaggggatgaagaatgctgtgtggggattgtacatccatgtgtagggcagtcgggaagctcttatgataggtgatatttggatgatgaccagtggcaggtaagcgtgcgatccccttggatttctggggaaggagctttcctggctgaggaagaggtacatgcaaaggtcctgaggtgggcatgggcctggtgtgtccaagcaactgcaaggaggcttgtgtcgctgcagtgaccggacaggagggagagagaccacagggcgtgtgtgcttgggtgagcgggtggggggccagatcactctgggtctagggggccatcatatggactttgactttgactctgtcaaaaatgggagtgactagaagattgtatacgtacaattgataacacttatgtgttaaaggcgttgtgctgactcctgtgggtagatgtgccaaaagggtagaaaaagatagaagaccaagccaggtgcctcggctcacacctgtaaccccagcactttgggagtctgaggcgggaggatcgcttgagcccaggagttgaaaaccagcctggacaccatagtgaaaaattagaaaatagctgggtgtggtggtgtgtgcctgtggtcccagctactcagaaggctgaggcaggaggattacctgaacctaggaggtcaaagctgcagtgagctgagatcgcaccactgcattccagcctggacagcacagtgagaccctgtccccctcttccgcaaaaaaacaaaaaggaagagcgattatgaggttcctgaggccatctagacaggaggtggcggggacttagagtggcagctgaagttggggcaaaagaggttggacactttatcaatatactttgaggtttgagtcaaaagccctttggctgggctgttagagggtatggggtatctttatggggtaatgaaaagattctaaaattaatggtgacagttgcacaattctgtgaatatcctaagaacaattgaatcgtatggtatatgagttatgtctcaacaatgttaacagaaatgaggatttgcagatggatttggtgttggggtctgagaaggagaggaggcaaggaagaccagcctgggcagctggaaggatggtcttcaaggaggaaagcagacagaggaggggcaagtgttaggggagggctaagagtttcaggagttcagttgtgttttttgttttgttttttgagatgaggtcttgctctattgcccaggctggagtgcagtgacatgatcacagctcactgcagcctcgaactcatgggctcaagcaatcctcctgcctcagcctcccaagtagctgggactacaagtgcacaccaccacacctggctaatttttaaatttttttgtagagatggggtcttgctgtgttgcccacgctggtctctaactcctgagctcaaacagtgctcctgcctcagcctcccaaagtgctgggattacaggtatgagccactgggcctagcccaggagttcagttaggtctcggctgtgatcagatatgcaaggggatatgggggaagcatttggacactcaacactggctctggggagagggccgcaggatgaatgacaggagcacctggctggtgagtgacagggggaagacaaggggcaggagtgagccctggacccctgatgctcccaagttaggaggggaggagcggccagccagggaggggacgtcccagaagccaggaggttctgtgtttcatttcctcaccggaagcagagagcatgggcacagagagacctttctttactgggcagaagcagcagtgccagcccagggtacatgacaagtgcctcagcatgtgggatcagggagtggggatgctggcaattgtggattggaggctctgggtggcaggaggctgccttggggctatagctgttgccatgtacaaataagagccaagggctgctgggcatcaaacgttcaagagaaactggaaattatgagattttgattggcttttcaaaatgtccatttcattttaaaaacaaaaacctacatgtgcctaaccacacaagtctgtgtccccacctggcctgtggcccgtcactgtgttctgctttctaacacagggagttactgccaggggcatggagtctctgtcaggccttttcctaagcaggtgtaccctgggagaggcatgggctgttcagggtgtcggtgcacctgcactggtgttgacccttagtgtgatgccaggcaggggccctcagccccccaggatccagctgggtctgaagttgagggaggaggtggaatcctgcatgaagaaagctctgctggctgagagcctggctcccacgctgactgtgtgactgtgggcaacttatttaatgatcctaagcctgagtttcctcctccgtaaaatgggttcataacagtgctcacatttttgggccacagcgagtatttaataagactgtacataaaagccgggagtggaggcatgtgcctggagtcctggctgctggggaggctgaggtggatcacttgagccttggagttcgaggctgcagtgcgctatgatcatacgtgtgaatagccattgccctccagcctgggcaggatagtgagaccccatatctaaaaggaaaaaaaatattctacacgtacagagcttagggtgttacttgacacatagacactcagtaaatgtgatgaaatgcattttgcgtgaatatttcggctctggctatttacattagtccagaaggtgaaccctgtgctacttaagtttttatagcagcactgcgagcgtaagcaaaaccagccacagtgcagcagaacagtaacaggagagccggctggggccagaaaccagcagctggacagcgctctcatggaggcaaagcctgttctgaccccagctccagccttttctagccctgcggccgcatcgtcccctgcactgctacttcctgtttgaacaataggacctcagtgcagcttgattcagcgagcgttaaatgaaataacgggagaatggactttggctctgaccccggccataatgtttgctgttattacaaagtgagggccaagattacagcagatccgcacacacggaggttagaggtgttttggggtattgtcagagagagactaacagaactgtctttggacccatggatggttttgtaaggaagtagtgcctaacgcaagttgtagtaaagacccatgggtaaatgaaaacgcctgtcctgggacccgggagaccgggagggagctccaaggctcttggcccaagggcgacttgctgggaggtgcctccttccagctgggaagccagtgcccagagcagatgcctctgctccgccacagcgctttgaaatggtgactcaggcttcatgcacgcccactgctgcccgtcagaactctcggcttcagcagttagcttggaaggcagtcgtgagcggggtattttgggcagcatctcagcagaggggccccagctgtgcgggtgttctccgcctctgcaggcgctgcctgccctgcagaactccctcctcgcggcccggggaggccgcagggtgcagttgggatgacctccctggcttggttggctccagcctgagcctttggggccgggctcctcagggcagcaggcgcgacccgtgaagacgtcagcgattccagcgctctccatcatcgatcgtgcctcctgtactggaggttttcacactgcgcgcttccttcaccctctaagagaatgangtncttcccccgggctccctttttcatgcagattggagtcaggggaatgggccgagtggagaaaataagcaaaaaaccctgagaaaggggaaagggcttttgcccggcccaactgactccagcacattcctttggtggggaaattgaatgaaatgaatggagaaaaaactaaaacatgccaaaaagcttaggtgggctttaaaaaaaaaagcttaaccagaggaggaaacccggaggacctgaaactccaaaaattgg

SEQ ID NO: 928 - DNA, 857 bp, Homo sapiens
ctaccacggtcccccgtcggtacagcgcggatcttcagcccgtggtgaagacgagggccatcagaggacgccccgcaccgccagtgtgagcagacagctccacgccaggccgggcccgacacggagcggggctccagcagggctgccgcagcgtcctccctctccggctggacaccggggccccactcactgcccccggccaggctggggagccacatcctccgctcggtgctgtcgcagggcgcggggcgggtgacccccggggtgccaggagagaccgaggcgcaggtaccagccgagaggagggcgcctgacccactctctccgggcaggggggcaggtgggtggcgagaaacttccaaaccgcactgggtctgatcagccaacatggctcggccgggggtccatcctcctgagtgtgtgggccccaccttgagtccttccctggcattgccccggccccttctgcggcaccctcggacctggaaggcgggcctgggttcacctccctccacagctggagaccccaggcccccagggcgtgattctcagtgggggatccgggagatccgcacctacaaaagggtcttgaggaggtggaggggggcaccccaagttcacaggctgcctggctggaaggaagccactgtggcgacctgccagcacctggacgctgctgcagggtcgtggccgctaccttcatatggctttggcctgtggcccggtgtcaatctgtttcctcaaaccctgtcagtctgctctctggctttgttcatcagtggcctaatcttagttgaacctgctcttttccagttgctttgctccgtagcctcccatgatctagttcccttgcgttc

SEQ ID NO: 929 - DNA, 826 bp, Homo sapiens
gtaccgacgcggatccttcagccccgtggtgaagacgagccactatgtaccccaggcctgctccaaaagtttaggcaccttataggccctggccattatggagcggggggttccccaaaagcaggaataaacccacctgcagggtgtagaggcaacaagagttgctgagaaacaaggtaggggtacatggcgggggaggggcatgaggtgagcggcccccacccatccgaagagcagcactgtctaaggagaccaggcctatggcctccgacctcctactgaccactaggaggacccggctttgattccaggagtggttttaacagacacggcctccccaaccaagctgggccgatgccggtggctcccaggggcccatcctaactgcccataagtggaaatgtgttacacactgtgcatccaacacatgcaatgcactgtccccgccgcacctgaggcgtcacctccaagcccagcgtgccccctgacctggaaactgcgcggggaccatgacgaagtcgtctgtgtcacaggaagagtccttgctgccaccagagtcccgggagctgtgcaggaagccagcggtgtcagccggggaggccagggtcttctgcagctgctgcatctcgcccagggactgagagtcaacggaggggctggtgagcaggtctcgggacctacacactcagggagcaatccccctctggaggccagagcccagaaagacgggcctggctgaaagctggcagcttttcggctcgtttttgctcaacatcactaagcactgactcagaagccgaaccataagcacgcgaaccatcaacga

SEQ ID NO: 930 - DNA, 589 bp, Homo sapiens
attagtgatgaggaaaggacggtacttcgaccgtggtgaaacgtggtgcgatcttggctcctgggttccagcgattctcctgcctcagcctccagacggagaagctgggattacaggcacgtaccccacgcccagctaattagttggtttgttttcgaactcctgacctgaagtaatccgcctacctcggcctcccaaagtgctgggaggtggaggctgcagtgagctgtgatcctgctgctgcactccagcctgggcaacaggactgagtaccctgtctataaaaaaaaaaaaaggtggaaagatcccaatcctcagttatatttttctgcagtggagtattatgcagcagcaagaaaaatgcatgggccagatggagtggctcatggctgggcatggtggctgacgcctgtaataccagcactttgggaggccatgagggtggatcatttgaggtcaggagtctgagaccagcttgaccaacatggggaaaccctgtctctactaaaaatacaaaaattagccgagcacagtggtgtgtgcctgtaatcccagctactcatgacgctgaggcaggagaattgcttga

SEQ ID NO: 931 - DNA, 861 bp, Homo sapiens
  misc_feature (1)...(861): n = A,T,C or G
acgacgcggtaccttccagccccgtggtgaagacctggcttccctgctgccacgaacaccaccaatggaggtcctcaccttgaatgttaattaattaattaattaattattttntgaagggctcactctgcgccaggctggagtgcagtggtgcaatctcagctcactgcagtctccgcctccttggttcaagcgattctcctgcctcagcctcccgagtagctgggattacaggaatgcgccaccacgcccagctaattttgtatttttagtagagacggagtttctccacgttggtcaggctggtctcgaactcctgacctcaggtgatccacccgccttggcctcccaaagtgttgggattacaggcgtgagccactgcgccccgccccacgtatctttttaaaagataaatgttatcgtgtgcatttacggtgtacgttgtggtggtgtagggtacgtatacgtagtaaattggtggccacagcagaacgggtgagttttgcatcatctcccaggcacctgtcttcctcccacagccagcgcaaccatgacccatgcattagcagacgcctggagcataattattctctgcagccctcaggtgcacacgagcccttttgaaggggctcaccctgtcgcccactgtttattctctgtcttatatatttgatcccaccttttaacaccacctgggagacggttctgcctttgccagctgatcagggatgcacgtcctgacctaactcggccacatctcgctactccggcggaccggccacaacagcacaaccccggagctcaaccggcaccgggccctacgcgagcccccacccttaacctgggccggcccggggggag

SEQ ID NO: 932 - DNA, 863 bp, Homo sapiens
  misc_feature (1)...(863): n = A,T,C or G
ccgttacttccgcccgtggtgaanacgtgtggctgggcgtgaatctgtcgtcttgctctctgtttcttggcatcccaagaaaacagaactgttgtctgcctgactggtcgtggagagaaggtttgagacagggtcttgttctgttgccgaggctggagtgcagtggtgtgatcacagctcactgtagcatcgaccacctgggctcaagggatcctcccgcctcagcctataagctgggactacaggcacacgccaccacagccggctgaatttttatttttatttgtagagatggggtttcgccatgtcgcccaggctggtctcaaactcctaggctcaatcagtttacctgcctcagcctcccaaagtgttggcattacaggcatgagctgctatgcccagcccacagcctgattattttaagattcatccgtgctgttgtgtatgtcagcagtctgttccttctcattgctgcggggtgttctgttctgtgggtgtgccacggattgtttatacagttacctgctgaaggacattggatgatttctagttttgggctgttagaagtaaagccactaagaacatttacatatgagtcataaataggattcagtaatcccttgtgatttacccactgtaagttttgctttattatatatcctatgaggagcctgttcggtgcccagcggatgcagggcggaactggtactgaactcaccgcctcgggcagggattccactaactccaagcggatcagacacccaccatatagattaagaaggccagagcaccgccgaccccgccagggtacaacccggtataccaacgaggtcagaccacagacaacgcccgnagaaagagca

SEQ ID NO: 933 - DNA, 1062 bp, Homo sapiens
  misc_feature (1)...(1062): n = A,T,C or G
atgggccngttgaagggtgcatctaccctgtggcgtagaccgggctgctccatgctagggggtgggtagtgtggaatggaatcaaaacacaggtttgattgaacctgtgcatacacctacttccacaatctgtcagttacaaaatgagtgccgtgggtgctacctatactttaaaaaaaaaacattgactataaagtaatctatggccaggtgcagtggctcacacctgtaatcccagcactttgggaggccgaggagggtggatcacttgagatcaggagttcgagaccagtctggccaacatggtgaaactctgtctctactaaaaatacaaaaattagccgggcgtggtgccgggctcttgaggcaggagaatcgcttgaacctgggaagtggaggttgcagtgaactgataatgtaccactgcactgcagtctacgtgacagaggaaaactctgtctcacaaatagataaataattaaataattaggtatgctattaatcccagtgactcaggaggctgaggcaggagaattgcttgaatctgggaggcagaggctgcagtgcacagtggttggacgggctctgtggctcacccctgtaattccagcacttagggagacggagacaggaggatactctgacgacaagagttcaaggccagcctgaccaacatggtgaaaccccgtctctactaacaatacaaaaactatatgggcgtggtggagagcgcctgtaatcccaactactcgggaggctgaggcacaagactcggtggaacccgggaagcggaagctgcattaagccaaaatccaccactgaactccaacctgggcgacagagcaagaatctgtatcccaaaaaaaaacaatctattacgtattaactttcaacattacaagctgttataacaactggccgaaggtaagcacttattttccttaaacttttgggttgaagcataccatggcccgccttgcatgaaaattaagggaaaagttttaaaaatgtttaaagaactcagaactgcgccaagagcccagtggttacttaccaagaggg

SEQ ID NO: 934 - DNA, 916 bp, Homo sapiens
gccgtctcagcccgtggtgaagacaacaaaaagcaaggaaatcctgccatttacaacaacatgaatgaacctagagggcataatgctaactgaaataagccagagaaagataaatgctgtacagtatcacttacacgtggaatcttttttttttaagagacagggtattgctctacagcccagcctggagtgtagtggcacaatcacagctcactgcagcctcaacctcctgggctcaagcgatcttcccgcctcagccttctgaatgaatagctgggactacagaacacatgccacacctggctaattttttaatttttttgtagagatgctgtcctatgttgtgcaggctggtcttgaatacgcggtctcaagtgaccctacagcctcggcctctccaagtgctgggactgcaggtgtgagccaaagcgcccagcctgtaattaataatattgcactgtatacttggaacttgctgaaagagtagatcttagccattctcaccaaacaaaacaaaacaagggtaactgttaattaatttgattgcggtaatcacctcactatccttataccaaatcgctttgtacactttataaaattttatttgccaattatatctcaataaagcaaaaaccaaaagaaaaaaaagtttcctcacagtgtcaccacctgggggtgtgtgtctaaaccctctcagctttgcttacacctgcgcatcaaagtgcacgaggcagggctctctgcttgcactggggctctataaaactcccaggaacagccatcatcggggccaggacaacgggccttcaatggggcgcaaaaaagcgcagaatatgcacggcgggcaacagagctaacaccgggcaaagctggcctcagagaagcaaaaaccccaagaacacccgccccgggaaaa

SEQ ID NO: 935 - DNA, 862 bp, Homo sapiens
cagccccgtggtgaagaccttcctttccttgactactagccgcttgggactgggtgctctggcgtctgggaaaccagggttgtcctgatgcgactggtcaaaatcccggatgaggccaggtgcggtggctcacgcctgtaatcccagcatctttgggaggccaaggcgggctgatcacctgaagtcaggagttcaagaccaggctggccaacatggtgaaaccccggctctactaaaaatacaaaaattagctgggcacggctgtgcacgcttgaaatcccatctactcaggaggctgagacaggagaatcatttgaatttaggaagcagaaattacagcgagccaagatcgtgccactgcactccagcctgggcaacagagcacaaaagaaaaaaggaacaagaaagaaagaaaaaacaatccgggatgtcctgtgaaagtccccacctcctacaggtgatcccatcagtccgaaccaaggtcatctgaagcaggtgtggaatcaccctgttcagaccgggccagggcaggctctgagggcagcagggacaggatgggccagagtacccagggcaatcggggggggggggggggggggggggtttcattatttaccatacgtcacttatatcactttctcactcctacactttatgacttctctcttactacaaccgtcctctttcttttctttttactcttctatacattcattctccacacaatatacgaagatcctcctcatcatgcaccatcccccaccacctcctcacaccccccccgcctcctacacgctcacttctttatctccattccctccccctcactaatcccaccacttatcctcctatgtcacttcta

SEQ ID NO: 936 - DNA, 1598 bp, Homo sapiens
attggtactccagataatctcaagagccaaatgtttatttcttaaggcatgtgatgagtatgtagggatcgctttattattactgctttaaattgtatgtatgtatttttccgctttcctcctccacatcgtattatgaaaattccaaacaagttgaatggattgtttagtgaaagatatcttactgtttaaattctatgattaattttactgtgctttggaagtcttacatatattttataatttcttttgtatgtgtgatgtatttcctaattaaaaattccttgtaagacggaaagaggaaaaccaaggagcctccattttgagttacagacttgcggcaggtgacagtggatgtctaagaaaatagaaaagagttaaaatggaaacatccattgctttaggaaaaaattcagcgtgagttttattactttctttttctttttctttttctttttttttttttaaacagagtctcgctctgtcgcccaggctggagtgcagtggcgcgatctcggttcaccgcaagctccgcctcctgggttcacgccattctcctgcctcagcctccggagtagctgagactacaggcccctgcgaccacgcccggcgaattttttgttatttttagtagagacggggcttcaccatgttagccaggatggtctcgatctcctgacctcgtgatccgccctcctcggcctcccaaagtgctgggattacaggcgtgagccaccgcacctggccgagttttattactaatagccaattgtgtaatttttattttgaccagtgaaactctagaaataaattcagaatttgttattacatatgtactaatttctgtttcgaaaagatttttaggtgatactgagtgcaggggtgttgcatataaaatacagacaggcacgcatttatttataaaaagataaaaagaaccgttctaagcagaaatttttcatcattttcctgttagagaaaatgaataattcgccataattttatcaccctaacacaaccttttttttttttttttttttttgtgacggagtctcgctctgttgtccaggctggagtgcagtggcgcgatctcaactcactacagcctctgcctcccaggctcaaacgattctcctgtctcagcttcctgaatagctaagattacaggcgtgtaccaccacacccagctaatttttgtatttttagtagaggcgggattttaccatgtcggccaggctggtctcgaactcctgacctcaagtgatccacctgccttggcctcccaaagtgctgggattacaggcatgagccaccctgcctgactgattttttaaatgttatgttgcatatttcccagttgaaacaagggaatttattactttttggttgtggtatttcatttaacaaaaaaataattttattgacttctaaataatccggtttttaacggggcgtaactggcttcatatttttcaggaccctgtattttttttaacccacttttttaatttaggttatggcgggtcctatttaaaaaaactttttgggaggaccctaggtgattcggaaaagcgttgctcttttcggggagcccaccg

SEQ ID NO: 937 - DNA, 1032 bp, Homo sapiens
  misc_feature (1)...(1032): n = A,T,C or G
attaaaaaacatttgcgccaccgcggatccttccagccccgtggtgaagacttctttagtgctactgacatcgcctttgtaaaattatgactgagacagtgaaagatctaacttaaccgactccatcttccttctaacctccaagctgtctttgttcattcctgggcgtaggctgaactaactttgggagaaacttagcttgtagtttacagtttaaacaaagacggtaacagccctttcccaaagcaaacctccttcttgcctaacattagccacaggattagaaattacggtttaggagccatgcagctggaggctacaagattctgaccctccctaaactgctcctaagatcagcgcttgagatattttgcagaccctgcacttgatggatcagctggcaccacccagatggataaacaggctcgtcagatcttgtggcccccacccaggaactgactcagtgcaagaggaaagacagctttgacttgctatgatttcatctctgaccaatcagcatcctggctcactggcttccccccaccaaccaagttatccttaaaaactctactcccttgcaggatgcgggtggctcacacctgtaatcccagcactttgcgaggctgaagcaggtgtatcacgaggtcaggagatcgagaccatcctgactaacacggtgaaaccccctctctactaaaaatacaaaaaattagctgggcatggtagcatatgcctgtaatcccagccactagggaggctgaggcaggagaattgcttgaacctgggaggtggaagttgcagtgctccgagattgtgccactgaactccagncctggcaacagagnctagagtctgtctccaaaaaaaaaaaaaaatcaactttatcggggggtataatccacatacaattaaaggttcacattctaagagttcagttcagtgagttttgacaaacgtacaaacccatttatccactcccaatcaacacagagcatttgtcttcaccacggctggaaggacgcgtactncacc

SEQ ID NO: 938 - DNA, 1058 bp, Homo sapiens
  misc_feature (1)...(1058): n = A,T,C or G
agcgatcttcagccccgggtgaagaagcacttctgtccctggcgcccagacctgaatatcagtccactccgggagcgcctccggcgagcgggcggaggaggagatccccgctcccgcccagatcccggcctcctcgtccctccccgcggggaagccgcccgcccctgggcctgagctcggaccgcggttccccgagggccagcagaggacgccccgcaccgccagtgtgagcaggaagccgcggcaggacggaggctccacgccaggccgggcccgacacggagcggggctccaggcagggggctgcccgcagcgtcctccctctccggctggacaccggggccccactcactgcccccggccaggctggggagccacatcctccgctcggtgctgtcgcagggcgcggggcgggtgacccccggggtgccaggagagaccgaggcgcaggtaccagccgagaggagggcgcctgacccactctctccgggcaggggggcaggtgggtggcgagaaacttccaaaccgcactgggtctgatcagccaacatggctcggccgggggtccatcctcctgagtgtgtgggccccaccttgagtccttccctggcattgccccggccccttctgcggcaccctcggacctggaaggcgggcctgggttcacctccctccacagctggagaccccaggcccccagggcgtgattctcagtgggggatccgggagatccgcacctacaaaagggtcttgaggaggtggaggggggcaccccaagttcacaggctgcctggctggaaggaagccactgtggggacctgcaggcacctggacgcgggcagcagggacagtggccagcaccctcccagatggcttcggggcctggggcaaacggtggccaaatcggcttcccatccagaccccctggccaagtcctgccaaccacaggggctgcgggtgccacccaagtggcccctccatatgcctcgactgcctgaaatacacctgcgctgacgtcttcaccctgggcgaaaggacgcgcactntcaaanggggcc

SEQ ID NO: 939 - DNA, 1109 bp, Homo sapiens
  misc_feature (1)...(1109): n = A,T,C or G
cgtgtcatgcgaacaatacatctacgctaacaggtctcttcactggaccgtgcgtgacgttaattccgagataattaacatcccggaagagaggcggcacatatataaagagcattttctgagcgagcacgcgaacacgctgtcgaaaaccaacacggtttacaacaacggacacgcaggtgtgatcacggttcctgttacaagagaaacgctcgcaccttgaaaggtttccacctccctccggttgaggttaaatgctcccgtaaaaagggtgtgtccaatttcgccattaaaggttaatgaaagtgtttataaaggccatccgatacgggccttttaggctttttaaccaagctgaaaatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacgtacgtgaaacatccggcaggaaaattcggtgatgctgccaactttctgatttagtgtatgatggtgtttctgaggtgctccagtggcttctgtttctatcagctgtccatcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatgaatggcgttggatgccgggcaaccgcccgcattatgggcgttggcctcaacacgattttccgccatttaaaaaactcaggccgcaatgctcgcccggcggtgatggcgctctctcagtcgctgggcgattttgtcgttgccagcgccgggccgcacctcgaatccgtgatcgccggtcacggagccggggcacaaaccctttctgaacaacggctgtgtcgggtactgaatatcgacatcggcggtggcaccgcgaactacgccctgttccatgccggaaaaatcagcggcactgcctgcctcaacgtcggtggtcgcctgctggaaaccgacagccacgggcgcgtggtttacgctgtcttcacccac

SEQ ID NO: 940 - DNA, 1154 bp, Homo sapiens
  misc_feature (1)...(1154): n = A,T,C or G
ctccagccccgggtgaagatcaggagcccccggcggggacaaaagagcgcactgtccccccgggggtccttggcggggctgcttgtccttgtgggcctgagttttttgtctttctgtgttttgagtacgacatacagcgagcagcccagggtctccacaggcgtccgcctccctcccgcccctggttcctgggcacggatgggacgcggctctccgtgccttatttttgcacggtggcaccgtgggccgtgcgattgcagcttcgcacgctatctggagtgtctgtgccggagccgcccgtctattcacctggttaagccaggctcggcctgcagcctgcttctggccagaacttcccggactcgcggcgagagtgtctcgggatctgggtcctgggtggcagttgtgtggtggcagattttgacaagctgctctaaagtttctgctccatttctcctctcggcagcacagcctgtggctgtcatcaccgcgcccacggcacagtggcagctcccttgatcttctgtaggaggtggggtggggcggggcaggtggggggtactgctgaggttgtgggatgctgggccagatggtgccaggtggcagccgccctccatgtcctggcttctgccggtggcctctgggttcctggccctcaggaccttgtcatcgccctggctggggccagggtgtcccctctcaccctgcagctgctcccagagcttcaggcgagcacccccagccaaaaccaagacaggcaggagggttagaccatggcctgatttcgccatgagagacgtctgactgtcccttgctccgcggtccccttctgacagccgtcttcatggctccggngatgttgtttgccttggacgtgggctttgccacccaactaaatgccgggcctcaatctccctgtctgcgcaatggggccagtgaggacaagctgccgtgcgatcagcggaagtgctttcgatggttcaaggacaagaagggggaaaggctggagaggatctgtggggggaacggaagggggaaggctggaaaaggatcggcgtggggggaccggaagggggaaagcttggaaaggatttggggggaaaatgggaaaggggaaggttggagaggaacctgtggaaggaaccgcaagggcg

SEQ ID NO: 941 - DNA, 1257 bp, Homo sapiens
tcaggccgggtaagaatttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcacaggcgtggtagagctactgctgcccagcaaaccggcaaatgaaacgcacgggatcaacaacatcgcaagaattaatgcgattttacgcatactgcttattccttgataaaacggttacacacgccaggacggcaaaatggatcccaaatcggaatagtctggatttggaaggctcacattatcaccaaaagagttttacgcaagcctgtcggcgcagggtttacaaatttcatcggaagcgggctttacccaaagagcgccgcgtgagttccagttctctcaaatcgtaaaagtttatcggtaagtttgtaaatcaggatccagtccggttcgacatgagcatcgcgataacctttccatgaaccttgcagcgggtggtctttataaacagctggaagcggtaaagtattattgataagaagcgtcataagatatttcaatttattcatatccttatgacgcttttgtgcaagttttacatcctttgaatattgtcccgagtattcaatatccctttgaatcatatttaaattcctaatttatcaaataaatcatcggcgtctttggccttatgaacatcaatgccagcttcgctgtttttgattgattgaatggttaattgattaggctcgcgtaaatcaaacggcaatgccttttcacgcgcgacctttgtgagggttatgcgaaccaggtcagagatggtcagccccatcccggccagtacgtccgctgcctgattcttcagatcttcatcgattcgggcgcgaacaaacgcgttagcagccattggggtatctcctgtgctgtatatttattcagcttgaattgtagctcaaatgagcaacagcgacaatccatgagtaatttaataaacggatgtttttacataattaactgaaatatatatgttaattttataataatggtttattaagtttgttcagaaacgatccgggatacactgcaacattaaagcatgaccagccattattgagtatgtccttgccgtcgattccatcctttgtattgtctggattactgttgatttgtttgccgttttc

SEQ ID NO: 942 - DNA, 1563 bp, Homo sapiens
tttcgccagcgcggatccttgaggccccgtggtgaagacctactaaaacacataaagttagctgggcgtggtggcgggcgcctgtagtcccagctacttgggaggctgaggtgggagaatctcttgaacccgggaggcggagcttgcagtgagccgagatcgcgcccctgcactccagcctgggtgagagtgagaccctgtgtcaaaaagaaaaaaaagagagagacatttgcattagatctttgaactgtttccgcttggcgtcttagaaaccttactcaacccagacagaaccctctcggggtgaagcttgcgccccgctgggacccggaagcagaaggaacagaaggaacagaaggaacagaaggccgtgcgggcggggtgtgaggcaggcgggggacgacccgccctgagctgcgctccccgcccgggcctcttccgcctccgtttcctcagctgccgggagctgcccggagaaccaggcgcctcccagttgctttcgcctcccgcgttgttcggccagagcctcggcgctgctgcgttttgactggagatctgaacgctgcgttaggcccctttcccgtgagcagcagaagccagttctcctgccttaaccacgggaatcaccgccaggcagcgggcggttccctggagggcagggagggctggggcctcttgaacccgattggcacacccatgcctgcgcctgctgccttgactctgctgagcatttctgatcagcaggacgagaccagcaactgggcgattcatttccctaccgcactgggcatcattgcagctcttaccggggatgcccctgttattggcctgaatgacatgatggtgcatgatgcagaacgcatttatgccgggattaaggcctcgtctctgatcaaacatctgcattatggatctgcctacacaatgggtctggacctgtgactaccggtgaagatatacctcgactacgggcctgctactgaaacgctatacccccatgcgggccttggagggttgtgacccttaattcccaggacagtccgaacttcatacatgcctgaacggacgacgtcctactgcgatcctaccattgaaagaggggggtttgctgatattggccaataatacaccgtgttactgaaaagctctttcaaactccgcatttggacaagaaaaatggcttctcccctcccaggggtaccggtttgcatttaccgtggattgcattagaataccgccatgaattcctgcttgaattatgaacccccaaccgtggaatttatgggcaaactcctgacgtcagcgtgagagttaattcatatggcacccacaggtattccttgtttaactataggaaggaaattctggaggcgcgaatctgtggatatctggggatgaatgggaccttaagtgggaagcagtggaaccggtctggaacaatttgtgcaaatacatgcagatgaattatggaagaagccaatgcctgtgacaaattggaggacacgccttgaagaacgctattgtggtcggattcatattagtttcgatgtatagcagactgca

SEQ ID NO: 943 - DNA, 2254 bp, Homo sapiens
  misc_feature (1)...(2254): n = A,T,C or G
ttcattattacttttttagacagggcctcactttttttcccaagctggagcacagtggtgcaggcatggctcactgcaggctcaaactcctgagctcaagcgatcctcctgccttggcctcccaaagtgcagggatcacaggcatgcgccactgcacccggcctcacttcctatctctgtggatttgcctgttctgggcatctcatataagtggtgtcatacgtcatattgctacgggggggtggggttggggtccttgtgcttagagctcccaagatggtggtgggctgtttccaagatgacggcaagcctcttgttctctgacctggggttcttggcctcacggattccaaggaatggaatcttgggccatggggtgagtgttacagctctcttagaagccgtgggtcacggaagagaaccgtggaacccagtgactagtgttcagctcgattaggaagaaccgggcacttagccgtgcgggaatgatgccgagcctttagcccgatcgggggcggcaatgggcgcctcgccggatcaggagcacagccgacaccctgccggatccagaggggtggaagtcagcggcgggcctgcgatggcagcaagcagcagtggtggatggcaagcaaaagctcagctcgagctgtaacaaacacagagcagaagagtgtgcagttggaagatttcatagagtgaaaacagagctcccataaaatgggaggggacccaaagggagttgccgttgccgttgccggctcgaatgcctgggtttgtatcccgatcattgtccctccccctgtgctctcaggtgatagatgattggctatttctttacttcctattttagcctaattagcattttagtgagctctctttactacctgacggggtgggtgtgagctaagttgcaagccccgtgtttaaaggtggatgcggtcaccttcccagctaagcttaggggttcttagtcggcctaggaaatccagctagtcctatctctcagtcccccctctcaacaggaaaacccaagtgctgttggggaggttggccgacgaccactgtaactgcttcctgctgaactggggcatagtaggggttgtgcagttgagatttcctcaggaggggtgtcttcaatgtcatcaacattggagcatgggctagcaggccgatccaggggtctgtggtggatcttagtcatggactgcatctgaggctctatttgaagaacgatttgtagttttacagcttcagttctggaagagacaaacttaacaaggaggttaaagatacagggattaaaatgtatggcctgtaatgtaggggattacttcattggcacaattcacaggccctgactatctgcttgatagttttgaaaaggcctggtccagtaaataatgatttggccatctgatgggtgctatcaatgcctaagtggaaggtggggtgaagggttttaagtaatttccattggttagctgcaggcaaaagtattttcccttctttggtggctagccatcctgaggggaggaaattatgtcctcctgaggttctccattgtatttctcctgctgagtactagggcttggtttcccggaggggattaccccatactaggggtccttctacaagcatttctaatggaaggtcccgccttgcggctcttttggcttcaatatctgcgtggtggttcccttctatttccctttcctttccgatgaccccagcagtgtaagactgctacctctttaggtttctgtacagccaataataatctcctaatggcttcctgatgtttgataggtgttccctcggaagttaggaattccctttctctccatattgctgtgtgggcatggaagactgggtaagcatacttagagtctgtatatatatttaccctttttccttctcctaattctagagcccgagtgagggctattagttctgccagctgagcgctagttcctggagtgaggggattactttttagtattccattatcactgaccactgcataccccgctttttgaagtccttttctacaaaggaacttccatctgtatacaagttgaggtcgggatcagtcaaaggaacctctagaagggtccctcgagcggcacaagtttgagcaattactttgtgacaagtatgntctatcttttcttcattgcctggaaagaatgtggcttggttaagagttgacaaattcacaatcttaccctggcccttaaagtattaaaccctgtat

SEQ ID NO: 944 - DNA, 1014 bp, Homo sapiens
cgcggtcgcggtccttccgccccgtggtgaagacggtggagtgcctgtcattccagtgatacggttttgctgtgtccccgccaaatctcatgttgaaggtaatccccaagtgtctagggaagacctggtgggaggtgactggatcatgggcccggcttcccccatgctgttctcgtgatagtgagtgagttctcccaagatctgatggtttacaaggggctcttccccttaccctcctcactctctcgcacctgccgccatgatctgtttcctgaggcctccccagccatgtggaactgagtcaattcaacctcttttctttataaactgcccaatcttgagcagttctttataacagtgtgacaacagactaatacacccacctactcgggaggctgaggcaggaggattgcttgagcccagcagtttgagactgcagtgagccatgatcatgccactgcactccagcctgggcaacagaatgagatcctgactctaaaaaaggaaagaaaagagaatgttgcatcatacaagtgtggctctctgcctttgcagccacacaattacatctgcctcagagtgagcctgattggagggtcgaaagcagacattgcggccgccactgtgccacctgcaagaatgtgtgtccctgagaacagaatcaacacaagagaaagcaaagaccagagagaacacagagtcccactggcagggagcatctagatccagctatacctgagccgaccaggctcctggacgtctcacctacataaggcgtaggctagtttgatttgtacatcattatgtgctcagaaacagcataacaagccagaacactgagctggaaagtgggccacgtgctgctcatagcagccggggaggggcagagaaggccaccacccaccttgtctgtccgggcgcagcgctggaaggacattttcctcatgtcctcaccatgattttcaggaatacagcctgaccggacgaaggcggacaccaagtcatcttcaattg

SEQ ID NO: 945 - DNA, 1706 bp, Homo sapiens
  misc_feature (1)...(1706): n = A,T,C or G
atttgatccccccgttgatcctcccccctcccgtggtgaagactcttggagtaagcaagaagaagctccctgatagctgtccagccagggttgaggtgaaggcacctcaagaagacaggggcacctgggtgtgtccagcaagactggagaagtctgaatggtggcacccaggtcaagctggcttctgtggcaggcctaagtgtgaactggaacattgcggagtggtgtggctcctcacccactggctcagtgctaaactgtgccaccaagagtccatctgcttcccttgaaaacttgaatgagatttttgctcctttatgacagaagttagctattaaatagattgaagcagcagctgcccccttgatgtgggacagtgtccaacctctcctcttggaacgctggcactgatttgggtgccaggtgccactcaccattgcgtttgcacccttgcttctcttaggggagaaagagcgaccacagtggggaacagacggggctgcagtggtggggctcactgcttatctttagtcctcctttcccctgtagatactggagtctgtagcccaggtctgaccctgtctcaccacaggattacccttgtctgctccatcctgtgcttcatcctgtcctgaaacctgactttcctcagtggccccttctgctcctcccctgctgtttctcatccacttgtgctcagcagcgtttgggttacagctcctttgagattgtggtacagcctcccagagagtttgcaaagccagaaaggcaactcaccccagagtgagagccaggtcctggccatctccttctctctcccttgagaccttctcacagtttcttctcttcgtgtgttcttagggagaatgttgagatctgaggctgttccctaccttccactccaggacttggtgtcatgttttctcctagctcctggcacaggctggcagcctccncagggcaaggactgtcttacccgtgtctgtctctactctcctgcagtagccccgggcctgacacacaaatggggctctgtgtctttgaattggatttacaagaggagagtttgcagttgaggtagtcctggaggttgataagaactactggctggggagggctgggtatttgcttctggcgaggtggtgctgcacaccctcattcagcaagggtcacagaatgcctcctgggctctgggcagctgggagcagggagttgtccctccatagggagagacgggcggaagccggaaagtccacagcgtgaatgttggcttcagaccttgctcttctgcctgctggctgcgtggccttgaacagctcacagatactcctgtagctcagtctcctagtccttcaaatggggtgtgagtagtacctaccccacagggcggccatgaggatttgagggatggcctggtctctccaagcgcccacacaagttagctgttgaggtcagcgatgatcggtatgttcctccctcagtaggtggtttagattacccacccactcccgtgtggcccaccctgggcacagcagtgactgaggacacatttctccagctgtgccatattgaatgtgagtcagctctgtcgtttgaatcagatgcggtgggtaatnngtactttcaaagttnnntcttttccaggtggctggttanagtgtcaataaaacagttatgtgtgccttcaagtgacttgattttaattt

SEQ ID NO: 946 - DNA, 1714 bp, Homo sapiens
cgcggtaccgtaccgaccctccgcccggagctgaagaccagccttaagagggcgtaatgcacacagcacagaattccctttgacggtttttagggaatttatggtttttggggagtttatggagtgcaggccccgtccccgggctttgggttgcactgattggttgtaacggcccctcccgcccagggcaccctggctggcgggtgcatgtgtggccttgctgtgccatggtggtggcgcctgggcctggcccctgcagatgaatgagggcccgacccccatactcatctgtgacccaacctgcatggggcctgggggcagggagagcaggtgtcatcagccccattttacagatgagaaaactaaggctcagagagtgtggataacctgtccacggtcacacagcacacggtcagtgatggagctgtggtgtggtcccagcaaccacgtctgacccactcagccatgcggggttcccctgcaccggcctcctctgggggctgaccctcggttggagtgacccccttgctccagcctcttccgcagggacactgccagatcccctgaatccgtctgtctgagcaactggggagagactgagaccgcgggaccccatcccactgcccacaggggaagacgggatcgtgaggaagataaatagcaaacacctgaacacatacacgcgtctcaggcggtcattatgtcctgaacagtaataactgctctattcgatcctaacagccaacagttatccagcactacccaaccatgcccacgtcattcgtgcccatgtccctcaggcactgcaaggctgggggtggtccctgctggagggtgcctggcacaaagcaggtgctcacaggcaactgagggttaaccttatgaagtgggtgttcttattactcccagtttacagatgagaacacggaggcacagggagttcggacatgtatcctcagctcagcccaggctgttggcttccgggtctccgcctgtgaccactgtgctgtgtgggggtgagggatgggctggagggctgatgaaatgggtgctcagggaacatcctgggggacacggaaggagctgtccaggtgatgcgtggggcggtgctcacatgctcacggtggtggggacagcaagtgcaaaggccctttggcagggaaaacacacagcgcagaggagcgggtgtgacagagtcaaggggcggcgtggagaatgaggtgggccacatcgcgtggagcccttggggccaacatgaagaagggacttgcttattactgcaaggtccacaggggaagccaggctccacaccccgtcctgtccctgccgtcctggcccactcagacggtgcccatgagggcccgaattccaaaagcgggtgcccaagagggccccaattccataagcgggtgcccagcaggcttccaaccactgcgtgaaaaaaacccccccctgcatgcgtctgacacctgcccttgcttcacaaacagggcaagcgtcccaccggaatttgctcgccaccaggggggggaaatttactcttgcccaaaatggccccgggaaaccccgagaaaaaacttgggtaaaagaataacccttcaggggcccccaaaatccttttccagactttcccccttatacgtgtaccccccaagaaaaccttaaagacctctccccctttaactatcgcatatcagaaagcttgtggggatct

SEQ ID NO: 947 - DNA, 1150 bp, Homo sapiens
taaaaaaacatttgaaccaaccgcgatccttccagccccgtgtgaagacttcacatcatgagatgtccacacagtaagatctcttccctgtattattttaactgcttcagatactaagattgctactgctgccactacccgtaaacaatgaggccaaccctttgccactacatcaatttccttactcaggtatgccacgggttgcaagctggtccctcggatctgtgtaaggactcctagagctattcctgttttttctgtgacatataaagaaacatataagcttattggcaagcttaacactggggcttgggttagggccttctttagggcccagaaagctgcttctgcttcaggcgtccatcttactaaatgggtattggctttctgagttttcttatttagtgtatctaatggcctggctatttcactgtacctgggaatccatatttggtggaagcctgttatgccaagaaccctcttagttgctttggtgttttgggatgaggataagccagtagaggctgcgtacgtttctcacggaaggccctggtgcctttggataattttagcgctaagtatttaacatgctgtgagcagagctgagcctttggtttggaaaccttgtagccacaggcggtgaacaaatttaagagcgcttgggtggggccgggtgcagtggctcacgcctgtaatcccagcactttgggaggccaaggcgggcggatcacgaggtcaggagttccagaccagccggaccaacatgatgaaaccccgtctctactaaaaatacaaaaaaaaaaaaaaaaaacaaaaatagccaggcgtggtggcaggcgcctgtagtcccagctactcgggaggctgaggcaggagaatcgcttgaacctgggaggcggaggttgcagtgagccgagatcgcgccactgcactccagcctgggtgacagagagagactctttctcaaaagaaaataacaaaacaaaataaaaagtgagccgggcatggtggcccaagcctttggtcccaaccactcgggaggtcgaggctctagtgagccgtcatcgcgccactgcacgccaacctgggcaacagagcgagaccgtcttcaccacggggctgaaggaacgcggtggctcaatgttttcaa

SEQ ID NO: 948 - DNA, 1343 bp, Homo sapiens
  misc_feature (1)...(1343): n = A,T,C or G
cttccgccccgtggtgaagactcaattactgagccccaacattacaacatagatgaacctggagaacatcatactcagtgaaagaagccagtcacaaaagcgcaaatactataggattctacttatatgaggttttcagaggagtcaaacccacagagacaaaagcagaagagagggccagcctccatggctcacgcctgtaatcccagcactttgggaggccaaggcgggcggatcacctgagctcaggagtttgagaccagcctggccaacatagcgagaccccatctctactaaaaatacaaaaattagccgggtgtgatggcacacacctgtaatcccagctacttgggacgctgaggcaggagaattgcttgaacccgggagtcggcaggttgcagtgagccaagatcatgccactgcactccagcctgggtgacagagcaagactctgtctcaaaaaacaaaaacaaaaacaaaaaacaaacaaaaaagaaagtagaagagtgggtgccaggggctgaaggaggggaatgaggaatgagtctttaacggggacagagtttgttttggaagctgaatgagttctggagctggatggtggtgacggttatacaacaattttttttttttttgagacagagtcttgctctgtcacccaggctggagtgcaatggcaggatcttggctcaccgcaacttccgcctccctggttcaagcgattctcctgcctcagcctcccgagtagctgggattacaggtgcgtgccaccatgcctggctaattttttgtatttttagtagagacagggattcaccatgttggccaggctggtctcgaactcctgacctcaggtgatccacccgcctcggattcctaaagtgctggggttacaggtatgagccaccgtgacaagggcaatagacttcaaaactattttggcaggcccatctataaatttagatttttataactagacacggagatttgtagtgtattctaaatagaagtccattccgttgtgatttattccctttacaaattcattagccaattctggatgagttttctacagtgaaaaccaccactgactactacccacacatccatccacctctgcatatcactcatcttctcttctctctcactctcagcagccggacagatctgcccagaatacacttgttcaaccactgcaggatctcactaataggaaaagggaggcctgtgagaacacgtttctaaaaattagatctgcttctttacgtacatctaaacgaagcgcactgagagctgtgagctcagccgtcattcgcccggggtgaaggatcgccaccgncccg

SEQ ID NO: 949 - DNA, 2691 bp, Homo sapiens
  misc_feature (1)...(2691): n = A,T,C or G
gcgcgtacttcaccccgtggtgaagatgtttttgtgtgtatgctaagtccacactcatcacaaatccaccaccctggacctgttttgtggtctcagctgcatggggctggtgacccagcactgttccttcagaaccacaaggctgagtactcctgtttgcgattggttttcacgtccaccctggacgctgctgctggcctgtgtggaagcacatgccaagtggtcctgtgacgccacattcctgtgcttgggactgaaccatgggattgggtgtgcacagagtggcccgccacagggaatggggatgtctctaaggagggacccagtgtagggtccagccctacagggcctgtgggttttctcttcatgtgcggagacaagagatcgtagaaaaataaagatacgagacaaagagatagaaggaaagacagctgggtccaggggaccactaccaccaatgggccgaacctgatagtggccccaaatgcctggacgcactgctatttattgtatacaaggcaaggggacagggtaaggagcgtgtgtcatctcaagtgattgataaggtcacgcgagtgacatgtccaccggacaggggtcctttccctttgtggtatgtgaggcggacaggaaggacagcatacgtcagcatttcttctatgcacttatcagaaagatcaaagactttaatactttcactaattgtgctactgctatcttctaagaactgaaaagcaggagccaggtgtgcaggtggagcatgaaagtggacaggagcgtgaccgttgaagcaccacagggagctgtttaagcccgctgatgactgcgggcaggcctgggtaatgtcaggcctcccacaagaggtggtggagcagagtgttctctgactaccctggggagagggagactccctttgccggtctgtgaagtaacaggtgccttcncaggcactggcgctaccagtagtccggggagccttcaagcgacccttatctgggcgtgacagggggctcacacccttgtcttctggtcacctctcacagtgtccttcagctcctgactctatggcctgatttttcctaggttataattatagaacagagattattataatagtaaagagtaatactacaaactaatgattgataatattggtatataattatatctatatcctatttctagtataacttttcttactctaattattttctttattacactggaacagctcgtgccttcagtctcttgcctcggcacctgggtggcttaccgcccacaacccaacgtttggcagacggggacagcagagccggagagaacagatagcttttctgtagcacgtatgaggcatcagtgaacgtgatacctgtcatccttgctcttccgagtgcctggctctgtcacatggctctcaggctgcctgaaggcattaggggcctatcagagacataactttttgccggtcaggatcctccgggaatctgaataaagctatggctctttttcccacaaatgcctagtttcaaaaggcacacagatccctggggatccatggatgcattctggagccgtcgtacagaggggagaacacaaagagggatccacaagttcactcctagtgggtgagaacacaaagagggatccacaagttcactcctagtgggtgagaacacaaagagggatccacaagttcactcctagtgggtgagaacacaaagagggatccacaagttcactcctagtgggtgagaacacaaagagggatccacaagttcactcctagtgggtgggggtgatgcatctgtggctcaaggtagagagttctgtgggtcttaactattttcattttctttttgattcttccatttacagctctctggttgttttcagggaagaaaagtaacaattctgtccaagctgatgaagagagcatttcaaaatagggtccttgtatttatttttatttctgctgttattagagagatggtttcattctaatacgttttctcacttgtatggggaaacctgcagaagtaaatccattaggccggcacggtcacacccgagtgccctgcccttcagatgaaaacacagtaacagtttaacatttttgttatttatttattcatttatttttgagacggagtttcactcttgttgcccaggctggagtgcaatggcgtgatcttggctcaccgcaacctcacctcctgggttcgagccattctcctgcctcagcctcccgagtagctgggaatacaggcatgcgtcaccacgcccggctgattttgcatttttagtagaaaaggggatattatatgatgaataggctgaatttttaactttagatacttaagggcacgtcgtggtattgggctgcggtggctcacacctgtaatgtgagctttctgggaggctcaagctcttatgattactaagtattaatgaattcggtaaccgtatattcttcctacttaaccctcttctcacacaactcaccacatcttgtcatcttttattattccccttcttccagtttctttagcacctttccccatatctctccatacaccattaccctcccttgactctccctatccctatcatcccctctatccttttatctacttactcatctcttactacaatattactcttatcctcacgctcatacactcctaatcctca

SEQ ID NO: 950 - DNA, 2170 bp, Homo sapiens
gtgcgcgtccttccgccccgtggtgaatacgcttctttcattttttgttttttttaaagatggggtctcttactttgttgcccaggctggaatgcagagtgcagtggcacagtcctagatcactgcagcttcaaactcttgggctcaagactcctgagtagctaggactacaggcatgtgtcaccatgcctggctaacattttaatttttatttttttgtagagacaggatcttgctgtgttgcccaggctggttttgaactgctgacctcaagcgatcctcccacctcagccttccaaagtgttgggattaaggcataagccaccacacctggtgatggctttttttcactttaaacattttaaataacatctgtctatttatatctctatatatctcacatatttatatctcatgtagggtgctaactataaaaatatccttttaaagctctaagttggctgggtgcggtggctcacacctgtaatcccagcactttgggaggccgaggcaggcggatcatgaggtcaggagatcaagaccatcctggctaatgcggtgaaaccccgtctctactaaaaattcaaaaaaactagccaggcgtggtggcaggcgcctatagtaccagctactcgggaggctgaggcaggagaatggcttgaacccgagaggcagaggttgcaatgagctgagatcacttcattgcactccagcctgggcaacaagagcaaagctctgtctcaaaaaaaaaaagaaaaaaaaaaatttagccgggcatggcgtgcacctgtaatcccagctactcaggaggctgaggcaggagaatcacttgaacctgggaggcagaggttgcagtgagctgagattgtgccactgcacttcagccttggcgacaagaccacaactctgtctcaaaaaaaaaaacacacacaatgagatatcagttcacacccatgggtactgttgaaagcaactaagggaaaagaacaagtgttggctgtggagaaagggaacgcgtgggtgctgctgttgggaaggtaacatggtgtggaccttgtggaaaatggtgtggaggttcctgaagaaattaaataacattccctacaatccagcaattccactcctgggtatatattccaaagaagtgaaggtagggacccaaacagttatctgtgtacccacattcgcagcagcatgattcgcggtagtcaaaggtggaaataaccatgcgtccatccatgggtaaatggacaaagaaaatgtccagctcaaggaggctcacgcctggaatcctagcactttggaaggctgaggcaggtggattgcttgaacccaggagttggagaccagcctgggcaacacagtgagaccttgtttctacaaaatatgaaaaaattagctgggtgtgaaggcgcgtcccaggtacttgggaggctgagaggtgggaggttcacctgagcccaggaggcggaggttgcagcgagctgtgctcctgccactgcactccagcctgggctacagagtgacatcctgtctcaaaaaaaagaaaaagaaaaaggagaaagagaatgtggtctatccatacaatgggtatcatcctgccttgaaaaggaagaatgttctgacacacaggaccgtaaaggccacagctcagccctggaaggactgtggaaaaatgaactcgcaaaaagcaggtgagaaggagtgtgcatgtttatggaacatgtgcattcagggagaatcacagagcgactgcccacaccctcagggaggtcagaagcaaagcaggttatgggaggtggggagaagggcagctctgttgaggggatacaccgggagaatgaatgtgtctgggaagagagagtaactcctagatggttctctctgaaggaaaagggttaactcgtaggtggttctctgagggaaaggatctgttcaggtgtagccacattcttgctcttccagggaggggaaggaataaacaattgttctccttggcgggtccggatcttaggcagataaagaagctttgactttgggagaagtggggggaggctggagagaccttgagcgtttctttcttcagttcagcgtgtgaaggtgccctattttgggatatcaattactgagcccacagatactgaaaatcatagtttcaccgggtagaact

SEQ ID NO: 951 - DNA, 1454 bp, Homo sapiens
accgtacttccaccccgtggtgaagactccttcctctcaattctgctgtgaacctaaaactgctcgtaaaaaatcatgttttttaaaagtttacatgggaagctattggcatgttattttacaaagacagaaactagccaactcttggttagcacagacttaaccctaacccttttccatctggtcaccatccttgccattaaagtaaatgctaaggacttaattactagttgctaaattattccttaaatcactcaattatattcactctacttagtgagacattttaaacgcaaaagttacagatacctaaacaaagcaactgttcagtgacagggagctgtttgaaccaactgccacacaagggccaccacacagccaccaccagccatgccacagactctgtactcacacggggaaaggcttaggaagagttactaaaaggaaaaatcagccacaatacagcatatgtagcaggaaggcactgccgtttacatttaaccaagatggaaaaggaaagaagatgaaagggacagagggaatggacaaagagagggaggaaagaaaggaaagaatgttttgaaaacaatggcctggcagtggttacctctggggcagcattacaggtgacatgatttgtgtgtgtgtgcgtttctaaatttcccaaatgttctataatgaacatgtatgaccaatacaaccaaagaaaagagtattttttaattaaaaaaaaaaaaaacttgataaagggctccgtgtccagtaatggccaagtacttcctatccggtcaaacataatccaggtaacaaggccgggcatggtggctcacgcctgtaatcccagcactttgggaggccgaggtgggtggatcacaagggcaggagatcgagaccatggtgaaactccgtctctactaaaaatacaaaaaaaaaaaaaaattagtcagacgcggtgacgggtgcctgtagtcccagctactcgggaggctgaagcaggaaaatggcgtgaacccgggaggcagagcttgcagtgagccgagactgcactactgcactccaacctgggtgaaagagcgagactccgtctcaaaaaaacaaaaacaaaaacaaaaacaaaaaacataatccaggtaaccataaactctagatgaaatacaaaaaaatatgaaaaggtaggccagtgatacaggaagggaagtgatattcgcaagaagggaatagaacacggtaaggtttccagtttcatggcatttggcatgagggcagccccagtctgtgctctatggaacggctcaaacctaaagacacatagcatctcactggcttgaacaagaggacaaagagcaagagacagatggaaaaggaggaggccccacattctctccctaacctccacctaaaccatgtacacaaaaacagagttttcaccacggggcggaaggaccgcgacctcg

SEQ ID NO: 952 - DNA, 1680 bp, Homo sapiens
cctttccgccccgtggtgaatacaggcagaggttgcagtgcacagtggttggccgggctctgtggctcacccctgtaattccagcactttgggagacggagacaggaggatactctgaggtcaggagttcaaggccagcctgaccaacatggtgaaaccccgtctctactaaaaatacaaaaactagatgggcgtggtggcgagcgcctgtagtcccagctactcgggaggctgaggcacaagaatcggtggaacccgggaggcggaggctgcagtaagccaaaatcccaccactgcactccagcctgggcgacagagcaagactctgtctccaaaaaaaaagcaatctattacttataactttcaccataaaagctgttataacaactgccgaagttaagcattattttcttaaacttttgtttcagtcagacactgcacgcactgcatgaacttctgtggaaatgtttaaagatgtttaaagaacacagaactgcgcaaagccacagtggtaactacaaaaaggaacaaaaggaatgtctacctgaggccagtcgcagtggctcatgcctgtaatcacaacacaggaaggccgaggcaggaggatcgcttgagcccaggagttggagagcagcctgggcaacacagcgagaccccattcctataaataataaaaaacttagcaagacaccattcctgcaaattataaaaaaaattattcaggccgtgaggtcaaggacacttacagccctcgatgttcgggaggctgaggtgggaggatctcttgagcccaggaggtggaggctgcagcgagcagtgtggatgcaccactgcattccagcctggaccacaaagggagaccacgcctcaaaaagaaaaaaaaatacacctacctgaatgtacccagaccctctaccttccagaaaaggaagtgggctgaggagagaatcctcacaactttaatacttagctctctgtccccttaacgctcacgacagcaggctcttctgagctgccccgagctgtccactgttctcagcaccgagcgtcagtacacctagctcatcttcacactctacttagcaggtgctgtgagcactcccatcctaaagatgaggactcaggcacccagcaagtgaaccccgccccagataacagcggttagcggcagggccgggcctgatggaaagcagcaggagctcgcgtgcagcaggagcagtgaaagctgcttgggcctgcacctaaatcctgccggacccgccgctacctgggcgaccgctcctgcacctaaacccagccggacccaccgcttccccggcggccgcacctgcacctaaaccccgcgggacctgccgcttcccgggcggccacacctgcatgccgtggtagcccttgcccgaataggccatgagcagcacgatcttccgcttgggcggcttctcgcgccgctcctcgtcgccaccgctcttgagcttcttcgccggatgttctccgtcctcccagacgcggtcgcccccggcccggccgctgcaggacctccggtcctgggggcatgcggctccggcgggcggcggctccgcgttcccggccatgcgcggcgagctgcggagaagggcggcgtgagcgggggcccgctgtcttcaccacgggcccgcaaggatccgcggtggcgcaattcat

SEQ ID NO: 953 - DNA, 2416 bp, Homo sapiens
  misc_feature (1)...(2416): n = A,T,C or G
tgtccctctctcgaggagcgggtcttcaccccgtggtgaagtatttttcaattgtataaaacccattacaatgagtatctaaatagcagaatcaaattactattccccaccgaaaggaaccaggctctttgtcgaaatggctgattccggggctggatcaaagaatatatatatatatacaaggtgcactttcaacagtttgtgccagaaaagaaggaagtcctccggaagtaagagaggtatgtcggaagtatactacagccagcttgaagaggctccaattggccaatcacagataacctgagcatcaaaataaataataacagaaccaccaggaggggggctgggcagtaaatgactggcaaggagcatcaggcaacttcatggagtgatagaaatggacatgttgaccattgtatgggttacatgggtgtatgtacttgtcaaaactctgcaaactgttaacactgaagatctgtgtgttctgtttttaaagtatgcctcaatttaatataatttaccatttttacagactaaagaagaaaaaccacatatcactgtcaatagatgtatttgacaaaattcaacatcaattcatgatatactaggagtaaaagggaattttattaccttgataaagaacatctgcaaaatctacagttaacatcttacttaaaggtggaagactaactgccttccccctagatcaggaaggagatcatactgggtgcccttgccaatacgataaaaaaaaaaaagaaaagtaaagaaataaaaagcatacagattgaaaaagaaaaaaaatcctgctctatttgcagacatgattctctatgtagagaatcccatggaatctacaaaaaagctcctaaaactaataaatgagtttagcaaggttgcagaatgtaggttcaaataatcaactgtatacctatatacttacaataaacagctggaaatttttttaagtactacttataataccccccaaaattggaatactgaggtataaacctaagaaaatatatggtatgctgaaagttacaaaatgttgatgaaagaaatcaaagaatactgaaataaatggagagatacaccatattcatggactggaagactcatattgttaagatatcactcctccctaaacaggtcaatggacgcaacacaattctaatcaaaatcccagcaagatgttttgtagatatcaacaagctcattctaaaatgtatacaaaaagggaaaggaaccagaatgaccaaaataattttgaaaaaggagaacaaacttggagaactcacactacttgacttcaaaacttacataaagctatagtaatcacaatagtgtgacactggcagagaaaaacacataaagagacgggaagagaagagaatccagaaacagaaccataaaagtatcaactcatctttggcaaaggtgcaagtcaactcaacatacatagatcgtctgttcaagaaatggcatggaacaactgaacattcacatgcaaatttcttatatttgccatgttacacaaaattttacgcaaaataaatcatagatctaaaagtaaaactataaaacttctacgagacaacacagaagaacatctttctgaccctggattgagcagagctcttagatatggcatcaaaagcaaatccataaaagaaaaaaacgataaattgtacttccacaaaatttaaaacttttgttctgaaaaagatagtcttaagagaagaaaaaaacaagccaaagacaggaaaaaatacttgcaaaacatgtagctgacaaaaaacatgtccatattatgtgaagaattttcaaatgcagtaataactctgaaaaaatgggtgagacatgaacagatactttgtcaaagatatacgaacagcaaatgaaaaaatgctcaactttattagtcttcagagacatccaaattaaaataaactagacctggaatgattaaaaaagaaaactgacaataacaagtactagagaagaagcaaaacgaagagaactatcatacattgctactgggaacacaaaatggtacaggcactttgagaaagtttggaagtttctttgaatctttttttttttttctttttgagacagagtctcactctngtcgcccaggctagagtcgcagtgnngtcgccatcttggctnncactgcaacctnnccgcctcccnnaggttcaaganngatntttcctgcctcagactcccaagtagctgggactacagcggcacgccactacgcctggctaattttttttttttttaagtagagatggggtttcactatgttggtcaggctggtctcgaactctctggcctcagctgcatctcccagcctcggcctcccaaagtgctgggattacaggcatgagccctgtgcccagccttt

SEQ ID NO: 954 - DNA, 2706 bp, Homo sapiens
ctcagcccgtggtgaagatcctggcctcacgtgatcctcctgccttggccgtccaaggtgctgggattaaatcactgtgcctgacccagtattttatttttaaagatggggtcagctaggcgtggtggtgcgcacctgtagtctcagctactcaggaggctgaggcaggagaatctcttgaacccgggaggcagacgttgtagtgagctgagatcatgctactgcactccagcctgggtgacagagtgagactccatctcaaaaaaaacaaaacaaaacaaaacaaaacaaagatggggtctccctttgtcacccaagcggcagcacagtggcgtgatcacagctcactgcagtctcgacctgctgggctgaagtgatcctcctgcctccgtctctcaagtagctgggacctcaactgcgtgcaccacacctggctccagtatttagagtgcatgtgtgctgttgactttaccagggggtctgtgcagagtgtgacaccactgtactcatttccgggggacactggccatcatgaatggcaactctggagacgagtggttagagggctgggtgggtagtcttcgtagtcttccttgctccaggcactgatgcctgctcccttctaccagggaagtgccccagcccttccagcaccaacgcaccaaacaaaaacatcactatatcagggcgtggtaggtccctcaggattccccgatgttccagacgctggccaagtctgtgttgccctctccgacgatcctagctgccgccggcataaacgtccacttggcggtgcacgggtagaaccacgatcctgctgacgtccggtcccacgtaacgatctccctgcatcaagatgcagatttctggctcatgatccccgaccctttacagtggaaaacgacccagcaaacaaggagggtgtgtaaaacttggaggcgcaaacctgaggcaaagcaaggtcacctctgcacacacagagcccacctcaggagcagtgcccagaagccatggcaagcacgaacagccacggcaaacacgggccacggcaaagacgagccacggcaaacatgagccacagcaaacatgaacagccacggcaaacacaggccacagcaaacacgagccacggcaaacacgggccacggcaaacacgaacagccacagcaaacacgggccacggcaaacacgggccatggcaaacacgagccacggcaaacacgagccacggcaaacacgagccacggcaaacacgagccacggcaaacatgaacagccacggcaaacacgggccacggcaaacacgaacagccatgcctgaacgggcccggttgcatctgattgcggaggctaagcagggttgggcctggttagtacttggatgggagaccaactgggagtatcaggtgctcgaggcttttggcaaaaaaaaaaaaaaaaaaaaaaagactacatacgtacaaaaacttttccatgtaaaaaaaccttcaagtcaaaacagcgatgacaaattggggcaaacatttacaaaataactaatacgagaaggctaagtcccctaacatgtagagagttgttatgattgaaaaagaactccatcgccacacacaggaatggacatggttgagttcacaaagcaatggaaacgcattttgaaacagaagggaaactgtgccatttgactcatcactgaagaaatgcaataaaaatcaagacctttccatctttctgatttagcaaagataaaaatgtttgcagacgctgcaccaggaggatgtgggcagcatctgcccgaggacggtcaccacagcactgacccggcagcaaaggccacctgcgacccggagcagccactggggagccctgcactgaaccgcagtgcgctgctgcgggaggaagccagtgtcttcctggagacggcttcacgtccaggtgcggaggggccgatgagcatttgtgggatggatggctactgcaagccgtgggcggagggaccctgagtgatgtcatctcagaaaccaacgcatcgggagatgcatagagtgctacatgaagttggccactggttgtgagaggaaccaggtatatggtaccgtgggggtgggggtggcacaggaaccctgcctgtgcagggtgcacgccatacgaattatagcctatgcctcagtccaggcctgtggaatttctgaatgggtgcggccatcttaggacgccttaaccgggactctaggccggggagggagactccacaaagaggatgcctggaccaatgccatataaggacagggctcgtgcggcaggaatgccctgtgggagcatttgtcaggggacgagagatacaagcccctcgtggaattgtttcgcgggaggcacagaaatggcaccacggctcaactaagacaaagctcaggtgttggagcaggaggccataaatccggggcggaagcgttgcgttttctaaaggaccacacaggggttctctttggccgttgggttataaggtcaaggctcacatttaggataggagagcgaacgctcagcgagaggtgcgctaacattagcgcacgaacatgcggatctagagggctaagacagagattcgaccccgctaggaggattacatacacgaagagagatataatgttagattaactagcggcaagcgttgaggtgttgagtagctaatagagcagctcacaaggagcg

SEQ ID NO: 955 - DNA, 1869 bp, Homo sapiens
gtacgcggatccttccagccccgtgctgaaggcgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtcaccacttgtcttcgttggcttgtcactgttttcagggttctgtcattttctttctcagccgaggcgcaggagcccagggcccctccacaggtgcccacaatggtcgacacagccctgggagcagagccccagggcagaagctggatgtgttgagggacaatgcaaacccctgcgccacaggaagcctctcccgccaggctgggggtcctgcacagggtgaagagagtccagagggcagggcatctgccttggtatagctttgggcacctgctttgactcctttgggggatacacctaggaggggctttcggggccacgtggagctgtgtgttaacttccaagaagcaacacggttcgttcactgcagcctctgagcagctgggcctccaaggccttgccgtgtggttttgatttgcatttccccgaggggtcatgacgtggagcatcacaggtacttggcggccatttgtgtgtctttggaggaacatctaaatcctttgcctccccctttttatttatttatttattttttaatttgaaatgagtaactctgttgctcaggccggagtgcagtggcgcgatctcggctcactgaaacctctgcctcccaggttcaagagattctcctgcctacctccaagtagctgggactacagccaccaagcccggctaatttttgtttttgttttgttttgtttttagtagagacggggtttcaccgtattagccaggatagtttcaatctgatgttgtggtctgcctgccttgaccttccaaagtgctgggattacaggcatgagccagcgcacctggctgtttttttttttttttttttttggagacagtctccctctgtcacccaggctggagtgtagtggtgcaatcttggctcactgcaatctctgcctcccgggttcaagcgattctccaggctcccgagtagctgggattataggccaagtgccaccacgcccaactagtttttgtatttttagtagagacggagtttcaccatgttgtccaggatggtctcaatatgaccccgtgatccacctgcctgcctcatcctcccaaagtgctgggattacaggcgtgagccaccacgccccaacttttttttttttttttttttttagttgaaatctcactctgtagcccagactggagtgcagtgctgcaatctgggctcaccgcaacgtccgcctcccaggttcaagcaattcttctgcctcagcctcccgaatagctgggactacgggcatgcgcccagctagttttttgtatttttagtagagacggggtttcacatgttggccaggctggtctcgaactcctgtagagttcgcatttttaaaactatatattgtttttattagataaaaataacttgctaaaaactgctaaccgcagtaagaaataatcttcaccacggggctgaagtaccg

SEQ ID NO: 956 - DNA, 1941 bp, Homo sapiens
  misc_feature (1)...(1941): n = A,T,C or G
ccgaccgtacctcaccccgtggtgaataggctgatgctgagagtgtgcccagaaccaggatttacatccatccaagggatgcacctgaagtttggttccagtgaattgtttttttccaaggaacaatttgtataaccatatggagacatttttgttttctgatacactgcagacttggaaaaggaaggtcaccggtcacacatcctatggctgtgttgacgtgaaatatctagaatacctacatccatagagacacaaagataagtggctgccagggcctgcggggtgacagtgaccaggtttctttctttcttttttttttttttgagacggagtctcgctctgtcccccaggctggagtgcagtggcgcgatctcggctcactgcaagctccgcctcccgggttcacgccattctcctgcctcagcctcccgagtagctgggactacaggcacccaccaccatgcccggctaattttttgtatttttagtagagacgaggtttcactgtgttagccaggatggtctagatctcctgacctcgtgatctgcccgcctcggtctcccaaagtgctgggattacaggcgtgagccaccgcgcctggccgacagttaccagctttcttttccggcgcattttgaactagatcgaggtggtgatcgtgaaacacactgaatgcgctcggtgccactgagttggatgcttaaaatgggtaattttatattatgtgaatctcacctaaaaaaacagaaggattttgaggaggggtgggggaatctgactgtgggctctgagatgggagacctcactcactgctggggggtacagagaatgtgcacaagaaagggaggctggggggagctcacacgtgggcctggcagagctggggttcccggcagtggcccttgcccacctgctgtgccgcccctgcagggacctgggatgtggtccagccttggggaagggggcagtggcggatcccagccttctgaggtgggggcggggggactcctgctccgggatcgggccaggctgtgtctgggcggccacacccagcgcacctgctcctcacacctgtgggcatcccgggccggctccccctgtctttcccactgtgggccgtgaggcctgggccacttccctttgcccttctcacaccgctgccctcctggtggattgggccgtggcaccagcgtgcatccagccttcccaccgctggcctgtgggtatcctgcccttcctgcaggagccagcctggcctcagcaccccgtggagggtgcaggcgtcccgggctgcagctctgagcttggcctgtggctgcttggccctgctgtggccctgctgtggccctgctgagggtcagatgcccgggccctggacctgaatgggaaccattctcagctgcaccccagtccgcgcacatggccatggggcaggggacagacgtgcatggggctgagtggctgcggctcctggagactttggagggaaccccatgggctgcatagaggatggaggatctgatgccacaaagggctcagagccaggcattcagcctggccagcaagtgactcagctgcggccctgccagccacaggcatgggtgggctcatgtccgttccctggttcagcacccgggatgtaacttttaaccatccttccatgccctccacacaccttgggccaagatcagtcatgtgagctcccacgtgagtcgtgccaggataaaaaaggggggaaagtgcaaaagtagactagttagttattcattaatttcgcgcatggctaacancgtccgtagaagtcctcctcttttttctttntatattgtgtatattgtatattatattaatcttaatatatagtttattatgttaatagtatattagattaatacactcagtattaatttactctattaagtgagctgacgtgtgtg

SEQ ID NO: 957 - DNA, 2905 bp, Homo sapiens
gggaagtgtagatgttgatcttcatgtttaatggttatgattttgatgaggcattgatgataagtatcgttggacatcggtccaagtatgagtacagtgacgactgatgaccctccgtggaagccgtgaactgcattctggatggccctggtagtcgataggatgggccaggctgggcggtgatcaggtgtaagattggcgcggctcgttatgagagtgtagtagagaggcacttccttattggctgcctttatagcttaagtagagatagttttgtcttgcgtaagagaaccccctcctggtttcccctcgtgcccctttccatgttcccatcctttccagctcctgattccccttttatcaggagaatggagaacaggcgtgggaaatggttcccaaaacgggggattgcgcagaattaattcttagaaatagaatggctgagttagaggttaggcatttaaagttgagttccataatgccaaattgcaaaaaaaaaaaaaaaaattgtagaccaaaaagttgtcacccaaaccaacgacatagcccataaatccgctggggaggaaaggttagctagatgggctgcgcatcggtcctgtggaacactgcacagaggtaaatatacctgtgctcaagggtgagttctccaaagattataattaagtaaaagcaaaatatggaacagggcactgtactgtctgtcgttttaagaaagcggtaggattgggatgtgtgtgtgtgtgaaacgcctgtaatgtgtacatggtcgttcctaactataatgacagctaactcatcacttaggccaagcagcgcactttccagcgattagtgcatccattcaatgattccacgaggcacttgctgttatgtccctgttttacagatgaggaaatcaaggcggagaaaagttggagaatgtgtccaaagtcacaccgccggcagccaaaagagcccgggggctcactcacagaagacacagccaacagcgattgctctgggagagaggaccggggaaaagttagtgctgttcaccgtacacgttgcgcgctagttggaatggctttcaccacgtgcaagcactgcttttgcaaatgcatgattctaaacaatgctcaccaacccagccttcagtacagtcctaaagtaacagcccagaaacacacacttcagccaggaccctccatgctgcctcccagagcagcccagcagctggacagcctgatgccctgggctggatcagcaagtcctggatgccttttacctgcacccagctcatcctccaggccgcaggacacacagactcccgaccctggactgggggccagaagccaccgagctggaagggacaagaggtctcctggcccaccatgtttgttttcccaataaagaggttccacagtgccccgtagtcagccatagcattcactcacatcctggagtgcctgctgcacaccggcctgcccagagagcacacgctgcgaggtaagtgctgcagttgacacagtgagaacaagacccgcctgcaggagctcccagcgcttaggggtgggggacaagaagagcaaagattgcaccacccgtggcaaaattgcaagagaaaaatgagtgaacaggtggctacgtgctgaggtgatcagggcagaccgtgagggccgagattgctagagatggcgaagcctgtactcctggaaagtactcagggaaccccagcccagcccaccctggcctggaaagccaagctaacggggtcttcaccccaaactcaaagaaatacccaggaagagtttaggagagggtgggatggcaagatgggatttgcatttggaaaccgttactaggcccaccgaggaaggacatgtttcttttttgttttgtgcggtcttattaaattttttattctttttataacttttaggttcagtggtgtgtggacaggtttgttatacaggtaaattatgtttcacagggtttgatgaacggattatttcatcacccaagtaataagcagagtacccgataagtagttttttgatcctctgtccctcctcccaccctcccaccctcaagtgggacctggtgtctcttgttcccttctttgtgtcctattttcttttttttttttttgagacggagtctcgctctttcgcccaggctggagtgcagtggcgctatcttggctcactgcaagctccgcctcccaggttcacgcctttctcctgcctcagcctcccgattagctggaactacaggcgcccgccaccacacctggctaattttttgtatttttagtagagatgaggtttcaccgtgttagccaggatggtctcgatctcctgacctcgtgatctgcccacctcggcctcccaaagtgctgggattataggtgtgagccacagcgcccggcccgtatattttcagtgtttacctcccacttataagtgagaacatgtagtgtttggttttctgttcctgtgttagttcgcttaggatgatggcctccaactccatccatgttgctgcagaggacatgatctcattcttttttatggctgtgtagtatttcatggtgtatatgtaccacagtttcttttttttgagacagggtctcactctgtcacccaggctggagtgcagtggctcaatcgccactcactgcagccttgactacctgggtttaggtgatcctcctgcctcaccctcccaagcagctgggattacaggtgcacgccaccacaccctactaatttttgtatttttagtagagatggggtttcaccatgttggtcaggctggtcttgatacacctgacctcatgatccacctgcctcggcctcccaaagtgctgggactgcaggcgtagccaccgctcttcaccacggggtgaagacgcgtcggtatt

SEQ ID NO: 958 - DNA, 3072 bp, Homo sapiens
  misc_feature (1)...(3072): n = A,T,C or G
gaagactctcactgaaataaaaaaggacgtgaggagggggaagaagggaaaggggaggacaagagcacaaagggtgcataggaagcttttgctaaagtcacttttcctgaacaccattgcccggtagtgtgggagtcccgccagcctctccaccaggcccgggtgagggtgggacggaggaggctgggagctgtggccagtgtggcctgaagacagtgggagacaggaactgctagggccagggacccaagctttatccagcatcttcccagcccagagagctccagcccttgaacttcagcagctcccaatgaggcccgagctggccaggagcctgcagccggccagactggttcctgcagaggcccttagagtgccccagggactttgcagcttgcctgtgactcagcctgacacaagcggtagccggccccatgatgggacagacaggtcaccagcctcacagcacgtctggaaggcaggcagagccgccacaggcaggagaatccttgcagggctgagtcagggccggggcaggctcctgctccccacgcctctgctctccaacgtggaatcctccaacatcctcaatgccctggttccaccaagtaggcgggcaaacctgccctccccgaatctgcccatctctgtaaatggtgcagttctacccaaggcccaacacccaggtgagtctcctgagctcacgccctccctcctccccaacatccagcccaaatgtccatctccttcacctcccttccctagtcctgccctcctgtctccatcccccgatcactgcgtctgagcccctgtcatctctgacctgcaccaaccccagacccctaatgggggcagccccttctttcctccccatcccctgcacctggcagccgcggggcctttgcactgacaggctctttgccactggagaacacgccctctcaaggctctccctgatgccccctagtcaagtgctgacaccaggggtccatggaccaaggttggctgcaaggttggccactgggtgcctgtgaacgtgcctggggggtcacctcttcctttttgctaacctccagcagaaatgtagtatttccttcactgatcctccccaggcatcatccaaaaaaggataccttggtagcacaaccactgggtttttttggtttttttttttgagacggagtctcactctgttgcccaggctggagtgcagtggtgcaatctctgctcactgcaacctctgcctcctgggttcatgccattctcctgcctcagcctcccgagtagctgggactacaggtgcccaccaccatgcccagctaattttttgtattttagtagagacagggtttcaccatgttggccaggatggtctcgatctcctgacctcgtgatccacccacctcggcctcccaaagtgctgggattacaggcgtgagccagcacacccggccacactgttggatttaaaaaccatggccgggcccagcggctcacatctgtaactccagcacttgggaggccgagacaggaggattgtttgagcccgggagttcaaaatcatcctggacaacatacggaaaccccatctctacaaaataattaaaaaattagcctgctgtggtggtgcttctgtggtcccagctacttgggaggccgaggcaggaggatcgcctgagcctgggaggtcgaggctgcagtgagctgtgatcacaccaccgcattccagtctgggtgacagagtaagaccctgtcaaaaaaaaaaaatcaatttatgatgttcatagcagtactattcataatagtaaaaaactagaaaagaggcgggcatagtgatgggcacctgtaatcccagtgctttgagaggctgaggcaggaggattgtttgagcccaggagtttgagaccagcctgggcaatgtagtaagaacctgtctctgcacaaaacagagaactagcctggaatggtggggtgcacctgtagtcctagctactcaggaggctgagatgggaggatcacttgagcctgggaggtggaggctgcagtgagctgtgatcctgctgctgcactccagcctgggcaacagactgagaccctgtctaaaaaaaaaaaaaaggtggaaagatcccaatcctcagttatatttttctgcagtggagtattatgcagcagcaagaaaaatgcatgggccagatggagtggctcatggctgggcatggtggctcacgcctgtaataccagcactttgggaggccaggagggtggatcatttgaggtcaggagtatgagaccagcttgaccaacatggtgaaaccctgtctctactaaaaatacaaaaattagccgggcacggtggtgtgtgcctgtaatcccagctactcaggaggctgaggcaggagaattgcttgaacccgggaggcagaagttgtagtgagctgacatcacgccactgcactccagcctggtgacagagcgagactccgtctctaaataaataaataaataaatgcatgaataacagcttcctgcaatcacaggatgcttctgaggtgacatcatgctgagtgggaaaaagtgaacccaggagatggcagtgggtgtgacatcctttttacaaagttaaaaacaattaaaaactaaacacgacaccgtgatgcacctgtgatggatacgtgtggcatgcccctagggctaaaccttcaacacaggaaggcaagggacggcagcacaaatcaaggacagtggccgcctggggagggagcgagggtttagaaggcgcagaggcagatggcagccatggttaacatcgagtgggctgctgaacccacggattttcattatgctacaaatcaaacaagtccaggcagtggggcgcggtggctcacgcctggaatcccagcactttgggaggctgaggcgggcggatcacttgaggtcaggagtttgagaccagcctggtcaacatggtgaaatactgactctaccaaaaatacaaaaattagccgggtgtggtagcctgtagnttcaccacggggtggagtacgcgtccttcatgtggagtagtgcagggat

SEQ ID NO: 959 - DNA, 3167 bp, Homo sapiens
  misc_feature (1)...(3167): n = A,T,C or G
ggacggtacttccaccccgtggtgaagatctgcctgccagactcaagtgattctcctgcctcagcatcccgagtagctgggattacaggtgcctgccatcatgcccagctaatttttttgtattgtttgtttgttttgagacggagttttgttcttgttgcccaggctggagtgcaatggcatgatctcggctcactgcaacctccgcctcccgggttcaagcgattctcttgcctcagcttcccaagtagctgggattacaggtgcctgccaccacacctgcctactttttttttttttttaatttttagtagagagggggtttcaacatgttggccaggctggtcttgaactcctgacctcaggtgatctgcccgcctcggcctcccctttgctgggattacaggcatggtgagccactgcacctggcctttttttttgtatttttagtagaaaaatggggtttcaccccccatctctactaaaaatacaaaaaattaatcgggcgtggtggtgggtgcctgtagtcccagctactcgggaggctgaggcaggagaatggggtgaacctgggaggcggagcttgcagtgagcggagattgcgccactgcactccagcctgggcgacagagcgagactctgtctccnaaaaaaaatgttctaacacctgagggcgaaatagggtttcaccatgttggccaggctggtctcaaactcctgatctcagtgatccacccacttcggcctcccaaagtgctgggattacaggtgtgagccaccgcgcccggccccaatagcttgtttttgtttttgtttttgttgtggagacagggtcttgctctgtcacccaggctggagtgcagtggcatgatcatagctttactgcagctgtgacttcttgagctcaagtgatctcctcccaggtaactgggactataggtgtgtggcaccacgccgtgctaatttttgattttttgtagagacactatctcactgtgttgcccaggcttgtcttgaattcttggactcaagacatcctctggtctcagtctcccaccgtgttggaattacaggtttgagacactgttcccagcctgtttctttttattgttgaggagtactccttggtgtgaacgtaccggtttgtctgttgcccgctgatggaccatttggattgtttccagttctttgttttccatctttttttttaataagggtaacacatgaacagttcacattgaaagatatccaaacaacacagaaatacatagagctcgttaagagttcctttgccctttctccccattcatcagctccccacagctaccaaatttggaattcatttttctgggtttctttccatacatcagaacatgcattctcagtgagggcgatatctccaacaagggagtgaaaattagttattggaagaagggtgaaaaaacttaggcattacagtgatttgtggcctcccgaagatcccagttcctgaacagatgtacagtgtggtatatctgtgtacagctgtagtattaaaattccatggggaggcaattaggagagaaacttatacagatgttccttagcggggccgtggaaaaataaagatcaagaaacaacagtagaatgatggattggggatttataaccttattatttggtgtttgatgaagcacttcttcagtttttcttgaacttctctcacaagctgaaatagatcccacctgttctagtataggagctttggttcataaggttaaggacccactactacctccatgatttaaaatccttggaattgtagcctgttaaatggaagggacattggagacattgaggggaggctttcctgttgatccaccattacagcaccctgacaggtcagttctctgtagtaacatacagtgtgataagccctagacaattttcaaattcagtttagcccacttggtatcattcggaatttatatatttcaggaactagtatggtacttctgtaatgtgccctttggtgggagaataatgaaggttttgttagcatatagatcttgggttagtagcttttaatttgttacgtgacatctagtgttatcatcttatattgaaagtattttttgtaacatttattatgaaaaatttcaaagatacacagagattgaaagaattttgtggttggctgggtggggtggctcacgcctgtaatccaagcactttgggaggctgaggcaggtggatcatatgagatcaggagtttgagaccaccctggccaacgtggtgaaactccgtctgtactaaaaatacaaaaattagccggttgtggtggctcacacctgtagtcccagctactcaggaggctgaggcatgagaatcgcttgagcccaggagacagaggttgcagtgagctgagattgcgccgcagcactcgagtttaggtgactgagtgagactctgtcttaaaaaacaagagaaaattttacggtgaacactagtatacctgccacttagtttccattaaacattttaccatacctgcttcatcatacctttttatccatttgtcttaaaattaaaaaaaaaaaaaccaacacatttcaaaatgtgtgtgtgtcagcgtctctgtagagagttgaattaaaattaggggccaggccaggtgtggtggctcatgcctgtaatcccagcactttgggagattaaggcaggagaattgtttgagccccagtagttcgagaccagcctggggaatatgttgaaaccctgtctatacaaaaaaatacaaaaatttggctgggcgcagtggctcgtgcctgtaatcccagcactttgggaggtcgaaacaggtggatcacttgaggttaggagttggagaccagtctggccaacatagtgaaaccctgtctctattaaaaatacaaaaattggccgggcgtggtggtgtacgcctgtaatcccagctactcaggaggctgaggcaggagaattgcgtgaacctgggaggcggaggttgaagtaagctgagatggtgccactgcactgcagcccgggtgacagagtgagactccatctcaaaaaaaaaaaagcaaaaaaggaaatataattcactcttgtacaattgacccattgagtattcaactatggttgcagttgcctcacgntgtcagtcaat

SEQ ID NO: 960 - DNA, 1877 bp, Homo sapiens
ttaaaaaccctgagccaccgcggtccttccagccccgtggtgaagacgcctggtcaacatagtgaaaccccatctgtacttaaaaatacaaaaaattagccgggcttggtggcaggcgcctgtaattccagctactcgggaggctgagtcaggagaattgcttgaacccgggaggcagaggttgcattgagcagggcttgtgccactgtactccatcctgggcgacagagagactccatctcagaaaataaaaaaataataattgaccagagtatctttaccaataataccttcatggagacagaataaggtaaaactaaaaataattctgaaaaccaaggctgagtgtgccgtgcctggaggagttcctgtgtcttctgcagaacccaggggcagcaggacccgtgtgtcctgagtcctctgggaagcaggctgagtgtcagccacagccggggagcagtcaacagggcgcacagtcctccctgtcagtgcttcttgagcagaagtttctcattttaatgaagtccagtttatccgtgtgttcatgtagatatccagttttctagcaccgtttgttgaaaagactgtctgttccccattggattgccttagaggctttggaacactgtgtgagcgtgggtctgattcttggtgcgcagctcagttcttcttatctgtgtgttggtccttacgccagcgctgcactgcactgtcctggttcctggagtcttggggcgtgtcttgaagtcaggtccttcacttggttcttctctctcaataatcttttttcaggctcactgatttttaaatttttttttctttttctttttttgagatagggtctcactctgtcacccaggctggagtgtggtggcgttctttcggctcactgcaacctcagcctccagggctgaagtgatcctcccatcccagcttcccaagtagctgggagtacaggcctgtgccaccatacctagctaatttttgtatttttgtagagatgaattttcgccacgttggtcaggctggtcttgaactcctgacctcaagtgatctgtgtaccttaggttcccaaatggctggaaatacagcataagccactgcgcctggtcaatttaaaattttttgtttgttttttggagatggggtctcattatattgcccaggctgattttgaactcctgacctcaagcagtcctcttgccttgacctcccaaagtgctgggattataggcatgagtcaccatgccccgactgattttttcacatctccacactgatgttacgcctatccaatgaatttttttttatttcggatgttgtatttttcacttctagtatctccatttcgctctttattttaatagtttctgttttgtcaagatttcttcttgtcttttattgcagtatatttttctttatgaccttgggcatacatattaaggtcactttaatatccttgcctgcttattctagtacgtgggtcatcttgaggttggtgtctgagtatggctcgtgttttttgtttgtattttggagtaattttgtttgtattttggagtaagtttgaattggattttgtacaattgtgcatgatatgtagaaaccctgggttctgttatattcttctgaaacgtatttattttctttaacacttaacttgattgaattaaaaatgcacactctggctgggtgtggtggctcacgcctgtaatgccagcactttgggaggctgaggcgggtggatcacaaggtcaggagtttgagaccagcctggccaatatggtgaaaccctgtctctactaaaaatacaaaaattagccgggcatggtggcgcacctgtagtcccagcttctcaggaggctgaggcagtcttc

SEQ ID NO: 961 - DNA, 3158 bp, Homo sapiens
agagccggtcgcggtagcgcgatccttccagcccgagggtgaagacagtgtgaggtcagagtctgtctagcagcataaaaacaaccaaaagattttctgagcctcagggcacatgggtggggcccagagagcacccaggaccgaagctgcccaggacctccctcaagcgccccaggctgtccccactcccactgctaggagcctgctccagggccaagggtgaggcccaccctgcctggtggctccctcatgcccctccggcacccccaggagtgagggtgggctgccaagcttcccttcctccacttccttctctaacatgcccacccctccttttttttaaacaaagaggctggaggccctaggatccagcctggtggctccgagatctacctaaagcgccctagtggaggacaaagattttttcaggagatcagaactctgacttctgcagctctctggggctgggctgtggaatggaagcagcttgggacaggaagcgggtgtggctcctcctaaaggagctacacgttgttttgttctcttttttgacagactctccctgtgtcaccaggctggagtgagttacatgatctcggctcactgcagccttgacctcccacactccagcgatcctcccacctcagcctcctgagcagctgggactacaggcgcacgccactccagctattttttttaatttttgtggagatgggggtctcactatgttgcccaggctagtctggaactcccaaactcaatgaatcctcccgcctcggcctcttgaagtgctgggattacaggcatgagccaccaggcacagctaacttaatcctctgagaggtctttttttttttttttgagacggaatctcactctgtcacccaggctggagtgtagtgatgagatctcagctcacagcaagccccgcctccagggttcacaccattctcctgcttcagcctcccgagtagctgggactaaggcgccgaccaccacgcctggctaattttttgtatttttagtagagacggtgtttcaccgtgttagccaggatggtctcgatctcctgacctcatgatccgtccgcctcagcctcccaaagtgctgggattatagatgtgagctaccacacctggcccatcctctgagaggtcttcttatcgtccctcccattttcctgaggggataacagatgcacagaggatctagccgaggctccctgtggcacctggaggggactcaggcaagttcatgctctcagctctctgacctgccctaggattcaacccacccaggtaggggagaatccgggtggcatctccaggcttttggcgcctatctgtgaccactgtttgggaaaatgatctggaacatgtgaacaatgatgcggctcacacttggctgtcacgtgggagcctcatttactaggtccacccacgaattgcttaatgatctaggacaggctggcgtgatggtttacctgtgtaatcccagcatgctgggaggctgagttgggcagattgcttgagcccaggaatttgagacaagcctgggcaacttagtaagaccccgtccctactaaaaattaaaaattagccaggcatggtggtgcacacctgtagtcccaactactcaggaggctgagtgggaggatcacttgagcgtgggaggtcaaggctgcagagagctgagactgtggcactgcactccaactcaggaggctaagtgggaggatcacctgagcttgggaggtcaaggctgcagtgagctgtgactgtggcactgcactccagctttcatgacaaagtgagaccctgtctcactctgaaaaaaaaaaaaatctaggacaagagtcagcaaacaaccgggcacaatggctcacgcctgtaatcccagcactttgagaggccgaggagggcagatcatctgaggtcaggagttcaagaccagcctggccaacacggtgaaaccctgcctctactaaaaatacaaaaattagccgggtttggtggtgggcacctgtaatcccagctgctcgggaggccgaggcaggagaatcttttgaacctgggaggcggaggttgcagtgagcacagattgcagcattgcactccaacctgggcaacagagaaaaaaaaaaaaaaaaaaaaaaaaatcagtaaacgttttcagtaaacctttcctgcaaaggtccaggtagtatatacatcttcagctctgcagccacacaggctctatcgcaactgcttaacactctgcaatggtagtgtaaccgcccaaggggttcaccttgcccactgctgaagcatagctgattcgtggagacaggggaattgcaatcgagaaagaataattgggacgggtgcggtggctcgtgtctgtaatcccagcactttgggaggccaaggcaggtggatcacctgaggtcaggagttcaagaccagcttaactaacatggcaaaaccccgcctctactgaaaatacaaaaattagccggtcatggcagtgcacacctgtagtcccagctactttggaggctgaggcaagagaatcacttgaacccaggagccggaggtggcagtgagccgagatcgcaccactgcactccaacctgggcaacagagcaagactgtctccaaaaacaacaacaacaacaacaacaacacaacaaaaaagagtaattcatgcagagccggctgtgtgggagaccagagttttattatcactcaaatcagttttcccgagcatttggggagtagagtttttgttttttcttgttgtttttttcacacacaacgtgggtgaatcttgaaaacatgattcttgtgaaagaagacagacgcaaaaagacatattgagataaaggactagctggatttcctaggccgactaagaatccctaagcctagctgggaaggtgaccgcatctacatttaaacacggtgcttgcaacttagctcacacccaaccaatcaggtagtaaagagagctcactaaaatgctaattaggctaaaaccccaggtaaagaaatagccaatcatctaacacctgagagcacagagggagggacaatgattgggatataaacccgtcttcaccacggggctggaaggatcgcgcgtattgaagacggggctggaagggtcgctcaaat

SEQ ID NO: 962 - DNA, 2708 bp, Homo sapiens
gaacgccagcgcggatccttgaggccccgtggtgaagactcagaaggcccctccctttcctccagggccactgcagttctgactcaggtggggaccccttcctcactctgctcttggttctaagttgtgttttctcttttccccaatctttgggagtcatattttcatatcttttttttttttttttttcctttgaggtggagtctggctctgtcacccaggctggagtgcagtggcacgatctcagctcactggaagctccgcctcccgggttcacgccattctcctgcctcagcctcccaagtagctgggactacaggcgcctgtcaccatgcccggctaattttttgtatttttagtagagactaacaatacatttagtagagactaacatttcatgttagccaggatagtctcgatctcctgacctcgtgatccacccgcctcggcctcccaaagtactgggattacaggcgtgagccactatgcccggccctccagatgcatttttaacagctgaattcatgtgtgaaatgacgtaaggtccgcgtagtccttctttctcagagaccagcgtgcgaggcccaagggacccaccttccgtcacccgttctgctttgtttacagggtgtgtccgcagccggccaggtggtatccctgaaggtgtggctgattgacgacattctagaaaagatcaacagccaccttccctctcacattcggattctgggtaagccttgcagtgcaggcggccacacacctggttgtagatggtcttgcagagacacgaggctatgcatgctcctgccttttccaactgtctctgatgcagaagcgtagtcagagttgctttgcagctggttctgaccttcagaaacgggagccactagacaggagtagaaagctgttcatttgcagtgcttgttgctacacgggcgccttgttttaagcaaacacaggatgtgaaaatccaaattcatggttaaaatgaacagttgttccctcttacggcaggactggtaaatggaatttttaggcctccttaaaatgtgactgtctaccttttaagtggcaggtacaggcaacttacataatacattcgttcattcatttattctgtttgttttttgagagagtctcgctctgtcacccaggctggagtgcagtggtgcaatcatggctcactgcagcctccgcctcccgggttcaagcagtcctcagcctcctgagtaactgggactacaggtgtgtgccaccacacttcatttttgagtttgtagagatggggtctcattgtgttgcccaggctggtcttgaactcctgggctcaagtgatcctcctgccttggcctcccagaagccgcttatatttaatgtaatgataggtgtggctgggcgtgaatctgtcgtcttgctctctgttttcttttcctttttgttttggtgtcatcccaagaaaacagaactgttgtctgcctgactggtctgcttggagagaagtgtttgagacagggtcttgttctgttgccgaggctggagtgcagtggtgtgatcacagctcactgtagcatcgaccacctgggctcaagggatcctcccgcctcagcctataagctgggactacaggcacacgccaccacagccggctgaatttttatttttatttgtagagatggggtttcgccatgtcgcccaggctggtctcaaactcctaggctcaatcagtttacctgcctcagcctcccaaagtgttggcattacaggcatgagctgctatgcccagcccacagcctgattattttaagattcatccgtgctgttgtgtatgtcagcagtctgttccttctcattgctgcggggtgttctgttctgtgggtgtgccacggattgtttatacagttacctgctgaaggacattggatgatttctagttttgggctgttagaagtaaagccactaagaacatttacatatgagtcataaataggattcagtaatccctgttgattttacccactgttaagtttttgtttttatttttatattttttatgatggagtcttgttctgttgcccaggctggagtgcagtggcgtgatctcggctcactgcaacctccacctgcctcctgggttcaagtgattctcccacctcagccttcccagtagctgggattacaggtacacgccaccacgcccagctaatttttgtatttttagtagagatggtgtttcaccatgttagtctcaaactcctgacctcaggtgatccacccacctcggcctcccaaagtgctgggattacaggcatgagccactgcgcccggctgcttttattattttaaattcacacataattatacatacttatgtagaattatgtgtgatatttccagtcatgtataaagatcaaatagggcaattagcataatatatccatcactccaagcatgtatcatttctttgtgttggagacattccgtatcttctcactattggaaaattacaataaatggttgtaaattcagtcaccttatagagcactgcacctgtccctcctgtccatcgtcctcctgtgcctgttccccagcctgtggctgccccctccccagagaagccgatgcttgctggagcttggtcggtgctctgggtaaggagacgctggggctcacgccgtattcaccacgggcggaaggaccgcgacccctct

SEQ ID NO: 963 - DNA, 3650 bp, Homo sapiens
  misc_feature (1)...(3650): n = A,T,C or G
ggcgggagtcgcgatcctccgccccgtggtgaagacaggtaaggcctctgggctgcggtctgctggggaccgggctgggggactgtggccccaggtgctggatcccctggtgagcactggtgttgagcctgtccaggctggggtctactgggcccctggagactccaccctgggtccaggcctgggctggtgctggctcttgctgtgacttccccagctgtgagaccggggagggggtgtctgggccgcagggcgccccagggcagggctgagttctcctgaacaggcatcccctccccgccgggcgtcagtcctaggggccctgcctgagtccggcgtccccggctggccctggcagcactgccggcctggcccacctgtctaggccgtgtgtttgttgacattgctcctgcggccggcattggccggcctcgctctgcgtcagacggggcgggggaggggccgccggagactcctgctcgctggcagtcagggccgggccggggcacaggcggctgccgctggctggccaaggagatgacctcgggcccggctggccccaagaagcaagcggtgggaccagctggctttcgtgctgcctccgtgtcccggggcccagggcaggcagggctggggctgtgggagccagggtgccgtcctggggaccaggaacctgaggcgggagatccgccccgccaaagtgctgactaatggctctgtgacctgtttactgagcccagggcccagcccctggctgagggaagggctggcaggccgtgttttggtggcctcctccgtccgcctctcagagctttgctgtggccttggggaccgaggcttgtcacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcatggctctgggagccagcaaggagtggacagctgtccctggccaggcagcgactctgagggactccccctccaccctgggctacactgcctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggcaactctgcggctttctctactcaggaagcacttggagccgccagctgcaggcgctcctgtctccgggcaccgggctctgctggagctgcagcttagcctgccctcgcccccacaggcgtggggattgttgccctgtgtcggtaaggcaatgtttgaggcaggcacccaaacccaggaaaaaataactgggttttaaaaatggacaatgaacgatttgggtgataaaagaaaatcctcaaacattacgggagggagtgcggtcgaggctagagtcctgcccccgatcgagtcccgctgccctccgttctcaggcccctgctttagttgtttccgggccaccggggacagccatccttacaaggcgatgtgttcaccggtgtccttccccgccacacccacctctctgcgccgtgaattttgtcacttaagagtatagtttgcactccatccagcctgggcgactgagcgaggccctgtctctaaaagagtagagcttggggaaggttctgtgctggctcaatccatatcagaaagtttacccctcggccaggcacagtggatcacacctgtgaccctagcactgtgggaggccaagacagaccagcctgggcaacatagcaagactcgctctctctaaaaaaaagaaaaaaaaagaaaaaaaattagccaggcatagtggcatgtctcagctactataaaggttgtaggaggattgattaaacccaggagtttaaggctgcagtgagccgtgatgttgccaccgcgttccagcctgggcagcagagtgtaaccctgtctcaaaaacacaaaacaaaaccctcaaaaagtttacccctctctgttagaggtcaccatctgtaagcacagtggtcgagagccaggctgacgctgatgaggggcccagtcctggctgccatatgtgcacacacagcttctttagtttgcggtcctatttcttcctctgtgaagcagaaagcacgggctgtgagggctgtgtgagggaggagggagtgctctcgggttggaggagccatcgtggaggtgctagctgctggcctgattgggtctgccgtggtgattttcagccatggcgtgcctgttgcccgagattccataactgatttcaccaaggccctgtaggtgggacatgaggttattttgggatgctggtacatcagggtggttgtgactggatccttagaagtagaatccttgggtaggagggatgctggtttttaatttgggtagctattgccaaatggacctccggagaggcaatgccactggtctctcagcctgtctccaagcatgtgtctccctaggtccttgccaggagggtggctctcagaggtttccatcgtggctcatgtgagaagtagaaaatgacatctcttatggttttgcttttcttttttttttgagactgagttttgctcttgtcgcccaggctggagtgcagtgacacaatctcccctcactgcaacctccgcctcctgggtccaagcgatcctcctgcctcagcctcccgagtagctgggattacaggcgcctgccaccacgctaggctaatttttgtattaaaaaatttatacaattttcgccacattggccaggctgatcttgaacgccggacctcaccttcgacctcccaaagtgctgggattacaggcatgagccaccatgcccagcctgcntgatatatttctatattttatatatacgtttttctgagatgtagtttcactcttgttgcncaggctggagtgcagtggcaccatctcgactcactgcaatctccgcctcccgggttcaagcgattctcctgcctcagcctcccgggtagctgggattacagacatgcgccaccacgcctggctaattttgtacttttagtagagacaaggtttctctgtgttggtcaggatggtctagaactcccgacctcaggtgatccgcccacatcggcctccgaaagtgctaggattacaggcatgagccaccgcttatggcctatttttatatattttttaaagagactgggtctcactctcttgcccaggctggagtgcagtggcataatcatggctcactgcagcctcgaacacttgagctcaagagatcctcccacttcagcctcntgagtagctgggactacagatacgcaccaccatacttggttaggcacatatttctggcaagctcttggtcccttttgtgccaaggcctggaagggtaccatgcttaacaccatggcccctgagccattctgccatttgctggatcctagctccaacatttacctgtgtgacattgggcatcttcacacgggctgagtcg

SEQ ID NO: 964 - DNA, 4181 bp, Homo sapiens
ccgacgcgtacttccagccccgtggtgaagacggggacaggagctccaggtgggggcagttaacaatgcttattactttcaaaacaagcttctgttcctgatcttactaaacaaacattatgataggagattagtgtgaaactggcacaaaagctaaattaacataggtagagtatattcgggattatttccttacaatacattcccagagtgtcaaaggagatcagtaagagaaaatgagggctagaaagaaactctctcacatatagtaattcagaaaaccaggggaaaggtaagggttaggaattttaaagttatgtcataaaaacaaattaatgcattgagaaattcaacttaaactctcatcacaaaccatacatcaaaataaattacatggtggggtctggtggctcatgcctgtaatcccagcactttgggaggccaagataggcggatcactggaggtcaggagttcgacaccagcctaaccaacatggtgaaaccccatttctactaaaaatacaaaaattagctgggcgtggtagcacacgtctgtaatcccagctacttgggaggctgaggcagaagaatcgcttgaacctgagaggcggaggttgcagtgagccgagactgagccattgcactccagcctgggcaacaaaaccaaaactgtctcaaacaagcaaataaataaataaataaataaataaagcatttttataagctaactttccaagttttacatttaatgtaaaaaaaaaaaaagaaagaaagaaaaatcaaaacgttccttctggtaggtgacaggaaaaaaaaaaaaccaaaacattaaaaaaccgaacacaaaagtgagtatttactaaatctctgaaggaaattcaatttcctaaccttaaaaataataaagttgtaactgaaaaaatagaaagatttgaagataatttttaaatgtttaaaactcaaaaagtaaatcatcaaaatctaaaaccaaattatcttggaaagaatatttgaactaggtacgacaaaaagctattaccaataccataaaaagcactcatacaaatcggtaagaaaaacattaaaatcccagtagaaaaattaattaaagacaaaaagaggctgggcatagtggctcatgcctgtaatcccagcactttgggaggctgaggtgggtggatcacctgaggtcaggactttgagaccagcctgaccaatatggtaaaaccctgtctctattaaatacaaaaaattagccgggcgtggtggcacatgcctgtaatcccagctacttgggaggctgaggcaggagaattgcttgaacccaggaggtggaggttgcagtgagccaagggcttgccactgcactccagcctgggcaaaggagtgagactcctaaaaaaaaaaaaaaaaaaaaggacaaataaagacagttcacaaaaggagaaaagcatgtacttaaccagcttataggaaaatgaccaaccttgctactaaaaagaggaatacagactaaaataaatatttccctagatccacttagccaagacattaaatcagacaactggcactccactaatcctgctaaagggaattacagaagcaatttgggaaggtgtagaaaagatttcaaatgggttcagaacccaaaaaacgccctgtaggagtagactgcatacagcagtaggaaagtggaatgaacccatgtgaccccaaaacctttggcctagtaaccctacttctagaaatctacccgaaggaaattaacctaccaacctaaaaaactgtacataaacaatactcactgtagaataacaaaaaaaattaaaaagcataatcagaaatttccaatgttgaagttctagatggaaaataagtaataaaaccaaaatttccagatacattaagtgaaaaaagcaggttaccaattgcataacacaatcactaagttaaacatacagaaaaggacccactgaaacgtatcagaatattaaaactgaccttcccctgatgagcagacacatcaaaccatgatacagccatacaacagacacaacccagcaacgccaaggaacaaaccactgacacacccacaacacagttgagtctcaggtgcaagatgccaagtaacagaggccgagggctgcgtgggtcactggcatgacattccggacaaggagaatggtggggacagagactagaacagaacctgacaggggctgaaggcggagatggagctgactagagagatgcatgaggaaatggggaagtaaagaaccgtagctacagcttgatttgtgataatggttacaagatggaatgtgtctctcaaaagtacacagatgggctgggtgcagtgactcatgcctgtaatcccagcactttgggaggccgaggcgggcggatcacctgaggtcaggagttcgagaacagcctggccaacatggtgaaacccccgtctctactaaaaatacaaaaattagctgggcatggttgcatgttcctgtaatcacagctactcgggaggctgaggaagaagaatcccttgaacctgggaggtggaggatgcaatgagccaagatcacaccactacactccagcctgggcaacagagcgagattctgtctcaaaaaaacaaaaagtacacagatggcaacattaaatggactaagaaaaaaaattcaaccatacactaaaaagcataaacttggatgagcacgctggctcacgcccgtaatcccaacactttgggaggctgaggcgggtggatcacctgaggtccggagttcaagaccagcctgaccaacgtggagaaaccccatccctactaaattgcaaaaattagccgggcatgatggcgggcacctgtagtcccagctactcgggaggctgaggcaggagaattgcttgaacccaggaggcagaagttgcagtgagccgagatcacgccattgcactccagcctgtgcgacagaatgaaactccagtctcaaaaaaaaaaaaaaaaaaaagttttatcaccgctagggactgttatgttaaaccccgaatgtcttactttattggtgattgaagaaatttccaagggtgactttggctggacccctcacccatgtgagatgcaaccccaccctccctgggcctaactctcctgccatggacatctagacagcttcctgcctttcactgtcggcaaggatgctgctgggaaactagagtttttcccctttaaaaagattccttctggggccgggcatggtggctcgcgcctgtaatcccagcactttggaaggccaaggtgggtggatcacttgaggccaggagttcgaggccaggagttcgagaccagcctgggcaacatagtgaaaccccatctctaccaaaaaatacaaaaattagctgggcatggtggtgcacacctataattccagctattcgggaagctgaggcgggagaatcacttgaaccaggaggaagaggttgcagtgagccgagacggcgccattgcactccagcctgagcaatagagtgagactctgtctcaacaacaacaacaacaaaaatattctttccttctttaggacagatttatagtagttttactgtatcatttctaaggttcttaaactgtgctaataaaattgttctccaaagattgtctccttcacctgtgtttagtaaggctggcttttgtcagaagccatttgctttgatgtttcctggtgcgtggcttggatcactgccctgtgtgtccctgggtgtgacccgtgtctggatcgttcagctatctgagccctaatgcaagctgagagggccaggtcgctccaccagcttcacggaaccagacaggcactgggggctgtgagtgagaagggggctaggcagggaaagggcttgggaacggggcgctgacgaggccaggcaggtcactgggtgggaggagtcgctaagaatgctgaaaacttccacctcagggccaacatttggggttttacttggcttgaataagtgattcactcacgtggctacacaggaatttcttgtgaatccttccaagttcctttgtataaatacaagcaaatatgcaaatatattctccccctccagccccaatacacatctttatacacggaaagtgtgtgtcttcaccacggggctggaaggagccgcgcaggcgttat

SEQ ID NO: 965 - DNA, 3067 bp, Homo sapiens
ttacgccagcgcggatccttgaggcctcgtggtgaagcacgcgtggggtacgtacctgtaatcccagcttctccgtctggaggctgaggcaggagaatcgctggaacccaggagccaagatcgcaccactgcactccagcctgggcaacagagtgagactccgtctcaaaaaaagaaagaaaaaaaaaagtttaggtcgagtttggtggctcaagcctgtaatcccatcattttgagagaccgaggtgagtggatcacttgaggccaagagttcgagaccagcctggccaacacagtgaaacccccaactctaccaaaaaatacaaaaattagtggggcgtggtggtgcatgtctgtagtcccagctactcaggaggctgaggcaggagaattgcttgaacctgggaggtggagggtgcagtgagccaagatcgcaccactgcactccagcctgggtgacgtagtgagaacttgtctcagaaaaaaaaaaattaacaacagctttattgatataatctacatactatacaattcaaccatttaaagtgtacaactaaatgtttttcaggggcctggtgtggtagctcacacctgtaatcccagcactttgggaggctaaggtgagcagatcacctgaggtcaggagtttcagaccagcctggccaacatggtgaaaccccgtctctactaaaaatacaaaaattaggctgggagaggtggctcacacctgtaatcccagcactttgggaggccgaggcagacagatcatgcagtcaggagttcgagaccagcctgaccaacatggcgaaaccctgtctctactaaaaatacaaaaattagccgggggtggcatggcctgtaatcccagctactcaggaggctgaggcaggggaatcgcttgaacccaggaggcggaggttgcagtgagtcgagattgtgccactgcactccagcctgggcaacagatggagacgccatctcaaaaaaacaaaaaaaagcaaaaaacaaaaattagcttggcgtggtggcgggcacctgtaatcccagctactcagggggctgaggcaggagaattgctccaacccaggaggtggaggttgtagtgagccaagatcgcgccattgcactgcagcctgggtgacaagagggaaactctgtctcaaaaaaaaaaaaaaaaaaaaggttttcagtgtattcacagaattgtgcaaccatcaccagcctgttttagaatatttttagcacttcaaaaagaaccttgcagccatcagcagtcactcctcatttctccccaatccccccagccctaggcaaccactagtgcttacgaatgtacctattcaggacatttcacataaacgggatcttaggtagatgctgaaaaataggattgccaggttgcatgttcagccttttgaggaaaagccaggctgttttccaaagcgctgtaccattttacatcccacctgcagtgtaagagcgttccaatttctccaacacccctgactcttgccaacacctgtgctgtctgcttgattacagccgtcctaacgggtgtgtggtgacgcctcactgtggtttgcattgcccttccctgatggctaatggtgttgagcctcttttcctgtgctgattggcacctgtatatgttatgtggaggaatgtctattcagatcttttgaccattttttaatcgcgttattttctttttattactgaattgtaagagttccttacatatgctagatacgaatcccttaccagatacgcgatttgccgttttccttccattctgtgagcttttcactttgatgtgtcctttgatgcacaaaagttgtatgttttgatcaagtccaatctgtcattttttctctcgttgctcgtgcttctgtggtcctgttgaagacaccacggccaccacgtttgcaaaggtttagcttctaacggtggtccgtagcttccactcttacatgtcggcctctgagccagtctgagttcacttttgcacatggtgtgagggaaggatgcagcttcgttctttacacgtggccacgtgccttcccagcaccgcttgtcggaatcagcacttttttctcccctgaattgcctgggctttcagttctgtcccatcggtcagttctgcacggtccgggtccctgcgctgtccagtaagttttccaactgtgaattgtgagtcttccaactttgttctttttcatgagtgttttggctattctgggtacaaatgctttttttttttgagacggagtctcgctctgtcacccaggttggagtgcaatggtgtgatctcggctcactgcaaccgctgcctcctgagttgaaatgattctcctgcatcagcctcccgagtagctgggattacaggcgtgtaccaccacacccagctaatttttgtatttttagtagaggcgggattttaccatgtcggccaggctggtctcgaactcctgacctcaagtgatccacctgccttggcctcccaaagtgctgggattacaggcatgagccaccatgcctgactgattttttaaatgttatgttgcatatataccagttgaaacaaatgaatttatacttttttgttttgttatttcatttaacaaataattattttattgacttctaataattctgtttttaactgctgttactgcttcattattttcaggacctgtaattcatctaaccactttctagttttaggttatgtctgttctatttagaaaaactcttaggagtgacactagtgaatcaggagagcgtaagtctcttcgtggtgcccaccgtatactcactttgtgtttagctaaaagtgctgctagactgtggccccagttttattatggctttgcaagccctgttaaccattctaaaaagagtttaaactttgggaggctacggtgggcagatcacttgaggccaggagtttgagaccagcctggccaacatggcaaaaccccatctctaccaaaaataccaaaaatttgccgggtgtggtggcgtgcttcccgtactttcccagcttacttcgagcagtgctgaggca

SEQ ID NO: 966 - DNA, 5588 bp, Homo sapiens
  misc_feature (1)...(5588): n = A,T,C or G
aactgagcggacccttccagccccgtggtgaagacggaggggcagccacatttgccctgagctgctggctgcagtgggggggtttgccccaggactgtgctccaggcctggttaacccctactccccttagcgtgacaagcccaccttgccaccaccaccaccccattagcctgggtcaacatttccaagccctagccaggaatcagccgccccctcccagatggacctgagctgcctggtgagctgcctgccgcctcttccctgcaggctcaggcctccccacagccgcgcctccacccacactgggagcacaggacaggtcagggctgggcgagggcgcctcgtgggctcaggaggccccctggggcaggtggccacttctacctgtgtccacccgaaggctggtggctcccaaacctgcaaggcttgttctgttggggtgtccctggcaaactaggaagtggttcccaccctctcactccagcccccaagacggcccctcccaggatgcctagcctgagatttggggcacagccccctgagcacaaactcgtgttaggtaggaggcacccaccagccctgccccacagacccaccaccccccaagattcgatgccattctatgctcaaattccagtgcctctggggccacaggcgacagtgcctgtttatcatgggcggggctgcctgtcccgggctggtgctggggccctggttctatgagttgaagcaggctggccgctcacacctgcaactaaaccacctgcttccaaacattgggcaacattccacagccactgggagtgctgcctgccaggcccggctccactttcctgaaatgcatgtggcctcgtggccaggctgcccagctccctggggaccagagtggggggtgccccaaaccgccaccgtgaaccccacagagtaaatgggccactcagtgcagctaccagccatgacctcagcttatagacgggaaggctggggggtgagttgtcctcccaaggggtctcagcacctgctggcccaacccaggcagcagctggcctgggtgggaaaggcacctgcctgtgtggacccttccctggtgagggggcagggggtcatcatccaatatcatagatgatgtgaggaaactccagagtgcttcctggaggaggtgacaggctattgtaaccatgaggcacagtggccctgttgagctgtgatcttaacaaaggactaaaaagtgcagaatgtgctgatgggcatctccagcacctacagcggtgactgatcatgggacaccctcagtaaaccctgcaggtgcaaggtagtgtgggaccggatgctcggggccaaagatccccacaccctggaggtcagggcggaagtgggaggccagcttgtcaaggccaaggctgtcacccccaaggcccctccagagaagctgcccaccccagtcatgaacgtccactttgacgtcctgtcgtgcctatagctttggaggggcccccagttctgtacacactcttggcttccccaaggggctgaggggctgggctgggtcagtagggtttggaaagggggtaaaggcacagaggggggccccgggaaggactcagtgcttcctggaagggggatctcggggtgtgcagatcccatgtagtgtcttgtgaggcccctcctggccagcacggcctgttgctgatgcccctgggacttccaggatggtggtgcctcattcctctgagcactgcctgctggtgggcaggagggttggccaggaccaccccatcaccagctcctgcagaccagaacctggaggcccagcaggtggcataaatgagtcacaagcattttcttttttctttttccttttttttttttttaggatttctttaaaaagttatgtttttttcatttatgcatttttttaggttaagccacatgaaactactagtatttattttaaatcaaaaatggtcaaaaatggccactttcatatgatttggccaatgaatacatgagaggtggtaaataatagcgattcacaagcattttctaaatgtccagagaaaaaaaaaaagacaggtttgcaggcagggcagagcccccagcacatcacccctggcttgtacctttctggagcccgcctcacccctgctgtggttccctgggctggcgagtatccacagggcagagcagcagcttcatggcagcctgcaagtgggcacaggcgccatttggcggttgaagaaactgaagctaggggtggaggtagcccccacagatggcacccaggcctgccatccccaggtccccacgatggcacccaggtccccacagatggcatccaggcccccctgtccccagggcccctccagggtagcagagatgactggggcatggggccagggcttgatttatgcccaggttaaagggctgccctcattcctgctcctactcagctccggtgtgggtagccttgcacccaccccagtgggcccttcagagcagagctgtcccctgcgccaggtgctggtgtgaacattttccacgtcctggctcacgtcctcatcaccagcctgccaaggactctgaggaaggagcccagaggggtggactgccttgccccaggcacacagcggggaggtggctgagtgggatttgaacctaggcagcctggctggaacctggcttttgtttctgagacagggtctcgctctgttgcagacacagtctgcaactcctgtgctcaaacgatcctcccgcctcagcctcccaaagtgctgggatctcaggcataagccacagcaccggccaagcctgggctcttatctcccccatgaatgtacagcatggcccaattccttaaactggtgtctgagccacagcctttctcagctggggtcccagaccttggatgctagacttccctgtcacaagtcagctgagagcctgcatttgacactggccacatttaagagccttttgaaggttccctagcattttgcggtctcaggaggcgtggggtggggcagggttgccatgagtggttgtacaggtcgtgcacggcacaagctcacaccatctaagggacatcagatttatttatttattcattttttagatggagtcttgctctgtcgcccaggctggagtgcagtggcacgatctcggctcactgcaagctccgcctcctgggttcccaccactctcctgcctcagcctcccgagtagctgggactacaggcacctgccaccacacccggctaattttttgtatttttagtagagacggggtttcaccatattagctaggatggtctccatctcctgacctcatgatccgcctgcctcggcctcccaaactgctgggattacaggcgtgagccacagcacccggccagggacatcaggtttattaagacacttttccggcagctgcccagggaagagacaagaggtgccttgtgggcagatagggggctgggagggggcctgcccggaagcagtggtggcccgtggcaggcttctcactgggtaggaccgggccctctgttgcaccccctcaccctgctctctgccctcaggagtggctaagcaggttcggttacctgcccccggctgaccccacaacagggcagctgcagacgcaagaggagctgtctaaggccatcacagccatgcagcagtttggtggcctggaggccaccggcatcctgggtcagttctccagggggcagcgggagcgccgtggcccccgtcaggtctgcgcccgtcggccatgccccctctgatcaggcacagtcccgtcttatgcttgaatgaacctgggtcctggcctggtgtagctcagagcctggggctggtcccccaaagatgacgtgggaggagggggcggctcggaggctggtgccagagtcagggctcccacccttgcggatgctcgggatcctagggtggggagtgagctgggctaggctctgagctccatgctttccctgcagacgaggccaccctggccctgatgaaaaccccacgctgctccctgccagacctccctgtcctgacccaggctcgcaggagacgccaggctccagcccccaccaagtggaacaagaggaacctgtcgtggaggtgggtgtgtggccagggtgaggagcggggcctccgtggaggtgggcgcgtggccagggtgaggaacggggtctccgtggaggtgggcgcgtggccagggtggggaacggggtctccgtggaggcgggtgcgtggccagggtgaggaacagggtctccgtggaggtgggcgcgtggccagggtggggaacggggtctccgtggaggcgggtgcgtggccagggtgaggagtggggcccccatgtctccgtgtctgggcctgctgtagatatccacaaaccagggtacttcagacagcagcaggagctctctccccactctggaggccaggagtccctgcaaaggagtaggctggatggtgccctggggaggtagagggagcatctgtccagggttctatccagctgtgcagttgctggcagccctcgatggaatcaccagcctctgcctccaccctgccctgtccgcgcgcagcctcctctcccgtgtctccaggatgctcctcggatttagggcccaccctgatccagtgtgacctcatgtcaacccctcatgacatccacaaagaccctatttctttttttttttttgagacagggtctcacttcgtcacccaggctggagtgcagtggcgcagtcacagctcactgtggccctgacatcctgggctcaagcaatcctcctgcctccgcctcccgagtagctgggactgcaggtgcatatgaccacacccagctaatttttttcttttttttgacacagagtctctttcacccaggctggggggcggtgttgcaatcttggctcactacaacctctgtctcctgggttcaagcaattctcctgcctcagcctcccaagtaggtgggattacaggcacgagccaccaggcccaactaattttttgtatttttactagagacagggctgggcatggngnctcacnccngnanntccggnagattgggacgcggccccaccgataaattcggaggtcaggacgacgagggcacgtctggcaactgggtggggccctggatatggaccagtgggactgacatgaatattcgtcggcataaaagctctacctggtccagaaaaaaactaactttaagagccagaaactcccggtaataactagtcgatggaatccagctaacagaacaatgtatccctatgatccccatgcatctggaccgaaatcagttcgttccacgaagttaaccatcgtcgaaaactacccgggaaagcggctcctgtgtctgcactactatatgaatgggccaatcggtcgaacagatgcgacgggccaagcttggcaacggcacagtcggggtaacgcccctcataagccccctatggtaaaacctcgcagcacgtagggagcgtacaatattatctcgctggagcctcgcttcggcgctgcacgtgtaccctgtgagcacagcgacactatgtagttagcg

SEQ ID NO: 967 - DNA, 5802 bp, Homo sapiens
  misc_feature (1)...(5802): n = A,T,C or G
attgcgcctgcgcggatccttccagccccattgaagactcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgaggtaagaaacaggagttaatttgtttagtacaaatcttctagatgatcagagtctatgcgacaatgaattaagtaataatttattgagcctgcggtatttctaaggtatttctaaggtgttggggcaaggatttgacccataagtaaaagtgaagaatgtgtttggcctccttcatgggaaggaagagctgttgagcgcagaagtgtgtcaggaggaagggacggagctgcgctatgatgagtgcgtcttcaacacccagtgttttcattgagcaccaaggattcatctcaggttcagagaactcagcaagcgtgtccagtttttttccccttgtatctgggtgtgtggtttgttggctgacgctgacagctgtcaccagccaaacgtgtgaaagcccagcaccctttgtctggttttccaagtttcacattttactcgtatagatctccttaaaaacaccatcagcatggttttcaaacagatttaagtcactagctttttataataaccagccataagtcactagatgtatgtatatgggaccttcatcattaaaatagttattatggcaaaaaactgtttgagaagttattcaatttttagatgtagtctcaagatttgagatcatactttaaactcatttttacaaatacctattaagtgatatttaagagtgactcttttttagagagtatactttttgggtgcctggaatggcacataataaaccccctacctgagatttcttagtaccatggtgagtctgagacttcctgaaaaccagggtgagagtgaattggactgtgacacactgtattttgtgcctttgtgttgtgtagtgtatactatgttggtggagcttattttgttttatgatacagttaaaataatttaaatctttgtcagctcttctgcaaagaaatctgctnttggtgaacaaaagctagtctctttgctcaagcagtccttactggtatctatggatgtatttgtgtggctttgccattttgtgttttcttttaacaccttttccaggatggaccatatttgtttttcaacaggtttatatgattattttgaggatttcacctctattgtcctgaaatagtaaaattcatttctgttacgtttgtataccaatgttgtctgtaagctcaatcccccttacctgtgcttagaaagaaaaacaaattcgtttttccaacttcctgctgaaaaagacctttgccattctgaccctacatataacagagtggctattctgcaaatttcctagggagttggtagggctttgttacttgaagtctgtctgccatatgcatttttaaagtttgaagttgcagaatctaaagatattgcactttgacttaaattggagtttctgcaaggtttgcagtttgagttaggttgttgtgctataaatctgtcagttcagtatcctttcacaggaattgatgcaaaaacattccatttttaaaccccaaatgtcagtgagctatcagcaataaaattctaacaaaattttgagcagttgtaaaaattatgttgcctttttttctcaaaatatttcctctcaggtaaaggttgtgacaggaaaggatgggcagactgggactcccgttgctatagcaacccagcttccgccaaaggtttctgctgctttttcatcccagcagcaaccatttcaggtacttttcgatggttctcaaatgtagtctcatcccaaacttttccttcatccagatattttaaccttcgatatactacttgctcttcagcattttttttccagagcccatttcttatttttcaacagtaaaaaatcttcctgcgtatacaattataaaattaaattgcatgagttaatgatgacacagatcttagtgcattactttctttcgtatacttgtaatgcggtagtagctttagcatgcatgtcatctaatagtcctgttgaatgtatgctcaggattccttgtgtgctgtgttttcaatgttggttctttcttgtgtcctttattttgagaacagtgcaaaacagaataagaaaaaaaagattcaagtagatgataaattggtattttccatagctagaggaaatgctgaagtgaaatacacttctgaaatcatcaggaccacaggcttctaaacggatattaagtgaatgcaaactgattatttttaattttttgcaaattcactcagtgttaaattagtaatgccaataatttaaaaacacaggtcactcacgcctgtaatcccagcactttgggagactgaggtgcatggatcacctgaggtcaggaattcgagaccagcctagccaacagggtgaaatgctgtccctactaaaactatgaaaattagctgggcatggtggtgcatgcctataatcccggctactcaggaggctgaggcaggagaattgcttgaacctgggaggcggaggttgcagtgagccgagattgtgtcactgcactccagcctgggcagtagagcaggactccgtctcaaaaacaaacaaacaaacaaacaaaaaccaaacaaaccatcaaatttctactagctttggaatagatagtgttgggttgtgaaagcagtttcatccttgggatttttgttgttactttaaattttgatttaatttcaaatgtacataatagttgcaattaattattttaaaaaccccttatatcctttaccaaatttatcagttgtttttgccccatttgcattattttcattctcatatatatacacatatctaaaacatcatatcctattcttttatctgtaaatacttcagcatgtattagataagaatgtttccttacctaatcacagtacagtgataaatatcaggaaattgtacagtagtacaataatacattctaatccatagtttatattcaaatttcatctcttgtctcaaggatgtccttcatagtgtttctttccccctagtccagtatcaagttgtcatgcctctctggcctttttaatctgggttggtttcttagtctttcatgaccttggctttggcctgggcctgggcgttaaaaagtacagaccaattattttgtacagtgtcctttgatgtgggattgtctgatgttttcttgtgtcctctttggatcatgtatttttgagaagattgctatagaagtaatgatatgtccgtttcaatgtgtcttatcagaagggtgtgatgtcactttgtcctataactagtaatgttaactctgaccacttcgttaaggtggtttctaccaggcctgtccagtggaaatttatttatttttccttttttaaatgatgagtaatttgggggaagatactttgagactatgtaaatatcctgaatctccttaaacttttacccactagttctagcatctgttggtgagtcttgcctgaatcagttattactataaagaatccatgctgggttttctaactccatcattctgtctacatttattagaatcagtaggctgtaatatatcactatcagtatttatttgcttatgtttgtttaaacttatttaatgtacattcagtaaaatgcactgttttttagtctgtacttgtgaattttgacgaatccattgagttgtgtaaccaccaccacagtcaagcaacagaagctccatcacctcccaaaatgttccctcatcaacccttcacgcctcccttgacctttgttctccatcgctaatgattttgccttttccagaatgaatatctatggaatcctagtctgggttgcttttcagtctggcttctttcacttaagataatgcatttcagattcatctactttgttttatttaccattaatttgttctttttattgctgagtgctattccattgtgtgaatgtgccccagtttgtttatccatttaccctttaaagaatatttgggttgtttccagttttcagaatttgggaataaagctgctacaaatgttcacatacagtttttcatgtcaacataggtattcatttcatttggataaatgcctaggagtcaaagagtctctctgaaagtattctggtttgggtggctggctggctgatttcaaaaaaaaaaaaaaagaaaaactaggaatcagatttctgggtatgttgaactttattaagaacccgtccggccgggtgcagtggcacacacctgtaatcccagcactttgggatgctgaggcgggaggattgcttgaggccagaaatttaagaccaacctgggccaggcactgtggttcacgcctgaaatcccagcactttgggaggccaaggtggaggatcacttgaggctgggaatttaagaccagcctggactaggcatgatggctcatgcctgtagtcccagcactttgggaggcctacatgggtggattacctgaggtcagtagagaccagcttggccaacgtggtgaaaccctgtctctgctaaaattgcaaaaatcagctgggcatggtggcacacgcctgtaattccagcttctcaggaggcacgagaattgcttgaacccaggaggcggaggttgcaatgagctgagacagcgccactgcacaccagcctgggccacagagtgataccctacctcaaaaaaaaaaaaaaaaaaaaaaaaagaccaccctgtctctactaaaaattaaaaaattaggccgggcgtggtagctcatgcctgtaatcccagcactttcggaggctgaggcaggcagatcacctgaggtcaggagtttgagaccagcctggccaacatggtgaaactccatctctactaaaaataccacaattagccgggcatggtggcgggcacctgtaatcccagctacttgggaggctgaggcaggagaatcacttgaacttgggaggtggaggttacagtgagccgagttcaccccattgcactccagcctgggtgacaagagtgagactcgtctcaaaaaaaaaaaaaacaaaaaaaacctatgtgtagtgatacacacctgtagtagtcccagctacttggaggctgaggtggaaggattgcttgagtcctggagttcgagggtgcagtgagtcgtggacatgccagtgcactccatcctgggccacagggccacatagtgagaccctgtctcaaaaaaataaaaaggtggctaggtgcggtggctcatgcctgtaattccagcgcttcacccgggtggaagacgcccg

SEQ ID NO: 968 - DNA, 4098 bp, Homo sapiens
  misc_feature (1)...(4098): n = A,T,C or G
tatgggggaccgatacttcacccgtggtgaagttttatgcctggctaattttttttagtagaaatggggtttcattatgttgaccaggctggtcttgaactcctgatctcaggtgatccacccaccttggcctcccagagtgctgggattacaggtgtgagccactgcgcccggcatgaaaatgatatttatttgggaatggggaatttcagtgggaatacatgtgccatagtgaactatgtgcattattggggctgggggctgggggtgaaggaagatgaagcctttacagaacgaatgaggaagatgacataattgttttgagataattatctttggcgggccgggcacggtggctcatgcctgtaatcccagctctttggaaggccgaggcgggtggatcacctgaagtcgggagttcgagaccagcctgaccaacatggagaaaccccgtctctactaaaaaatacaaaattagccaggtgtggtggtgcgtgcctgtaatcccagctacttgggaggcagaggcaggagaatcgcttgaacccaggaggcagaggttttgatgagccaagattgcagcattgcactccagcctgggcaacaacagagaaaatacgtctcaaaaaaaaaaaaattatctttggctacaaagatcaataataaaggcaatgccagtccaaggttagacaggcaattgctgggtagatattttcacaatagttttgtgtaaggtttcaatggcctttgtgcaaggttgtgttttttgcgcttttattttttcatttttttcttttttttcatgaatccatctcagtccatttttgcagtcttttctgatagtttttgttttcaggcatttatgcacgacagcctttctcttcatggccttcctgaggcctatttgccagagtgtttggttttatttgtttttttaaaacagaagtgattctgacaactttcacaaaatcaagatctcggcactaggtgtgttcgttgctgcttgggcctcactggtcagctgaaagaaatgtgtgtgtactaagccctgcacatactcatacacagatattttcctatgcaaccacctgtagctatgttcagctgcacgtgagttcacactgacgtctccagccctcctccatcaccacatggaccatgctaacctctccccttgcttatccgtcaccctgggagtctctttgtccctctctcttgctctccctcatcccaactgtggagcccaggaagcagcttcctgagtccctctagggcctcccgctgctctgtgcactcttgcccaggccccccttgctgtggacttgactcgggcctctctgcttccagcctccccaccctactctccccaaagcacattctgagagctctctgaagcacacgcaggcctgaggctgagccctcttttgcgtccctttcttcccaggatactgcttggggaaaggacgtgctcgggacccatctgtcagctgaatggaggccgggtggtgcccggctggcacccagagggcacttcatccgcatgcatgctgagcccctacggggtgccaggctctctgctgtcctggaagctggggccaatctccgaagagaacagagctgccaccctccagaagctggtgggtcctgggtggtggtggccgaaagggacactggttactgcaagcttgtttctgcttttgcactttttttttttttttgagatggagtctcactctgttgcccaggctggagtgcagtggtgcagtgtcggctcaccgccacctccgcctcccgggttcaagtgattctcctgcctcagcctcccaagtagctgggattacagccgcccgacactatgcctggctaatttttgtatttttagtangagaccaggtttcacttatgttggcccgggcttgccctcaaacctcctgacttaaggtgaattcacctgccctggcccctcccaaaatgcctgggattaccaggtgttgacccaccggggcccggccgcacaatttttcaagagctggcaggacctgctgtactagaaaagaaacctgggttatttccaggttagtaggggcatcagctggccttgtttccacggtcgtctcgcaacccacggcagaatccgtccaaggggaagacagaggtggctcagctctgcagagtttgagatctgaatcaacggaaaatcgtctaaagtgctttctcaaactctttttcaacatttcactttcatgtttccctaagctgcccccgctgaatagctaatgaacttgtaattaaagcaacttttcacatggtgaaaagccgcattccaccacccgctcgggctctcagtccggggctggaacccagcctggcgcagcaggtgtgcaatccctgacgctggtgtttatggagtgggtagaatggctggccctccaggacaccgcccctgtgcaccttcttgtgggaacaccttcttgggggctgacctggccccacgaggtacaccagggtgctggctgctttcagccaggggaagagcggccgtattgtgctcagtgaaagcccaattccctgcaatttggattctgaaaggagttgaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcacaacctactcatctgacaaagggctaatatccagaatctacgatgaactcaaacaaatttacaagaaaaaaacaaacaaccccatcaaaaagtgggcgaaggacatgaacagacacttctcaaaagaagacatttatgcagccaaaacacacatgaaaaaatgctcaccatcactggccatcagagaaatgcaaatcaaaaccacagtgagataccatctcacgccagttagaatggcaatcattaaaaagtcaggaaacaacaggtgctggagaggatgtggagaaataggaacactttgacactgttggtgggactgtaaactagttcaaccattgtggaagtcagtgtggcgattcctcaaggatctagaactagaaataccatttgacccagccatcccattactgggtatatacccaaaggactataaatcatgctgctataaagacacatgcacgcgtatgtttattgtggcattatttacaatagcaaagacttggaaccaacccaaatgtccaacaatgatagactggattaaggaaatgtggcacacatacaccatggaatactatgcagccataaaaaatgatgagttcatgtcctttgtagggacatggatgaaattggaaaccatcattctcagcaaactatcgcaaggacagaaaaacaaccaccgcatgttctcactcatagatgggaattgaacaatgagaacacatggacacaggaaggggaacatcacacaccggggcctgttgtggggtggggggagggggagggatagcattgggagatatacctaatgctagatgatgagttagtgggtgcatcacagcagcatggcacatgtatacatatgtaactaacctgcacgttgtgcacatgtcccctgaaacttaaagtataataattaaaaaaaaagaaaagaaaaaaggcggaggcagcctgggccccgtgccgcacctgtgctgggatggtcttcacctatgtgctggaagcataccgcggtaagtataaagcggtttgtttcaat

SEQ ID NO: 969 - DNA, 4455 bp, Homo sapiens
gcctggccgtcgacatttaggtgacactatagaaggatccgcggaattctgaaagaagatgccaggtagggcacctcagggcctggagggcctcacaggaagggctcaggcctgtctgcctttaccaagtacatgttcactctcttaggtgtttgtaggggagtggccaagacagccacgtggctcaggtgtggaatgaagctagaccaggtggaagccgaagggtcggcctctccaggcaggagagaaggatgatctaagggcaggtgcaggccagaatgtctggaaagcatttctggtgcgggattgccagtttggtgacgtggactctgggaagcaaggggacaggggacagcagtcagagctgagctgctgcccacagagcaggctccactgcccagaggctaagcggtatcaccaagcggcggacaactggcaggtcaggaagaagtgccactccagcctggacaacagagtgagaccccatctcttaagaaaaaggaagaagcagcaccagaagctgcgccccctagtcttaactgtctgggaggctgaggcaggaggttgcttgaggtcaggaggtgaaggctgcagtgagctgtaatggcaccactgcactccagcctggacagcagcacgagaccttgtctgttttttcaaaaaaaaggaacactaaactttgatgtattgatactttaataaatttcctgtatctttttggaaatttttattgatgaaacataagtggcaaagcactatgaactgcctgtggtggcttatcttaggtattttacatgtaaataaaatgctggttgcatcttaaataccacaagtattttacttgaggtcctaaatggggacgcgtcatctgttatcagttaaatgaaataagtagctttaagagaagttaatgggtttggagtggttccgtccctgaattgtgccttgatgaactcttagccaaaaactggctcagatccgagcttctccctttgtgccctgcctttaaaccaaagctgcatctctcacagaaactcttgcctttcagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggtaacccctgtcctccagcagctctctctggggaaaggcaaggggcggccagcaggactctccctcctccctgagtccttgcctatgtcagtactcgcctgtgtccagggggcgccagccacaaagccaaaccgcaccccctctagcaaggaagtcgccctagatgtggcttctcacaatccatgagcgctcagaggagcaggtcctgtactggggagaccctcctgcagagcccaggagtggagcagtccacttgaagcagcccaagtgtcacacacgtgcctgatgcccaccaggcacactgggctgtgcaatgaccagtagaccgggaactgtcaccaggtccccaggctgccgtgggttggagcaggtccccaagctgcaacggccagggccaaatgacgcccacctgtcaccgggcatcacacctgggcagcagcacagacgtgggcgtcccagtcccgggctaggtgataatgacttcaagtcagacaccctccgctgcccaggcacccacaccctggggggaccagagagggcagcatctgggaacagctgctccctttaaactgattgcttccataaatgtcaatcatgggagtaacgcgcaactgttccattctagtggcagaggcctcagctaatttgagatggattagaatctaagaggtggcacctttagagttaaaatgtaaatcaggctgggcgccgtggctcatacctgtaatcccagcactttgggaggccagggcaggaatttgagaccagtctggacaacatggcaggaccttgtctctactaaaaataggtggcacgcgtctgtaatcccagctactcaggaggctaaggtgagaggattgcttgagcccaggaggtggaggctgctgtgagccatgacggcaccactgcacatcagcctgggtgacagagagagaccctgtttctgaaaatgtaataatgataaaatgtacatcagtgtaggaggctgagcatcgctgcggggagggggtgttggctccagcacacagacgcctcatgcacaggccgagggcacctacagccaaggccgtggttctgggaaggctccaccgttctgctgagtctttcctttctttgtttcttttttcctttgtgtttaaggtaattttatatgaaaatctttttgagttagattgcgatttgtaaacatttcagatgagtataacacagcatgtttatgatgccaagttttattgaaggatactggaggggtgggcgcggcggctcacgcctataatcccagcactttgggaggccaaggcgggtggatcacctgaggtcaggagttcgagaccaccctgaccaatatggtgaaaccccgtccctactgaaaatacaaaaattagccgggcatggtggcacacgcctgcaatcccagctactcaggaggctgaggcaggagaattgcttgaatctgggaggcagaagttgcagtgagctgagaacgtgccattgcactccagcctgggtgacagagtgaaactcttgtctggaaaaaaaaaaaaagatactggaagcagatgcagtgggcacttctcagttctagagttggggttcggaggtggggatgctgttcactggccttggctcagcatcttcacacggttgtaagctctgctctctctctctctgcattaggggagtctctcaggaaaaagaagcccagatctcttcagcaatcgtttcttccgtgcagagcaaaatcactcaggtcagtgggcacgcccccctcccgctcccagcctttcatcaaggggcctcgtggtttctctgttgctaattttcattccctgtccctcctgtccctgtcatgggacagggatctcgggcaaaataccacaggctctgggtgaggccgagggcaaagccgtgtggcccgcaccctgcacagccaggctcctccgccgcccccacggtgctagcaccgtctggtcttgaccaccaactcgttgatgaatttcttcaccacgtgggttgtctggccaggtcttcacaggttctcctctgtgtctcgccctgcacaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctagaccctggcgtggtttcttccttctctccttggttggcttctgggtctgtttgaccgtctgtcatctgttacacgtgtagtcatggaggtgtggcagggacaggtgggcagcactgggcctccctgtcctgggcccccagccctccgacagcagccactggactccccttccccgtctccacgcctcctgcggtcaccgcacaccccttcttcccaggccgtcagctccccgtgggcatgtgtccctgccggcacccatgctgcaactgccggacaggccctccctgcggcagtggtgcacagcaggggagcagcccagccccgcctcaccatgctgagcaccgcatgttgccttgagcgccggctgcttgctcctggcgcctttcctgacgtgcagatgcccgggactccactgcaggcttcggccccccagtggaaacacaatttgtgtgtagctgagggtccggccacctggagttggggctcgtaaggtccttacaccagaaatgaggatttgctgcttgtctgctgtaggcaggtcacagtgacacttttgtccccacaggaaggacactccctggcgttcacttaaacgcctgctgtgccgaggtcaagttccattgtcagttctgccaatttaccaaaacccagaaattgaattacggtttttcctccttatggcgcttggggtccagacgctgcctgcccgcgaaggccagtgtgggtgaggcaggtgggcaagctggggcaggtgggtgggtggggccaggcacacacacaggcacaggccccacagctgcccacaaccactcagaaatgctacaggccctgtcttcaccacggggct

SEQ ID NO: 970 - DNA, 6008 bp, Homo sapiens
  misc_feature (1)...(6008): n = A,T,C or G
acaacgcaagcttcaaaggggaataccaaggtaaaattaatagtaatgtggcaatcccagtttgcacagtggctttgtcacgaacccagccgtaaaggcaaccaagggaataaatcagataacctcacggtgggtgagaccggctgcgaccctgtggcctgttttcttattttgtgcatgtgggtctcagctttcccagaggagtttctccaggtgcagcgtgtggtggcagcaacagcacaggcatttccttacttaaccagaagagactaagggatctcctgggtcaggttctgtggagttccagcagaagccgcggatcgtggaagttcagcgacaccaccgtcctgccccgtgggagaggtgggcattgagatgggtaagagcgtcatcatgacaggagtcctgttcgccggcgtctagggaaagccgtctacagcatgaaacgtcctattcgcgacctggtttgcagttcgaatgtctctgactatggcattgggaggtacagtgaacttttgtgtggcccacacatcagacgcaaggcttcttttggagaattcatctagttttagctgataggacttcaggaacagagaagtttccatttttagtaattctatggaagaaagttagattcgatgaatccagaagaatgtaggtgttatgcgcgtctgtataagaggccacctaaacaggcttagtgtgagcaacaaggctgtttattcacttgggtgcaagggggctgagtctgagaaaggagtcagaggagggtggtgggcctatcattggttcttataggtttgggataggataggcggtggagttagcagcaattttttcgggcaggggatggacgttacaaagtacattcataagggtggggagggtgtattgtcacaggggcggggaggaatgttacaaagtacattcacaaggacggggaatatcacaaagtacattatcacaagggtgggggaggacaggaatttttttttttttttgacggagtctctctctgtcgcccaggctggagtgcagtggcgccatctcggctcactgcaacctccgcctcctggattcacgccattctcctgcctcagcctcctgagtagctggattacaggcgcccagcaccacgcctggctaattttttttttctgtatttttttagtagagacagggtttcaccatattggccaggctggtttcgaacttatgacctcacgtgatccgcctgccttggcctcccaaagtgctgggattacaggcgtgagccaccacgcccagccaaaaaatatcctgtcttacatgttgttagattcctttgggggttcagtgctatttccacctaatacaggtctgtagcaatgtcaatgttcaaccccatcctgggtggcatgggatcactcttcatggttcacaccttgtaaaaaccatcagtcgtcatctttttgtaggtttgacaaacgctctttcgaatccagaaaagtcaagtagagaaggaaagtaaggggccacttactgtgcctcgaatcacaagaccgcggtggaccagcctggttaagacctgtggatgtcttcagcaagaaacttggagaggcccctaaagatatcgccagagagaaaacaaagaaagcttcagtcgctccttcctaagctgtcacgactactcttttaaatggccccatgcttggatttctgtcaccacgactgggggagcctgggcgagtgtgctttccctcactgcacctcccatgggagcccaggctgctgcgccgtcctcagactgttgggatgatgagcggacggtgaactcccaccacctgcgcctgtgaagggagctccggttgaggggctttgctggcttcgggtcgggggctgccgtagttctgtgttggggagatggtgtggactgcggcagagccaagcctgagccccacgccaggatgagtggagtgcccggaaagcattctgatttccggcctggcgtgtcttccttccattacactgaaagttttacccaacagctcgtttaagttttttttctttttgaggtggggtctcgctctgtcgcccaggtgatcctcctacctcagcctcccaaggagctgggattacagacacacaccaccacatcctgctctttttttttttttttaaattttatagagatgaagttttgccatgttgtccaggctggtctcaaactcctgagttcaagctatccacctacctcagcctcacaaaatgctaggattactggtgtgagccatcatgcctggccaagttttgttttgttttgtttctttaaattttaaatttaatttgatttttagagttgggatcttgctctgtggcccaggctggtctcgaattcttagctttgagccatcctcccacctgggccttcctaagcagtggaattacagttgtgagccactgtgcctgacctcactgaggtttttatcacagaatgataacaaaagcgccatgcccacagttttgtaggtagtgagtgctgttgctaggacatgctcctggttagtttggcttcagatactgtatttttccatgtttctacagtgagcctggccttgtgtgacttctgtgaaatatccacttctccaccctctttgttctctgccagttgtaatttcttgagtcatttcgtttttgttgcaggaaatcaggtgcctgttgtttttttttttttttttgatggagtcttgctctgttgcccaggctggagtccagtggtgcgatgtcggctcaccgcaatctccctctcccaggtttgagtgattctcctgcctcagcctcccaagtagctgggatcacaggcacccgccaccacacctggctaatttttgtatttttagtagagacggggtttcaccatgttggtcaggctggtctcaaactcctgacctcaagtgatccacctgccttggcctcccaaagtgctgggattacaggtgtggccaccgcgcctggcaggaaatcaggtttaagggacttgcctgtgagtgagtgtgacggctggagcctctcaacagtgcagactgctgtaaatgaagactgtggaatggcgaatctcattgttcatctggggccatcagactgatcagctgtacatagtctataggatattcacattaatacatttacatagatataactttaaagaagatttactataacagctaaaattatgactaatgatattagattttaagttttatacaatttttaaacattatttatttatttatttttttgagatggagtctcgctctgtcgctcagtctggaatgcagtggcgcaatctcggctcactgcaacctccgcctcctgggttaaagtgattctcctgcctcagcctcctgaatagctgggattacaggtgtgcaccaccacgcctggctgatttttgtatttctagtagagatggggtttcaccatgttggccaggctggtcttgaactcctgacctcaggtgatccacccacttcagcctcccaaaatgctggaattacaggtgtaagccaccatgcccagccatgaaacatttgtattaataacataaatgtaactgaaagaatgcctaatataatttattatttgataatgtctctcacataatttactaaataagcctaataatttaatgcctctacaaaatgagagataagtttttaaggttctcctggggcccagctagaaaattccaaagttaagcctaggtcagaaaaacttaatttagaattttgttcttggagaagctgctaaagatgtcaaaaggtttaaaacaattgaacgaaacgtgatcataggtcactctgaaataacagtcgtttatttcactgaagtgataatcaaaagactttgaaagcaagacagagatagttacacagcactggctggggcagcacagacactaaaattggagtgacacagaggagtcagcagggcccttgcgcaaggatgacatacaaattcgtgaagacttccatattttttaaaataatataattataaatattaaaaaatcgtttgttggccaagtgcggtggctcactcctgtaatcccagcactttgggaggccaaggggggtggatcacctgaggtcaggagtttgagaccagcctgggcaacatggcaaaaccccatctttaccaaaaaatacaaaaattagccgggtgtggtgggggggcgcctgtaatcccagctacttgggaggctgaggcaggagagttgcttgaacccaggaggcagaggttgcagtgagcagagattgtgccactccactccagctggggcaacagagcaagattctgtctcaaaaaaaaaaaaaaaatcaccatttcagggtgtacacttccctgcatttaggacatttacaaggttgtgcagatgccaccttgtgactgtcctaaactccaccacactccagcctgggcaatagagccagaccttgtctcaaagaaaaaaaaaaagagtttttttaaaaaggttacgtggatgtaaccttttatttatttttgttcatttttttccagacagggtctcaatatgttgttgctcaggctagaatgcagtgctgcagtctcagctcactgcaacctccacctcttgggctcaagtgatccaaccacctcagcctcccaagtagctgtgcaccaccgcacctggctaattttttgtttattttttgtagagatggagtctcactatgttgcccaggctggtctcaaactcccaggttcaagcaatcctcctgcctcagcctcccaaagtgctgggtttacaagtgtgagttgccacacccactcgtctttcttacaacaattacaaaaaatattggctggaatgccaaagctgtgagttttatctcaaccccattagaaaagtcagcagattcaaagtaagcagaaaaaaaaaaaatagagaacttagaaggctctccacattagccctatagttgaaggcttgttttttgaagagactgtttgaataatgataatttgagctcttaatttttcttgatgtaatttgtccaccagttaaaaaaatatgcatgagaatgggctataatatgtaggtgtcgggagtcccagaaaacttggcatgtcttcatatttaagaatcccattccgtttcttattaatatctttagagcaaagaaaattctgtaaatcctgtcagagaatgtttggagtttgaccaatgttttagatggtggtgactggcccagcagctttaaaaaagttttttctttgtatcttctagtatgtattttttccagttatgaattcaacgtggaacccagttgtttttaattagccaccctgtgcccaccatttagaatgtttatttttgttcttggaagatttttagaaacaaagaagggaaaatggccaaatcatgcatttaaccaaactataatcaggatttgcaaaaaattttgacccaggcatgtagatcaaatgaaatattcagctaggagcagtgaccaaaagtgaatttaccagagaagacctcgcacctcgcacctggcacctcgcatctcgcagatggaatctgagttctctagaaaccaaaaagacacttgtctttcttttttgatcctaggaggaatgtaagggcgtttattaaggcaatcttataaccaaaccaaatctggaatacagtggagagcttctacctaaaaagagggaggcctggccctgagagaagattcagcagggcagaaaaagcaagaggcagaaatgaagagctcangtggggaatcgccagttctgagagccacggctcncttncaacagggacccgctttcaggttccacttctgacaccatttattctcacggaaatatccgggagaaggctctttaaaagaaaactggagaggaatttcaccttcttttcccancctggaccctaangccacaaaactcactcactggaacctttggcctcccggttaaaaccctttttctggcttacc

SEQ ID NO: 971 - DNA, 5978 bp, Homo sapiens
atttgacggccctttcagccccgtggtgaagactggcaacccctgacctcctttcttcatagatgggcctctaatgcagccatgcaaccttttgtgtctggctctttttttttgagatggagtctcactctgtcacccaggctggagcgcagtggcgcgatctcggctcgctgcgacctcagccttccgagtagctgggactacaggtgaccgccaccacgcccggctaattttttgtattttttttttagtagagacggggtttcactgttagccaggatggtctcgatcttctgacctcgtgatccacccacctcggcctcccaaagtgctgggattataggcgtgagccaccgcacctggcctcttttttttttttttttttttttttagagatgggggtctcactatgtggcccaggcttgtctcaaaactcctgggctcaagtgatcctcctgactcagcctcctgaacagctgggactacaggcatgcactatcacacctggctaatttttagatttttttgtagaaatggggtctcaccatgttgcccaggctggtctcaaactcctgggctcaagcaattctcttgccctggcctctgaaagtgctgggaatacaggcacgaaccactgtgcccggcccggcttcttccactgagcatagcgtgttccaggttcaccccatggtagcatggatttgacctggatttattctcatggctgaatagttttgtcatcatgcagcctatagcaggcactgggttgtcacccctgttggctgcggtgaacagtgctgtgaaggctggtgtacgagctcctgtgggaacgcctgtcttcagctctttagggtgtaccccggggtggaattgcagggcagtgctcacacactgagtgtttaactcggcgaggggtctgactcccacctcgacgtcagctctgggggcagcagtctcgctgatcgcagctgcgcccccacagagcctgtctgctgagtggcctcggtttcatccctgggattcagaagggctggtgggatgtggggggaggcgggcgtcgggggtttgaggccgtcctcctccttgtctcccgcaggtgtgcgggagtctgtgtctcccacggcgcagcccgaggagcctcccctgctgccggagcccccagacaaccggtccagcgccccgtaagccctgggcccacggtcaccacccgctggggtctgtctgtcctcatccctgtcccacgcaacatttgccccaaatcgtggctcagagtcctgggaaacgcacagctgtgtggccgactgagcccccagtgacattttgtcttttcttaaaccccatctaataccggccctcccctgccaggggtcctgcacagaaatgagaacttcagacaaggtttcctctccccctcgtccctgtcagctactgccatgtgacaagcagcccagcttgaggaatgtttcatcaagctcatggattcccagcatcaggaagtcaggcagggcctgcgagtgtctggcctgtgcccccagcgggagggatgttcactgccggggcccacatctggtgccagggctgggcccaactgggacggccactggggctgctccacgaggcatgaccctcccacagcaactggattcccagtgaagttgtcttgagagctggtattgccagaggccggtagaagctgtgaccttgtgccacccagccccagatgtcacaggaccgtacgtgtaaccctcccggttaaagctgcgaaggagccacgctctgtgtcgagtcgtctctcggtggacatgcaccttgtccctgaccttctgtcgctacagccacgtcgctgtgaacacgcttcttgtaggaccgaattctaggcccgggcttggggtcccgtggcgtggggtcccgtggcgtgggtgtttggcacccagccaggcccagggtgctacaccagtctccacccctgagctcctgccctccccgcagctccctggcgctctgtatgctcagagcgtagatctcggcccccgcccgctgaagcggtggacaggcacccccgttttaatttgcctttagcagacctctaggcaaggataggggctccacacaaggatgcctgtcccatgccgctcaggtcaggggctctgccgcaggatgccctgtcccgcgctgcccagggccccgcctcccagcccacctggctctctccctgcaggcccaggaaggacgtgccccacagatgcagcactcactttgacgcggtggcccagatccggggtgaagctttcttcttcaaaggtacctccagggttcccgtggcggttggctgagggccatggcccactctgggtgcagaccgtctctgcagcccggccctcccctctgtgcccccaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggtgggtgggcctccccgtcgcactccgggcttcccgggccctctgtccgcctcatggagggacggagagggtccagcctgcgtgtaagccctacgtctgcccagaggctggtcgagcacagagcagctggtttgcttgtgcactcagcagatgcactctgagcacctactgtatgccccgtcctgaggcagccgctgtaggcacacagagggcaaaacgatggaaagccctgccctcgttctagtcaggccacagtccacccgcaagtcaggaggagctgatgccagtgccgttcggtgtggtcagaaatgaaggacaatggggagaggtctccttagggagatgctgtacaagcagaaactagggaacagtgttccagcccggggaacggccgtgcgaggcaggagcagccctgccgagtcccaaaaacatcaaaggggctgcagctggagtaccaggggcctggaggaggctcgggacagaagcgtgaggggccgtggctgctagggccggcctgcctctccctggtcggccccggtgcccaccgttccaggaaccacctcgtggcagtgttacaggaagcactccttttgcctccaagtctccgggaagggcaggaaagggagacagtagcaggggcaggtgggggtggcagggctgcaggacagagacccccatgctgggctgaaacacccggagtttccctcacagtctggaggccacgagtccgaaatcaagggctaggcagggtgggtcccctctggaggctgtcccaggcctctcccacatccagtgtcaccctcagccacatccctcctgccaccgcctctgtctccacccggccgtctcctcccccatctccgcatcttctcttataaggaagccgggccttgattcaggtcccctagtcctgtttgttttttgttttttgttttttgtttttctgagacaaagtctcactctgttgcccaggctggaatgcaatggtgtgatctcagctcactgcaaccttcacctcccaggttgcaattctcctgcctcagcctccctagtagctgggattacaaggtgcccgccaccactcccggctaatttttgtatttttagtggggacagggtttcacccacgttggccaggctggtctcgaactcctgacttcaggtgatccacccgccttggtgtcccaaagtgccaagattacagatgtgagccactgcacccggcctgcctaatcccatcttaactcatcttaactaacacatctgcaaagaccctctttccaagtaaggtcacgtcctgagattctgggtggatgtgagtttggaggacgtcattcaatccaatgtggcagccactcccacagtcacgggcgggaccccgtttccttgccgaggtaaagggtgttctgcgtgtctgtcaggggaaccacttcctgtaactccatcgcctgcccggccctcagcatttgactccgtcacccccatcacctgggagccctccggtgactgttcccggaggcctgatccctcctgaagggacagaggctgcagctacctgggaggctgaggcaggaggaccacctgagccagaaggtcaaggctgcactgcaccatgatcgtgcactgcactccagcctgggcgacagagcaagaccttgtctaaaaaaaaaaaaaaaccaaaatgtcacgcgcagtggctcacgcctgcaatcccagcattttgggaggccgaggcgggcagattacaaggtcaggaaatcgagaccatcctggttaacacggtgaaaccccgtctctactacaaaatacaaaaaatttgccgggcgtggtggcgggcacctgttgttccagctactcgggaggctgaggcaggagaatggcgtgaacctgggaggcggagtttgcagtgaggtgagatcacaccactggactccagcctgggtgacagagcgagactccgtctcaaaaaaaaaaaaaaaaaatccccaaagacagtacctggactaaaaaagaaaaaagaaaattacttgcaaacctcatgaccaattgctcctaacctcccctaggccaccttgccaaaggccccagggtgccctgtagagcctccccgagcaggatcccatcacgtgcggctcccctgccttgcacacattagaagtgttcaggccgcttcccccaggtggacccgtctggcatctcctccagatcaggttctggttttgcacatctggcaggaatgccaccgagggcaggtgttctgagccccgagccgccctgcctggtgatgttcgctgtggtcacctggatgaggtgtgtctgcaggtttcgctaccataaagccccatttctgggtgtgaggggttggtcacctgccaggagagacttgagaacatgtgggtctcttgccacaggccgtctcacccctgctccccctctgtcccctgtgtcgcctgcccctgcctggttccctaccaggcgcatctgtcctggttcctgctcagccatagcagggcagggcccattggtcctcccatcatctccttaatccctccccctatttacagacatcacagccctttccagtctccagcaaaggactttttctggtctttttatattatttttatttttaattttattttactgtatttttttgagacagagtctcactctatcacccaggctgcagtgcagtggtgtgatctcagctcactgcggcctcgacctcccaggttcaagcagttctcctgccttaggctcctgagtagctgagactacaggcgctcaccaccgtgcctggcaaattttttgtatttttggtagagacagggttcaccgtgttggtcaggctgatctcaaactcccgacctcaggtgatccacccaccttggcctcccaaagtgctgggattacaggcatgagccaccactcccggtctggttttttggtcgttttaaattgtgggcgtggtgagcacactttactatttcagccattttgaagccacagctcggtggcatgaagcacgttcacgttgctgtgcagctgtcacctgcgtccacctcccgaagatttccaccttcccaaacggaaacgctgccccgtgaaacacggatgccccgccccgcccctgggcagccccgcccctcccctgggcacccccacttcgcttgctgtccccatggctctgagtgttccagggaccccatgtcagtgggacagacaggatctgcccctctgtgcctggctcgtgtcactcagcggaaggtcctcggggctcatacacgcggtggcacgtggcaggatttccttcctggctgaggctgagcggcattccatggcacggacggactgcacctcgttcgcctgctcacttgggtttcctctactctgggctcctgttcttcacccgggtggaagtacgcgcc

SEQ ID NO: 972 - DNA, 5945 bp, Homo sapiens
gctctaataaatttgcggccgctaatacgactcactatagggagaggatccgcggaattcataaaatagaacacagatgtgataaaattatctagaatcaagtaaaactgatgacgtaataggataacaattctaaacctatatatgcacatactaacatagtctcaaaatacataaaatgaaaactgacagaaacttaaggagaaataggtactcattatcataatggaacattttaacatacttctctcagtaattgatagagcaagaagacaaaaatcagtaaggataagaactggataatgcaatcaacaagttctacctggtggactgagagagagaattgtaccataacctgatgaatgcatgttgttttaaagcatgtatggaatgtttataaactggtccattcaaaacctacctcaacaaaatccaggtcagtgagaatcccatacatcttctgtctgatcaaaatgcaattaatgtagaataataataaaaatatatattgaaaaccctgtattgtttggaaattaagaaacatccttctaaataactcatgggtcaataaaatatatatacaggggaaatcagaaaatatttaaaactgaataataaatatgatattcagctaaagcagtattacggaaaaattcagacccttaaatgtttatattaatgagctgatgaaaattaggaagctagtcatccaagttaaaaactcagaaaaagatgtttttaaaaaagaaatactacgagcagaaacaaaacagaaaacaatatacaggcgccagattaaaaaaaaaaaaaaagaatctgacaaacttttgacaagactatcaagaaaacaggcataaatacacagtattaggagaaagaagggacatacatacaaacacacccaagatcggaaacactgtaaggagaaattattgacaatgtatgccaataaattttaaaatgtagatgaaataaagaaattcctagaaaatttgactatcataattgactatgaagaaaagaaaaagtcatattcctcaatttaatgtatgagggccaggcacggtggctcagcctgtaaccccagcactttgggaggctcaggtgggcagatcacctgaggtcaggagttggagaccagcctgggcaacacggtaaaaccctaactctactaaaaatacaaaaaattagccaggcatggtggcaggtgcctatagtcccagctacttgggaggctgaggcaggagaatgacgtgaacttgggaggcggtgcttgcggtgagctgagatcacgccactgcactccagcctgggtgacagagaaagactccgtctcaaaaaaaaaaaaaaaaagcgcttgggtggcttgatggcacaaggtttctgaaagggtggctaaaagtaaatcatccaagcaccgaaggacaacggtgtccaggtatgagaactggctcaagttgggctaatgtctgtcgaaatagatgggggctatccctgaccccttggggtaaaacagtccaggtgagttgagacgttgggtttgaaggctcttcaaaggcaaacaagaattgagagtcaggatgtacagggatgcagaaaaaggcatccttaaggtccaggactgtaaacaactctgcttcttctggtatttaggaaaacagagtataagggttaggtacagctgggtatagagggacagtggcctcattgataatcctgagatcttgcactaacctccactgtctgttgggcttctgtactcctaaaattggagtattgcaggggctattgcatacttttactaggccttgggcttttgggtccttaacaatcttttggagtccttgttggcctcgggtctaaggggttactgcctttggcagggaaaggaggtggaatcctttaacttgaacaggacgggcattttttgctcatctatattgtccttctgttgcctagactttaggattaattccttcctcaagcaggggacaacaaacgggtgttccttctcctacgttcaagtgtaaaatggcccctgcttttgatagaatgtctctccctaacaagggagtggggctttcgggcataattagaaaagcatgtgaaaagagtaaagctccccagtcacaccttagtggctgggagaagtatctagtgactggctgtcctaggacgcctcggatagtgacagatctggaagacagttgtccgggacaggagagtaagactgagaaggccgcgccagtgtccaggagacagttaacctcctggccgtcaatgatcaagcatacctggggctctgtgagggtgatggcatgggctggtgcttgccctgggcaccctcagtcctgtcctgctgctggatcatctggttagtggcttctgacttagagaaccttcgtcccctggggcagtgggtcttccagtgattcccttgacataaggggcgtggacgagggggcggcttatttctattcggacagtcttttttaaagtgtccttggagaccgcactggaagcaagccctattaggcattggatttgcccagcctttccgtattccagagcctccacaatccacttgcctgagggccatgactaaaggggtggcctttttcttatctcgtttgtcccgttccgcctgctcctcctgatctctattataaaaaatggaggttgccaagttcaatagggtttctaagttttgctccaggcctaaggcagacttttgaagtttttttctaatgtctgcagctgagtgagtgagaaatttatcctttaagattagttagccttcagtagagtcaggtgacagggaggtatgcttcctcaatgcctcccttagtctctccagaaagacagtaggattttcttcccttccctgtgttacagtggacatcattgaataattcataggcttcttcctagttttccttagtccttctagcacacaagttagcaaatgtctgcagcaccaatctccatgttctcattctgtgtcccaatgagggtctacactgggaactgcctgctggcctgtggggaatcattctctttcctctgttgtcatcctatcatcgacctgactgagacaccagagatctccaagctctcgggctgcagtaatggcagcacttctctcattaggggttagtgtctgatctagcagtaacattgcatctctccatgtcagatcaaaggattgtcctaaccctcataaaacatcaatatagccatcggggttatctgagaatttacctaggtctattttaatttgcttcaagtctgagagggaaaaaggcacatacactctggctgggccgaattctccagaatacatcttaggagcgtttttgccttaggggaacttttcctatctggaaaaagaacatagggatgccaggacccctggttattttctgatgagcgttagtcctagagtgtcctctatgttcctaatgcttattcctttccagggtgcgtaaccacccacggacctctgcttattggattagttacactcaccgacgtagcaggtcctgcacctgttttcccacctttcttgaccacaaagaaagaggtccgggctattgattctagtggtcctttaatagtgtgcccgacattgcctttacacccaagggtgagttctagagctgggctgggttcctgagtatttcataataaaccccagttaccccatcaagatgcactcccataaacaacagttcttatgcaaattcatttcagagagggtgtgggtaaccttttgagtcaggattgagatagagttttttgattctgtaagtactttcaggcttggctgagtgcaaacagctcgcacgtttgagcagacccattattaggcaattttcttaactctacttctaccagagtttccctcaattactgaatacccattgtgtttttttctcaatcacttgggaggaaccatctattgtcctgtcctgaagggagttcctcctaggtctggtcggaccttagtatggtaaataagatttaaatcccctgttaggaagtctgctgggttaagggaattttcagtggttaacattaaattatctttctctaacagaatagccccatactttaagatttttgagttagtaagctacctttttgcttttttgacttaggatagttctgaactggtgaggtgtgctcacaatggggtttcctctaaaggctaattttctgctctcttctgttagcaaagcagttgccactacagattgaatgcatttggccccccaggggttactgggttaaggatttttgataggaaggctactggttgtcagtggcctcagtgctttcgggctacacccttatttacaatgacaacaaagtagtattggagtgttatagggtcacagagaaaaccttcagttatcaattataagttttaaatttaccctggcttttaaagaaatagggtacactgttttttctttactacttctttctctcttatgttctcctttctgtctttgcagatggatttttggaaacagtggaaggacgttcgctcgttgcccccatttgccactataggaatatgtaccttccttttatttactcaatttacttatatcctgatctattatgttgttgtagacccagttccaattgttaaaatactgggttatcagttctaaggccttggcaagggtggtaggagcgggtcccacctaactgcccatgtcaagagctgtatgcctaaattggggggaacaccagggacaagactccctgggttcatagcctaggggcctaaggacacagcgtagagcttccttagatccctttggagatacaacctgctctaatacttgggagaggaagtgaaagtctgaagcattagtatctaggaggcagggatcagaggaagtagattcagcagtaaggagaattttgcggctacactttcaagaaattcatgctcaggacccaggaagtatgggtcaaaaggaaaggtaggggtgcatgtatggacaactgttgagtagagacttctggccacaccataatctcaacaggctaatgatgggagttcaggacgacagctttctgcctctaatcagccttcagcttccccagaaagtggaagctggttccaggcagaccacgctcccaacccagaagggttgggggttgttagaaagccctttcccagacagcctcacacctgagtcttaagtccagtgtttttaacctgccaactggtgcccggtattttcctccaattctaaggaaggataggacagaatagcaagcgaaagtggtccaatattactcaccactttggaggtcccttcatgatcaccaaaatgttactggggggggtccttgttcttagacctcccaagattgtggcatccactctcaagatggcagcaagccttttgttctctgacctggggttcttggcctcactgattccaaggaatggaatcttgggccatgctgtgagtgttatagctctcttagaagccgtgggtcatggaagagaactgtggaacccagcgactagtgttcagcttgattagcatgaacctgggcacttagctgtgcaggaataatggcgagcctttagcttgatggggggtggcaatgggcgcctcactggatcaggagcacagccgacaccctgccggacctggacaggtggaagtcagcagcgagtctgcgatggtggcattcagcagtggtggacggcaagtgaaagctcagctcgagccgtaacaaacacagaacagaagaatgtgcagttgcaagatctaatagagtgaaaacagagctcccataaaatgggaggggacccaaagggggttgccattgccggctcgaatgcctgggtttatatcccagtcttcaccacggggctggaaggatacgcggtggatcaaactgttttctat

SEQ ID NO: 973 - DNA, 6973 bp, Homo sapiens
ccgacgcgtaccttccagccccgtggtgaagacctgggcacagtgtctcttacctgtaatctcagcactttgagaggctgagacaagaggatattgaacacaggagttcaaggccagcctgggcctcatctctacaaaaaataaaaaataaataaactgaaatttttaaagagaaaacaatttggctataaaagggaagagacagagggaaggttggaaggggataagattaggtggataacagaggggagtgattttgcatgttgaagtgccgtgaggcagtagacatgctgacggtacgagaaaagacagagtgaaagtgcaaggtctgagaaggcaggagaaagacaacggggaaaccatcgagggcatgggcactagagagggagacctcttccactgcaaagcaggaagtgcaagcctggggtgggattcaagaggatggggagtggcatttcctggcccccattctctcctggagtgggagtgacccacctgctgagagcatgggacagtggtcactggggtgaggagaatggaggcaatcggatatgccggtgagaagacactgacttagagaagtgtcatgggactgtctgccagtagaaactctgggtgactgttgaaatggcagtgacagtggacacagagcacagcaccaatcacattctccctcatcgtcataaatgagcattagaaggctggcagttgattgggtgcagtggctcatgcctgtaatcccaatactttggaaggcagaggtgggcgaatcatttgagttcaggagttcaagaccagcctggccaacatggtgaaacgcaggctctactaaaaatacaaaaattagttggtcatggtgctgcctgtagtcccagctattcgggaggctgagccacaagaatcacttgagcccaggagctggacgttgcgggagctgagatcgcaacactgcgctccagcctgggcgacagagcaccgctatgaaaaaaaaaaccaaaaaaaccaaaaaaaaacaaggccagcagttgggtaaaaaccacggctaggggctttcatgccaaggcaccgtctgaaggaggcacagaatcctggaagtggtggactatggaatccaggcaggggcagccaggatgaagcggctaaaggagaagagaggagaggagttggtggtgtgaggtgttgattcagccattagtgcaggattcaggacacaagtaacaggtggtgctgcccagtggcaacacggagcaccacgacacaacggtttccatcctcactcacactgagaaaaccatactgcaactccccaccttaggacttactgcttcatccccaggcatgaaatactgagtccaagtaagtgaaatgatgggttcagcaaatttttcagactggctgttccaatgagaagctattaattttggtgaaaatcaatttatcacttttttctttcactttttgcatcttaagaaatctttgggccaggtacagtggttcacacctatgatcccagcacactgaaaagctgaggcaggaggatcacttgaggccaggagtttgagaccacctgtgcaacatagcaagaccctgtctcttaaaaaaaaatttttttttttttgagacagtctcgctctgtcgcccagactggagtgcagtggcacgatctcggctcactgcaacatccacctcctgggttcaagcgattctcctgcctcagcctcccaagcagctgggattacaggcgcatgtcaccacgcccagctaattttttgtatttttagtagagatggggtttcaccgtgttagccaggatagtctcaatctcctgacctcatgatccgcccacctcggcctcccaaagtgctgggattacaggtgtgagccaccgcatctgaccagttttttttttttaaattggcctggcatggtggtgcgcctgtagtcccagttgcttgggacgccggaggatagcttgatcccaggaggtggaggctgtactgaactatgatcgcaccactgcactccggcctgggcgacagaacaagaccttgtctcaaaatagaaaaaaagaagaaagaaaaaccttttggctaccacagagcagtgaaaacattatcccgtgtttgctggagatgcattaccatccttgcaaaggctcacgcacgcttatatatacatggaactctccagaagaagccgcagggcactagtgagagcagtggcctctggacagggatactgggaattagagaatgaaaggcaacttcccttttttatagttttttatttccttccatatatacatattattttaaaatgtcacataccccaggatcatcaaaagtgatttaaatgggtcacccaggccgggcacggtggctcacgcctgtaatcccagcactttgggaggccaaggcgggtggatcacctgagcttaggagtttgagaccagcctgaccaacatggtgaaaccctgtctctaccaaaaatacaaaaatcagccgggcgtggcagcgggcacctgtactctcagctactctggaggctgaggaaggagaatcgcttgagcccgggaggcgcaggttgcagtgagccgagatcgcgccactgcactccaggctgggcaacacagcgagactccgtctcaaacaaaataaaaataaaaaataaagtcctgtctatcccaggtaaaattaacatgcttagaaccaagctcctgcttgttctccaaacccattcctttccctgtctcccgttccagttaacggcccagctcatccatccctcaaacccaaagcccagtgggcctcacacctgcactccctggctcccgaagcagtgagccccactgctcctctggccaaaatccctaaaaccagctccactctcttgggcaccccacgccctaggagctcactgcctgaagcatctcccaatcccacctgtcctgccccacttctcacacacggtgtccaccgcatcatgggcacgtgcacatgtcactcacgcactgctggggcgacaggcgactgcgcattagtcacatgcattgttggcacgtcaggcgcatgcgcattagttgtgtgcaccgctggggcatcaggcactcgtgcattggtcacgtgcgcccacgggctgcaggctgggaggccacgtgtatgcacggcacttcctccgctgagcccctccctgggctcctggcagcccgccagccaaggatcccctgctcctggctaacgcagtgtgttttgttccacgctaagcgccacttcaaaagcagtcttccccagcctcccttgcagctacgaagggccgctggatgcacctgtgaccaatgacgtgcagcagcggctggtggggtcttccagtaagctccactaagggcctgttccgcgatgcaccctttccttctgccctctgccccaacccccacctgcctggcaccgggacagtgctgaggcgagtaccgacctgcaaccagggcaaaggctgcacgcatggggctgtctaggaagaggagcccgtggctgccacccctctcggggatgcggcaggtcagcggggcccctgcttcagtgccctccacagccctgcctcgggaccaccctgcagagtgcaggatgctgggtttttttgttgttttttttttgacggagtttggctctctcacccaggctggagtgcagtggcgcaatcttggctcactgcaatctccacctcccaggttcaagcgattctcctgcctcagcctcccaagtagctgggattacaggcgcccaccatcgcgcccagctaatttttgtatttttagtagagacggggtttctccatgctggtcaggctggtctcaaactcccgacctcaagtaatccacctgcctcagcctcccgaagtgttgggattacaggcatgagccaccacgcctggccagtttttttggttgttgttgttttttttttttttgagtgcagtggcaatcagggcagcctcgacttctccagactcaggcaatcctcccacctcagcctcctgagcagctgaactacagggcatgccgccatgcccagctaatcttttgcagagacgcggtttcaccattttacccaggctggtctggaactcctgtactcaagcgatctgcccacctcagcctcccaagtgctgggattacaggctgagccaacctcctgggcctttctcttttgttcagccgtatctgttctcaacgggacaccatgctgtgctcatctctgtggacgaaaaaaatgttaaaaaagactaagaaaaaggcaaaccaaggattgactaagcaaaatttgtacttgtttaataagaaaatcacttctttaaaaaaatagttctttacatgctgaggttcatctatgcaatgcaagagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtccccttcactgccttccaggggactgggcacctgcagaagaagaccacatggagaataagaggcaagcactctctccactgctcctggatgcccacaggggcccatgacaggcttggcacaggagccttgcccccaccactccctcatcaggagcagagtctggtgtttgttctcggtcattctcttaaccaggtcaggaacctgtgcagggaaagccaagggctggggacactagaggggcctttgttgggctccttcacatcctcacaggtcgcactgaccacaggggaaaataaaatggggccatttggaaactcaacaaatgcaggtgcctcggaagtatatatgcctctcatcagtggagtccacagcagtccagtctggcccaggccaaatcagcacctgcgctgtatttagcctgcaccgggcttgggaaaaattaactaccagcacttaaaaaagagatttcccataccagtatgcaacgctggtttcccttgataacatttaagcatacggtcactgtcacattccaacatggccaccaccagctgccactgagccacgagtacccccttcagatgaaacgaggctcctggccaccgctggccccccaactccctgccgtccctgggctgggggcctctcatcgccccatctataggacggctcgccaggtgcctggcccctcgcctgcccaccttacctccctggggcctgcacacagttgaatctgccacccaggtatgcaggaaggactctcttttcacagatatctagatgacaggaagaatctccctgagccctgcctgggaatgtcaccctttgaaacctcactgggccaccatgaaagaactcaggctggccggacgcagtggctcacgactgtaatcccagcactttgggaggccaaggcgggtggatcacaaggtcaggagatcaagaccatcctggctaacatggtgaaaccccatctctactaaaaatacaaaaaatgagccgggcgtggtggtgggcgcctgtagtcccagctactcgggaggctgaggcaggagaatggcgtgaacccgggaggcggagcttgcagtgagccgagatcgcgccactgcactccagcctgggtgacagaacaagacttcgtctcaaacaacaaaaaaaaaagaaagaacaaactcgggctttggggacatctctcaccccagagcgaagaactgagaatgacattttcattcacttagcttttagcttctgcacctacaatcctgtatgttccggttctaagctacattccgcagctgtctagctgctgattatgctccatgccaggtccatagtaggtgtgctggcagcaagcctgaccctgggacagccctcccagggtcgaaaagcaccccgtgggggagcaagtgggtggcgcaggcatgcagacaaggaacatctcaagaccgcctgcccctgctcctgcagcagctgtgtggccttgcggggaagtgacacacttctctgtgcctcagctcactcctctgtacaatgggaacaatgtgggcctgtgttctgctgagcactgctgggactgtgcccctaccttggcgcccgtgccacctgccgtgagagcggtggcactgaagttgtggatgggcaaggtgctcagccactgggccatggagcgttcgtcccgctcggtgccgatgatggtggggtagatgtgctcctccttgaaggctgcgacctttccttcctcctgcgcccagtccagcggctcatgcagcccatcgttgccaaagcgctggttgtacttctcgaagtgcaccctctccaggaccaggccgagtccgggcgccttgggcacgtccaccttctctgtgccccagctgcgctccagcacgctctcaggggcataacccttcacaatggccaccaccaggccgaccatcttccggatctgatgcatcatgaagctctggcccttcaccctgatcaccgcaaactccaggccctcccgcacaaagggttcctcgcagtacatctccaggatgtagcggcaggcactgggatcctgcggccccttctgcgaggtgaaattgtggaagttgtgcgtgcccttgtagcaggccaggagcctgttgacctgctgcagcgtctcggcgctcaggcggtaggtctcatcctgaacgtcccggtccttgtgcgcaaaggcaaacgtgggcagcaggtagcaataggtcctggcatcacatctgttcttggagttaaacccgcccgtgacccgcttcagtcctaggggggaggtggtcagggaggagaaaggcaggtgagaagtgcctggatgaccagggagcagcgtcttcaccacggggctggaaggatcagcgctgttcaat

SEQ ID NO: 974 - DNA, 10659 bp, Homo sapiens
  misc_feature (1)...(10659): n = A,T,C or G
agagaaaattgaagcaacgctgttccttccgaccccattgtgaagaccctgtcctcactctgcccagtgccaatgccaagccagtcaccctctgtgtccccggaaggacctagccttgctgtctccaaccctggcagagtcagggatgagaagtgaggacaaacaagcccaggaccacctctgccagggctgggggagctcctccagggcagctgcaggcccaggccctgcgccacaacaccccccgacgggggcccccagctgggcctgtccacccttcccacaggcagcgactctctctagggctcttgaggggggtcaggtgagagcacagcctcaccggccacagctgacctcccctgggcccacccagaacccacacagggcatcgggctccagctctgccttgcagaacccacacagggcatcgggctccacgtctgcctcgcagctacatttggttttcacaagctaccctgggcagtggggaccgggcaagctcccagaatcaagtcacccagttaagacaccagaaagggccacaactgcctccctgggctccaggggaggaaaccggccaccccaggcagagcagctcgcctcccaagacagggtccgggggtccgtcccgtggtgacacacacagttgtggccacaccgcccatgccctaatcaaacacaccaggctccctgcaccatcacccccaccccgggaggtgggtcccaacttgccgcctatttaaagggaggaaacagggaacggctgctgaccattccacagggctgtccctgaaaagtcccaacacatgcatctgaggctcagaacacttcaaaaagacagcaatatcaacaccccactgtctccaggcagcatgcctgagggacctgggacagcactccccaggcaggccggcccccacaccctgcacacacgcacccacggccggccagagccaggtgtcccaggcagcctggcacgggtgtctgggcacgtaggaggctgccccacccctggggtgctaaggtgctttacttaataggatccaggctcccaccctctgccagccctactcttgtctggtgatcctgggctgggcctggtgagcaggcactgacctagttcacacctccagagctggctccggaaagtggcaaaagccacagctgtggctggacagaaccactctgcacccccaggcggggctcctggacagctcccaaaagggaagggatgccggctccaccctaagaaggaagggccaccctctggccctggggaaccacctgcagccgcccattgtgtatgggcctcctggggctgcagcccaaggctgacctctgcagcctcccgcctgctgggcctgggggtctggacaatccgggagccagccgcagggggttgaggcaggtccctagatgcagtgaggcaggggtgggtggcccaacccttctgagggcacgaccttgcttggaaaaagcaggaaacaaccccagtgcgagttggggggtgcagggggtgtaagctgcagagaccctcaggaagacgccaactcctcacattccccccgagacccggccatcctagttggcgcacaccccagtaaaaactgttcccagcagctctgtccttcaggtggctgagacctgacccccagccatcgcggacagatactgataccaggtgacagtcccaccacggggtgctgcgcacaaacaaaaaccaactcctgtcacccacggagacacagcacccctcaacctacggctgacatcccacctccaggcttaaagtcagcatgtggcaaagggagcgtgtgggaaccaggagctggctcacgtgaagaatgagaaagcagagggggaggggggcacacaggaggacggacgtgccctcgataggagggaggagagcggcccgggacgcgggcatggctttgggctggcgcttgctacgccacacagggcctgttgtggtacatcttctcatctgttgtgcactttccagtatttttatcccatgacggggttcctttttttttttttgagacgagtctcgctgtcacccaggctggagtgcagtggcacaaactcagctcaatgcaacctccacctcccaggttcaagcgattctcctgcctcagcctcacaagtagctgggactacaggcgcccaccaccacgcccagctaatttttgtacttttagtagagatggggttttgccatgttggccaggctggtctcgaactcctgacctcaggtgatctgcccacctcggcctcccaaagtgctgggattacaggcgtgagccactgtgcccagtctcatcccattgttttcaaagttaaaaaaaaaaaaaaagatatacacaacttcggaggtaattccagaactgcctgggccctgggagccccttcacaggcccctgcccaggagctgggtacccaccccacgggtttctactcggcctgcatcctgccccaactcacactgcagacagccccccggccagaccaggccaggcctggcagccccctcctcactctgggatggggagttacagtctcatgctgggctggactgcctggacccatggtctcccaggaccccaagcagggctggacacctcttgactcaggtctccactgcaagtaactcacaggcagcggctctgtctgcagggcctgagtgagtcacacctgggtggcccagcaagacctttagctgcaaggaacctgtcagatggcgtgctggccaggggggccaccatcagcaaggccagtagccatcagccctcctcccagggcatgctgggcaggatcccagcctggctccacagccctataccctgatttctgtggtggccgcactcctggggccaggcaagtccagacagggacaccacatgctcagtaaggaggccaggtgctccccaggtgctccagccgcctcccagcggctgtggtggactcaaagagcgtgacccaaggcacacacttcccaggcactcacattttcacaattttgtatggctaaaaaagaaacccaatacacaaaacccaacacaataagaacaaaaataacaacctcaacagtcaacaaacaacatggcggggaatacctgtaacctatcacaaagaagctactttgcttcatatataaaggacacctacctttcaagaacattgacagagcacttacaaagtggcaggcacagttctaaagacttaacatactcaagatgccatcacaaccacaacagttttttttttttttttttttttttgagagagtttcactctgtcgcccaggctggaatctcaggtcactgtaacctcccgctgccaggttcaagcgattcttctgcctcagcctcccaagtagctagggctacaggcaaccaccaccatgcccggctaatttttgtatttttagtagcgacagggttcactatgttagcctggctggtcttgaactcctgaccttgtgatccatccgcctcgacctcccaaagtgctgggattataggcgtgagccaccgcgcctggcaacaccttacattaggatggtacacttgttataatgaattaatcaatattgatacattattattactgaaagtccatacttcagattccctttgtttccctaatgtcctcgttttgtcccaggatcccatccaggttcccaccttgtatcgagtcctatctccctgggtgcctctgggctggggaagttcttcattcttttcatagctgtgtaatattccattttataaatgatgcatcgctgattcaccagttctcttctggggcatatttgggttgtttctgatcctactctaacactactctaaaaaccttgtacctaagtcatttctcatatctgcacaaacgtctttagcataagcaaacgttcagcaaaggccagatggtagacatcttagtatttgcagagcatccagtttctgttattcaactctgcggttgcataaaagcagccagagactacatgtaaatgagcgggtgtggctgtgttccaatacaattttatgtgtgaaccctgagatctgaatttcatagaatttttacatatcacaaaatattcttttttcacaattttttaaaataaatttgtttcaaaattaaaagtgtataacctggccaggtgcagtagctcactcctataatcccagcactttgggaggccaaggcaggtggatcacctgaggtctgtagttcgagaccagcttgaccaacatggtgaaaccctgtctctactaaaaatataaaaatgagctgggtgtggtggcaggtgcctgtaatcccagctacttgggaggctgaggcaggagaatcacttgaacctgggaggcagaagttgcagtgagctgagattgtgccactccactccagcctgagtgacagagagagactctgtctaaaaaaaaaaaaattaagtcacaatatataggattaaataaaacccatctgatgagaatttatggtttgtagggcatgactctctagaccccttagataagaatttgggcaagataaaaaatatgagtttagtcctcacaaagatgttcaacatcactagtggttagagaaatgcaaatcaaaaccacagtcaggccgggttcagtggctcacgcctgtaatcctagcactttgggaggctaaggcgggtggatcacttgaggtcaggaggatcactgagaccagcctggccaacattgtgaaaccccatctctactaaaaataaaaaatgtaggctgggcacggtggctcatgcctgtaatcccagcactttgggaggccaaggtaggcagactgcctgagctcaggagttcaacaccagcctaggcaacacagtgaaaccccgtctctactaaaatacaaaaaagattcgccgggtgtggcggcctgtgcctgtaatcccaggtactcaggaggctgaggcaggagaattgcttgaacccgggaggcagaggttgcagtgagccgagattgtgccactgcactccagcctgggtgacagagcgagactcagtctctaaaaaaaacccaaaaccaaacaaaaattagctccaggcgtggtggctcatgcctgtaatcccagcactttgggaagccggggcaggcggatcgcttgaagtcgggagttcgagactagccttaccaacatggtgaaatcccatttttactaaaaatacaaaaaattagctgggagtggtggcaggtgcctgtaatcccagctactcgggaggctgaggcaggagaatcacttgaacccgggaggtggaggttgcagtgagttgagatcgtgcaattgcactccaacctgggcaacaagagtgaaactccatctcaaaaaataaaataaaatgaatttttaaaaaaaccacacacaactatgataatatggtaaaaacctaaccttggtgaatctgggaagactatgtgggtgctcatggcacccacataagaatcatgtggcattattaagaatcatggcattattcttaagacttttatgaaggtatgaaattttcaaaataaaaagttggaaagagtaaaataaactgttgagatgttacactggccagatccacacatggaacgtggcagaatgaaacgagatgttctgaaacaagatgactttaggtaaatatacaacagatttcaaagacttagcaccaaaaaagggaaagaaaatacatctcattgccaaccactctgtagaagctgaagtgagaacactcgagacatcctggggggtcaacagctgagggacacctggtacctctggggtgtcctatgtctggctgtggtgatggctgcacagctctgtgaatatactggaatcactaaactgtatacttttttttttttttgccaggctggagctcagtgacgcaacctcgactccctgccaccttcgtcttctgtattcaagagattctcctgcctcagcctcccaggtagctgggattacaggtgtaagccaccatgccttgctaatttttgtatctttagtagagatgggattttgtcatgttggccaggctggtcttgaactcctgacttcaggtgatcagcccgccttggcctcccaaagtgctgggattacaggcgtgagccaccgcacctggcctcatccgggattttgaccaagtgcatcaggacaacctggtttccagagcagagacccagccaaagcggctgtagtcaaggaaaggaagcgtatgggtatgggctcaggaaacggtggcgtcctagcgtgtgccaaagtcaggcagggctggaccaagtctcacagcaacagcgtcagaacgcggtttctctcagtccatctctgtgtggggcaaagacggcccagggcagctcctgtgcatccttccccctcagcaggcccagccagagacagactctttctcaaccaatggtcccaaggccacctctctctggattctgggtcaggacctgatcgtggggccaggggcagggaagtgagctgaagccctgggctggaagggattctctacaggaaatcagaggtgctgaagtcagaggaagggagggtggatggcaggcaaagctgggtcgaggactcagaagagggaacgcggccagtgcccccactgcatcatggggctcatacacatctgagacttggaacaggacgctgttgaggggctgtagctcggtgctggcaaggggcttcaccgcggggcttgctggcattgaagggagatggcttgtttatggagcttgggcgacagtggcttgggatgtacaaatgtgagaagggccttacaggcaggccactgttctccccagaaaggcctggtggcggctggtgaactggagatgcttggttagacatcgggaatttgaccttcctcaaagcagctgcctggcaccatggctgctgtgttcccttcaagcctgccaccccattcggacatctgaaagccgctgagatccaagccccgcaagaaatcgctcttctcccatcagctttgcaacgctgaaaaatcatgacggcacggtggctcacacctgtaatcccagcactttgggaggctgaattgcaggcggatcgcttgagctcaggagtttgagaccagactgacgaatatggcgaaacccatgtttctactaaaaatataaaaatagctgtgcatggtggtgtgtgcctgtggtcccagctacttgggaggctgaagtggaaggatcacttaagcacaggaattccggcgagacagagcgagaccctgccacgaaaaagaaagaaagaaagagagagagagaaagaaagaaagagagagagagaaagaaagagagagagagaaaaaaaagagaaagagaaagagaaagaggggagggaggaaggaaggaaggaaaaagaaaaaccacgtattatcatctgtggaggagggtgtggggagtgggcactcaggctcctggtacagcccctcgggagggccaccaggtagcagctattacgattcaagaagcacatgttctgcggccagaattcttggcgtctgctgtagaggaacgctccggtctttgcacgggaaggctaatgcaagcatggtgttgcagcgggatttgtaataggaaagaattcagaaactgcccacgcgcccacccatggccgactggctgatccagggccatgtgtcctgctggctgtggccaagggcatgggtaggggctggagtcccacctgcaccctgtttatggatccatggcctcaccgtggggccacagcacatgaggaatcaggcacctttccaagacccacaaagctgctgtgtaagctggtggctgccctgggctgacaacactgggctatgacccaaagacagaagccaggaagaagggattcgatccaagagtatccgcagggccactcagacatattgctgggatttttttcttttttaaagacgaagttttgctctgccacccaggctggagtgcagtggtgcgatctcagctcactgcaacctctgcctcccgggttcaagtgattctcctgcctcagcctcctgagtagctgggattacaggcacctgctaccatatccggctaattttgtatttttagtagagacagggtttcaccatgttggccaggctggtctcaaactcctgacctcaagtgatccacccgcctcagcctcccaaagtgccgggattacaggtatgagccactgcatccggccaaaaaagtgaattgcatgggatgtgaattttactacagtggaaacgatgcatggatgtcagagcatgtgaagcggcaaggacgatgctgaggccgggagggtccgggcggcaggggcagcactactgcagggtgtggtgggcggtgtggagggcagctggggctgggtataagtgaggtgaccgcgtcggcctctgatgcacgtgtgctgtctccccggggcaccagctcccaggacaggggctctgcctcacttcctgatgtgaacccagcagaggggtccctggtgcctgacttggctactcttgggtttcccaggcaatctacatacctctgggtgcctcagttttctcatctgtaaagtggggacagtagtcctaccttatatggccacaaagatcagatgatttaagacgtgcaatgtgatttgcacaggcctgggacgccatcaaccctgcctgtcgtaactccaccagtgtctggggcgcagaggtggaattctgatctaggggctctggggacgtcaggggtgggctctgtggacaggccagagcgtcccagctggcacggcaccatccgtggagggaacagcggggagagcaaaccctcccgggggggctctgctcaggggtgcctggggtttctgacccctcttccaggggccctgtgtctggcttcggggagacactcaccgtacagctgccagacgcgcaccttgtcctcgtaggggagcccgtagcgcagcgggtcacccaccgggccctggtagtacggccgcatgatggagtgtgcagcggccacatggcttaacccaatggcgtggccaaactcgtggacagccactgcaaacaggtccatcccgtgggcatctggggacacagggagccatgtgaactaagggcaagaagggccctgtccccgcggggagggaccagcaggcccccaccatgctctggggtgaccatggggatgcctcgatgccggctgcgccagagggattctgcagggttactgggaattaacgcgattcccctgggggctctgtggggcctgctgggcttcccaggcctggggtctttgtaccattcatggagcggctgataaccttttctgcataaggccacacagataacaccttgtgcctggggcctgggttacatggggccaggtgtcggtcggatgacctgaggcccaatgctgtgggcactgacccctggccccacaagacgggcctgggctcccaggactgcatggttcccaaggctacagtccagaggtcagaacagcctctgcagagctgagacttctgcagacaacgggacttagcgggagtgacactgagccggggccacagaggcctcgcaggcctcctgctctgtcaggtgctgagaacgtgatgaggacaagctcggctcagccagcggtgtccctgcccgacaggccagcacccagcgaggtcagccgggccgagcacagatgctgtgagatcggcctagtgggaaatgcccagccgtgctcaggagcagccgcgtgtgttttcagccgcagggttggggatgggggggccatggctgctcctcatcctcacaggccgctggggctcctgactctgccctgagggctgccccagacgcacccgaggagcggaaggtccaggcctcgtcatcgtcaaagtgggtgtccccggcggtgtggtggtggccggggaagaaggcgtgggccacggtgccgccggggccgtcgaaggggtagccgtcgttatggtcggccttggagaagtcgatctggatgtcggcggcgctgcccgccacctcgtggaagttcaggggcgcaatgtcgctccagaccttgagggcgtagtacatgagtgcacgcaccgtgtcgtgccccagtggtgagtcccgtgggaacgtccggaccctgcaggcaggggtcagcccagagtgagtcacggagaacaggccacgtgccccaggccgaggttccctgaacgcccctcctcagcccgggggtgcccctatgagggtctcccccatcttccgccttcctccccacgccaggagtcatccgatgcactcacggcggttccagtagttcactgggatagatgacggagggagggaaatgagagcccaggcaggctgagacccccaggccacaggcaaacgtcagctcccgcgtggagccatcagccccagggccctcaacggtgcgtcccgtctgccccatccccctgctccccactgaaggggctctctcggttcaccagccctcacactagccagggcccatctgagatagttttgactccgggggacagcagaaggtgagtgggtcacatagtgtcccgccaaattcacgtccatccggaacctgtcttcacaatggggccggaaggaaacgcgttgntgaaatcatttc

SEQ ID NO: 975 - DNA, 11599 bp, Homo sapiens
  misc_feature (1)...(11599): n = A,T,C or G
agcttgttcgtccggcggcatgtcgtcgcacgcttcggttcttccccgcctacgactagggagcgctaggcccgctggcccgttcttgcgttgcggggtcggctccccgggcttcggccccaagacctacagtggcacccaccctgtgcggccctcgtgtggccccagccccgctccccgtccccgttccacagacgctggggcgcaggggcggctccgccctgcccttcacccgcacggtagaggggtcacggctcaccgcagcctccgcctccgggctccagcggtcctcgcaggcgcgccccaccacgctcagctaattttttcttattttttatagagatgcggtctcctgaaaagtagccactcttttttgttttgttttgttttgtttggggggcgggggacagagtcttgctctttcgccaggctggagtgcagtggcgcgatctcggctcggaatctccacctcccgggctcaagcgattctcccgtctcagcttccggagtagctgggactacaggcgcgcgccaccacgcccggttaatttttttgtattttagtagagacagggtttcaccatgttggccaggatggtctcgatatcctgacctcgtgatccgccttcctcggcctcccaaagtgctgggattacaagcgtgagccacgcgcccggcctttttttttttttttttttaagagaccggcccactatgttgcccaggcagatctcgaactgctgagctcaagcgatcctcccgcctcccctcccgaagtgctaggattccaggtgtggccaccgcgcccaccacttccttgcctcctctcccaagcttgccctcctgtctcctgctttcccttagacaaactcatatgatcctgggcccgcgcagataatctggcataatctcaaaatccttaatcccatctctggggccacaattcaaccaactacaagcttgaatttggggaatgagccatggaggtgttggggagagcgtgttcctggcagtgcaagagccaggaggcaggagacagccgtctgcagcagccccactcccgccctccaggggctgtgccttctcctacaggtgaggactcagtggggcctggggcactgtgcccacctggagtatgcaggtagagaaaccacagggctgcgtgatgactggagggactgataggaaaagaggaccaaggggtccggggccaggttgtgtggggcctcgtgggccaccgaggacttggcattggctatgagtgagatgggagccccagggatccaatctgacaccccttcccaaggggcactcagtgggctgcgagtggcttgtgaggagctggtggccgaggcaggaaggggaggcaggagggagatgcaattgtccagctgggagggtggctcagctgtataagtgaccccccaggagggcacccctccaccagcccaggctccaggactgaggcgggggggtttggacaggcacccaggggggccacagttctgtggcagtgtgggcaccaaggcctggtccccctggcttggagccccgcccccacatggccagtgtgtgcagggatgaggtccttcctgtactgccatggcttcccctgggcccaccctcaccacctggctctggcacaaggacctttacagcagctttatttaccactgcccaaacgcagaaacaaccgatatgtcggcaggtgaatggaaaaactgtggtacctacagacaatggaatactatgcagctctaaaaagaaatgaggccaggcacagtggctcatgcccgtaatcctaacgctttgggaggccaggagggcggatcacttaaggccaggagtttgagaggcagcctggccagcgtggcaaaacccgtctctaaaaatacaaaaatctctctccctctccctctcgctctcgctctcgctctcgctctccctccccctccccctctcgctctcgctctccccacggtctccctctccctctctttccacggtctccctctgatgccgagcggaagctggacggtactgctgccatctcggctcactgcaacctccctgcctgattctcctgcctcagcctgccgagtgcctgcgattgcaggcgcgcgccgccacgcctgactggttttcctatttttttggtggagatggggtttcgctgtgttggcggggctggtctccagctcctaaccgcgagtgatccgccagcctccgcctcccgaggcgccgggattgcagacgggagtctcgttcactcagtgctcaatggtgcccaggctggagtgcagtggcgtgatctcggctcgctacaacctccacctcccacccgcctgccttggcccccccaaagtgctgagattgcagcctctgcccggccgccaccccgtctgggaagtgaggagcttctctgcctggccgcccatcgtctgggatgtgaggagcccctctgcctggctgcccagtctggaaagtgaggagcgtctctgcccggccgcccatcgtctgagatgtggggagcacctctgccctgccgccccgtctgggatgcgaggagcgtctctgcccggctgccccgtctgagaagtgaggagcccctctgcctgccaaccgccccgtctgggaagtgaggagcgtctccgcccggcagccaccccgtcctggagggaggtgggggtcagcccccaccaggccagccaccccgtcagggaggtgaggggcgcctctgcccggccgcccctactgggaagtgaggagccccctctgcccggccaccaccccgtctgggaggtgtacccaacagctcattgagaacgggccatgatgacaatggcggttttgtggaatacaaaggggggaaggtggggaaaagattgagaaatcagatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggtcctctgcctaggaaaaccagagacctttgttcacttgtttatccgctgaccttccctccactattgtcctgtgaccctgccaaatccccctctgtgagaaacacccaagaatgatcaataaaaaataataataaataaataaataaataaaaatacaaaaattagccaggctgggtgcagtggctcacgcctgtaatcccagctactcaggagactggggcacaaaagtcgcttgaaccttgggaggtggaggttgcagtgagccgagttcccgccactgcactccagcccggacaacatagcgagactgtctcagnnnanaaaannnnnnnnnnnnnnnnggcccggcgtaatggctcacgcctgcaatcccagcactttgggaggccaaggcgggtggatcacgaggtcaggagatcgagaccatcctagctaacacagtgaaaccccgtctctactaaaaaatacaaaaaaattagccgggcgtggtggcgggcacctgtagtcccagctacgtgggaggctgaggcaggagaatggcgtgaacccgggaggtggagcttgcagtgagccgagatcgcgccactgcactccagcctgggcgacagagcgagactccgtctcaaaaaanaaagaagaggaagaaactccagaaaattagcctggcgtggtggtgcgtgcctataattccagctacttgggaggctgaggcaggagaattgcgtgaacctgggagacggaggttgcagtgagctgagatcgtaccactgcactccagcctgggccacagagtgagattccatctcaaaaataaataaataaataaaataaaaaataaattagccaggcatgctggtgagcgcctataatcccagctactcaggaggctgaggcaggagaatcgcttgaaactgggaggcggaggttgcagtgagccgagatcacgccactgcactccagcctgggcaacaagagcgaaactccatctcaaaaaaaaacaaaacaaacgcaagctagctggatgtggtgggcacctgtaatcccagctactcaggaagctaaggcgggggaatcgcttgagcccaggaggtggaggttgcagtgagctgagattgtgctactgcactccagcctgagtgtcagcgagagactctgactcaaacaaaagaataaaacacaggccgggcgcagtggctcacgcctgtagtcccagcactttgggaggccgaggtgggtggatcacgaggtcaggagatggagaccatcctggctaacacggtgaaaccctgtctctactaaaagtacaaaaacaaaattatctgggcgtggtggcaggcctctgtagccccagctacatgggaggctgaggcgagagaatggcgtgaacccaggaggcggagcttgcagtgagccgagatcacgccactgcactccagcctgggcgacacagcgagactccaaaaaaaaaggaaaagaaaaaaatcactcatttaaaaagaaagaaaagaaagagagagagaaagaaaagaaagagaagaaaagaaagagaaaacaaaagaaaagaaggaaagaaaggaaagaaagatcaaaactaatccaatcggtctcagccaagctaggtcctggggccacaggaggatccctgcagcctgttgcatgaatcaatcaaccttccctggaacacagccaggcccatttgtttaaataataatgcactaaacaaggcagcggagcggtgggctggcctctgggagaggtgacacagcagcttttagttgtcacaacactcgtttcccaagcacaaagagaaaccaaaggacgcgcagaggaaaggtggtctcccggctggggaggacctgggatgtgagggaagagggagggagggagcagggatgcatgagcccggctctggggctcctgcacccctcaaggcaggctgaggccggcctcgccctggttgcatcacccaggacgccctggggatctccaggccaccgcggcagccgggcccctgatgcaatccacggctgtctggcagcatgacctgccccggtcagcctggactctgccctgcctgggggcccagccctgaccacagcctccagcgatccctcccttcccagggtctgtttacaggcgcttggagcatcaggcgcatttctatcatgaactcacagggtggtgcccagcgagtgtctctgatctgtaaactgggtgtggtggcatctaccctgtctgtggggttgcaggaggaagccacacgcatgtggggagccatgccaggcacacagtggatgcaacaggggagttgctcgttctgaccgtgttcaccatgtctctgatgcgcatcttctcacgtgaaatcagcatgtgtcttaaaatggacagagtagaagttcaactagcaacattgtgtgcttcctactggcacatacgtgaatggtggaggctcacgcctctcaacccagcactttgggaggcccaggctggaggatcacttgagcccaggagttcaagaccagcctgggcaacatggtgagaccctgtccctaaaaaaatttaaattagccaggagtggtggtgtgcacctgtagtcccagctactcaggaggctgaggcgggaggatcacttgagcatggagattgaggctgcagtgagctgtgatccagcctggacaacagagcaagaccctgcctctaaaaaaccaagttaatggtgggtgtgttgtggacggcacccaggttggaaggaaagcagttaagtattgctacgaagctcagctgcacagcatgtcacagaacccatccaggctggggctggagagtgctttgtgaaccagaattggcaatgatgcttgggtgggctgggccctgcacttccatctcccaccgggttaggtgccccagaacaggtctggggtgcgccaggggctctgaatcccctcatccaaggctgccaggggaccgggctttcctgccatctcagggactctgaggagccatcggacagtcggagggagaagagagcaagtgaggaagtcacctctggtataactgacatgagacttagatagttggggtcaaggtggatgtaggggcactttagctgggtggtcagtgagggcttcctggaggaggtggcatttgagctaggacttgcatgatggggtgagcacttgggcagagggaacagctagtgcaaggcctcaggttggggaaacaaaaagaggccaaagttcagggtccacagctccagtagacagagcaaagattcaaactcaggccacaggtccccagggtcagggcacaccccctgcacctcaccaagttatcgacaggaggatggtggggaggggaggccagcgtgacagtgggcagggggcactctggaggcaggggctgggctcgctctgctgcccaggctggagtgcagtggcagcctcatggctcactgcagccccgacctcctgggctcaagcactcctcctgccttggcctcctgagtagctgggactgtacaggcctgtgccactgcacctggctaattttttatttttattttgctagagatggggtctccctctgttgcccaggctggtcttaaacccctgggctcaagtgttcttcctgcctcaacctcccaaagtgctgggatgacaggcgtgagccaccgcaaccagctaagactatattttttagaacagttttggtttcactgcaaaattgagcagaaggtagagggagttccgtgtgtctcccgcacacacagccccccgccatcagctggccacccacggtagccctgctctgacagtcgttatcacccggagtccgcagttcacgttgggactcactcttggcgctgtgcatgctgtgggtttgggcaaatggaagaggacacagatcaccgtggtgccatcacatggggcagtttcactgtccccatatctcccattcacccctctattcatcccacccgctggcaaccactgctcttttcctgcctccagggtttggcctttcccagcttgtccgacagttggaatcatcgtctgtggcctttgcaggcggcttctttcacttagtaacgtgcattgtcatttcttctgtgtcttcagagtttggaagctcttttcctcttggtattgaatagagtcccactgtctggatgcaccccgctgacccacccactcaccgactgcagggcgtcccggttgctgccaggtttgggggatgatgactagggctgccacacacccggctgtctttgctgactcagcagtcgtgcctggggagggaggggtgaagggtcgggggaggggtgaagggggtagggaagggtgaaaggggagggagggtgaagtggggagggaggggtgaaggggctgggcctccccagctgaccccagacctctaggctggagcaggggagtttttacccacgagcctgcgggggcggctttgttgctcaaaagcataaatgcacagaaccgcctttgcctggggctggagggatttcgcaagctctcctcctctctgaaggcacttgggtgtgagaccccaggcctggaggctgtctgggggcctgggaggtgaaggggttccaaaggccccaccctcacccctgtgttcctataggtccagaggttgcctgggcgagggactcaggagtgaggtcgggctgcacctggctcctaggggtcacgagagtggctggggtctgaggaggggacacttgggccgagagcatagaggggaacacaggaccgcgcaggcccctgctgctctgtggccaagcaaccccctgccagggctggcatcttaggtgggtcgattcagcgcctgcaccaaagcttctaacctgtcagcaagatcaagacggcccactcagagcatctgagatgagtgctttgtgcatttggaaaacagagcatttccacagcagccggccaggacagatgtctgttttatttcacagggtcataacgatgccatgtccccatctgttgccgcaggtgaaataggggcggggacaatccagggacatctttcccagcatgcatgaaccagaaataacaccagcgtgtctgagaagaaacggtgaagaaatccaccctggctgtctgtcgggcagccccggcgaggagttgagtccccttaccgctgcgaatgagctgtcctccaccccacgtcggagacctcagcgcccggggccccggcctgttagcacctgcatgcctttgacggcaacccctggcatatgcctgggcctcacagctattggcggagcgcctactctgttccaggcacagggcacagcagcaacctggaccccccaggggtggctcctcctccatcccggcttcctgctggaacatgagcaggcaattcacacaagaagcctgtaatcccagcactttgagaggtggaagcgggaggatggcttgagtcttgggagttcaaggctgcagtgggctgtgattgcaccactgcactccatcctgggtgacggagcaagaccctgtctcaaaaaaaaacaaaaaaaaaaaaaagaaagaaaaagaaaaaagaacaacagaatattaaaatgaatatgtaaatgcaggaaaatctgtttttttttttcctaagaggtgggaggaaagacaatggaacctggtggataagaaagaatttctgtctgtcagttgcctcagcctacaacgtgatgtacaacagctcaaagacaacgaaaagctagaatctgacagccctggagtacctgctctgatttaaaatgcatagttttcctgtgaaacacaggtgtttttttttctatactatggtgctatttttataaagcttaaaaacaagcaggccgggtgcggtggctcacgcctgtaatcccaacactttgggaggctgaggcgggtggatcacgaggtcaggagatcgagaccatcctggctaacatggtgaaaccccgtattagccaggcgtggtggcaggcgcctgtagtcccagctactcgggaggctgagggaggagaatggcgtgaacccaggaggcagagcttgcagtgagccgagatcccaccactgcactccatcctgggcgacagagtgagactgtctcaaaaaaaaaaaaaaaaagcaaagctggaaaagatagcttctaggtatacacatgcacatacgcactaagatcgcttctaggtatacacacacatacgtgctaagatagcttctaggtatacacacgcacatatgcactaagatcacttctaggtatacacacacatacgtgctaagatagcttctaggtatacacacgcacatacgcgctaagactgtttagtgagaagcaaggagatgatgcagtgtcagcggggagtctcgcagctgacacagggtgagtcctgtctgactccatttatgtgcagtccggggatgggcacgctaatgtccagaggctgagatcaggacagtgactcactcgtcaggaacgacggggcacctgccagcttcctagggtctgagatgccctacatcttgaggggctgtggtgacacaggtgtgcatgtgagcaaaaatgaatcaggctgtgcccttcatattagtgcacttgactgagaatcggttacacttcagtagaaataacaaaaaacaaaggaataataagcgcaaaactcaggcatgagtagcctggttggggaggttgggaggatgggatgggaggaccacagatgacaatgaaaatgactgggccgggcgcggtggtcacacctgtaaccccagcacttgaagaagctgaggtgggaggatcgctggaggcaggagttcgagaccagcctgggcaacttagtgagaccaccccccccgcccccaatctctacaaaaagtaagaataaaaataaaacagccagtcatagtggtgcacgctgtagtcccagctactcaggaagctgagatgggagaattgcttcagccagggaggtggaagctgcagtgagccaagatcctgccattgcactccggcctgcacgacagagcgagaccctgtctcagaacaaacagaaaaaataaattggagatgttcttagttttgggtgaggtggtgatttacagggtgttccttatttaattatgctgtttatatgtgctatgtatattattatgtatgtattacatagcaataaagaaaaaggtctgagaagattatttaagtaaacatacaggaattcccagtatgttcttttttcttttctcatatacagtatttcttcttcacgaaaattttcaagcttagaaaggagttgacttggctgggtgcagtggctcacacctgtaatcccagcactttgggaggccgaggcgggcagatcacctgaggtcaggagttcgagaccagcctggccaacgtggtgaaacccccatctctactaaaaaatacaaaaattagccaagcgtggtggtgggcgcctgtaatcccaactactcaggctgaggcaggagaatcgcttgaacccaggaggtggaggttgcagtgagctaagatcaagccattgcactccagcctgggcgacagagcgagagactccgtctcaaaaaaaagaaaaaagaaaaaagaaagtagttgactgggcctggcgcggtggctcacacctgtaatctcagcactttgggaggctgaggtgggtagatcacttgaggtcaggagttcgagaccagcttggccaacatggcgaaaccccgtatctaccaaaatacaaaaattagccaggcagggtggcaggtgcttgtaatcttagctactcaggaggctgaggcaggagaattgcttgaacctgggaggtggaggttgcagcgagctgagattacgccactgcactccagcctgggcaacagagcaagactctgtctcagaaaaaaaaaaaaaaaaaaggagtggactgtaattccggcactttgggaggctgaggcaggtggatcactggagccctggagtgtaagaccaccctgggcaacatggcaaaatcccgtctgtgaaaaaaattcaaaaattagccgggcatggtggtgtgcactggtagtcccagctactagggaggctgaggtaggaggatcgcttgagtctgggagttggaggctgcagtgagctatgatttctccactgcactttagcctggggcaacagagtgagaccctgtctcaaaagaaattttttttaaaagaaagtagttgaatgaacagccttttataagcaccgcacctagattccagcattgtgagggctttggatgttgctttatttatttttgtgcttgttatagcaattttgaaataaaaacagatatcatgacatgtctctcctaaatattttctctctctctcgtcttcaccacgggcccgcaaggatcgcgcgtggcgcaattcaa

SEQ ID NO: 976 - DNA, 14997 bp, Homo sapiens
agcctcccaaagtgctgtgattataggcatgagccatcttgcctggcttttttttttttttttttttttgagacagagtctcgctctgtcacccaggctggagtgcagtggcgcaatctcaactcactgcagcctctacctcccagattcaagcgattctcctgcctcagcctcccgagtagctgggaccacaggcgcgcaccactatgcctggccaatttttgtagttttagtagagatgaggtttcaccatgttggccaggctggtctcaaactcctgacctcgagatccactcgccttggcctcccaaagtgctgagattacaggcgtgagccaccacatctggctgcctgagaaagatcttgatcaaagggggaaatatagccaagcacagtgtctcacacctgtaatcccagtgcgttggaaggctgaggcaagaggatcttttgaggtcaggagttcacgaccagcctgagcaacatagtgagacccctgcctctgccaaaaaaaccttaaaaattagctgggtctgggggtgcacacctgtggtcctagctacttgtgagatggtggtgggaggattgcttgagcctgagaggtggaggccgcagtgagctatgattacgccactgcactccagcctggacaacggagtcccctgtctcaaaaaaaaacaattgcctgggtgcagtgactcacacctgtaatcccaacattttgggaggccaaggcagcaggctcccttgagcccaggagtttaagaccagcctgggaaacacagggagactccatctttatttattttttaaaaatttaagaggccgggcatggtggatcacgcctgtaatcccagcactttgggaggctgaggtgagcagatcacaaggtcaggagtttgagaccagcctgaacaatatggtgaaaccccatttctactaaaaatacaaaaattagctgggcgtgatggcacacacctgtaatcccagctactcaggaggctgtggtaggagaatcgcttgaacccgggaggcggaggttgcagtgagcggagatcatgccactgcactccagcctgggcgacagagcgagacaccatctcaaaaaaaaaattaaaaaatatttttaaaaaggggaaataggaaagttttcagaatcaaaatagagttattagtgtaaaaaaaaatcacctgacaaatacagccagggaagattatgaagggagggttcgcagccttgtatgcctgataaaaactaccacgaaagactgcaaaaaacacaactttgcccagaaaatacttctgcaaggaaatctgcccagcaactgcctgtccaaccccggattggcatcatcttgtcattcctcctcgtagccaaggataattggcttaatattctcatttcaaaacaattatggcgtcctcattttcctttaaaaccctttttcttcctttaccccccttaatatacacatagtttactatggcacacacattccctcccaaataaatatacatatcctctagagagcctctttctgtttcatatttaggttgggaagttctaataccattctccaatacaaggaacccagggccaggcacggtggctcacgcctgtaatcccagcactttgggaggccaagacaggaggatcacttgagcccaagagtttgagaccagcctgggcaaccttgtccctactaaaaataaaaaattacccaggcatggtggcatgcacctgtggtcccagctactcaggaggctaaggtgggaggactgcttgaacccaggaggtcaaggctgcagtgagctatgatcatgccgctgcactttagcctgagcaacaaagcgagaccgtgcctcaaaaacaaacaaacaaaaaaaaagcaaaccaaacaaaaaaacacaaaacaaggactggggcaggaaacacacaaccttatagttgcagaaagtaaaaacgtgctcaacacaaacaaaatccccagtttagggccaggtgcggtggctcacgcctgtaatcccagcactttgggaggctgaggcgggtggatcacctgcggtcaggagttcaagaccagcctggccaacatggcgaaaccccatctctactaaaaatacaaaaaattagctgggcatggtggcgggtgcctgtaatcccagctactcggaaggctgaggtaggagaatcgcttgaacccaggaggcagaggttgcatgagccgagatcatgccattgcactccagcctgggcaacaagagtgaaactctgtatcaaaataataataacaatacattttataaataaataaatgtcacatgagatccagacggggccctggcacagaaaaaaggacattagagaaaaactcagggaacctgaataacgtgtggattatgcttaatgacaatgtatcattacggtccattcactgtgaccaacgttccatgataagataaaatgttaattacagaggagagtgagtgtaaggtgtatgggcacttcagccattatggaaattaaaaatagaactgccacagggcctgacagtccttcccctgggcctgtacccgaaggaatccagctcaccacccatccaggtgtccacactcacacgtccaccacagcactacccacagcggccaaagcagggaactacctgggcattcatcagtggccggacagataaggagactgtggtgtatatgatcacgtggagagaggtgatggactattgttcagccttaaaaacagaggagatcctgcatttgccacatggatggactaggggtcacgatgccagcaagacaagccagacacagaaagaaacatcacaggatctcactaatatccagaatctttaaaataaataaataaaggcaggcgggggtattgggtgcggtggctcacacctgtaatctcagcattttgggaggtcaaggtgggaggatcacttgagctcaggagttttgagaccagcctgggtaacatagcaaaaccccatctctacaaaaatgtttttaaaattagttaagtgtggtggtgtgcacctgtggtcccagctacctgggaagctaaggcgggaggattgcttgagcccaggaggttgaggctgcagtgagccgtgatcataccactgcactccagcctgggcaagagagcaagaacctgtctcacaaaaataaataaataaaaaggtggggatcaaatatataaagacagagaataaaacagtgggcgacagggtgagccccttcaaaagggctcgtgtgcacctgagggctgcagagaataattatgctccaggcgtctgctaatgcatgggtcatggttgcgctggctgtgggaggaagacaggtgcctgggagatgatgcaaaactcacccgttctgctgtggccaccaatttactacgtatacgtaccctacaccaccacaacgtacaccgtaaatgcacacgataacatttatcttttaaaaagatacgtggggcggggcgcagtggctcacgcctgtaatcccaacactttgggaggccaaggcgggtggatcacctgaggtcaggagttcgagaccagcctgaccaacgtggagaaactccgtctctactaaaaatacaaaattagctgggcgtggtggcgcattcctgtaatcccagctactcgggaggctgaggcaggagaatcgcttgaaccaaggaggcggagactgcagtgagctgagattgcaccactgcactccagcctgggcgacagagtgagactccatctcaaaaataattaattaattaattaattaacatttaaaagtcaacaacgaggggctgaggacctccattggtggtgttcgtggcagcagggaagccaggtaccagtgcatgaggacttggaaccaggacttcgaagacgctgggctgaggagaagaccaaccaggctggggctggcatagggtccagggagggcccatctctgaaatgggtgacataagccaaacacagtgttttgtgctcaggcctctctgcactgggcttcctgtcacttacacccaaagagccttgaatggaattcaccctgagcgatacaaccaggggcacagcaccccctcctcactgcctgacacgagggtcctgggtccccacaggagcaaccgtgggcagggccacctgggagctgcccgtcagagtgtctgcacccggatggctacagaccagggctgggcacctctggctttcctacaaccttcatgtcacagctaggagccccaagcgtgtgtcccacagagctccgacaatagtgcccgcctgtcatttgcccatcttcatggtccacagacaacgctacctgagtctccagccaggggctggaaatgagctgatgggcccagcccaggtttaatgctccaggcatggggcagcatcactaaaccctgggctgacagggacaaaggtggcttttctaaaggaaattgcagggtaagggagatggatagcaggcaaggctggatcagggggctcagaagatgtgatgcaacgtgtggatgtgcacgtggcaaacataaatacaagatacagttattgtgggtcttttctgctttctgcttttcttgcttctcataaattgtttaatttgctcaacagtatgtctgaggccgggcacagtgactcacacctgtaatcccagcactttgggaggccgagttgagtggatcacctgaagtcaggtgtggcatttgagaatagcctgaccaacatggggaaaccctgtctctactgaaaatacaaaaattagccaggcttggtggtgcgcagctgtaatcccagctactcgggaggctgaggcaggacaatcgcttgaacccgggaggcggaggttgccgtgagccgagattgtgccactgcaccccagcctaggtgacagagcaagactccatctgaaacaaaacaaaacaaaaataacatacactctctccccgtttcagaggactgggtggaggctatgtccgcctcccctggaagccctcaaggacccacagaagtctcgagcctgccagtgtgcagcgggggacacagatccgccctctgcaccgggagcatcatgtgaagtctaagaaagccctgcaggaccagccgtctcacacttgtcgtggaaaatcccatcagcacacctctgactcccacgtgggaatcaccaggccatcaccatcaaaccgccctcccgcaggcaaaaacggcaaacgcagccctcccatgctcaagggaggtctcatcgctctgccatagtcctcacaaatctccaaatacaaccaagatgtgtctccctcacagccctcgtccaagccactgtctctccctggcaaatcccagccctgcaccctcactggccccacgtccacccattctcagaacggcagtcagatggacctgcagaacctccgtctcatcaggccccactctgcccaaaaccctcccgtggctcccctgagcccgcacagtaaacacagaaatccctgacaccccagcgtctcctcagactctccagagcacccagcacatccctgaagcacccagggcctccccagagcattcagcacccagggcttcctccgagcacccagcacccagggcctccccagagcacccagcaccttcctagagtacccagcaccttcctagagtacccagcatcaggcagaacacccagcatgacccagagcacccaggagcacctcagagtacccagcacctccccagagcactcagaacctccccacagcacccagcatcatccccagagcacccagcacctccccagagcatccagcaccaccccagagtacccatcacctccccagagcactgcctcagagtacccagcatcttcccagagcacccagaaccgccccagagtacccagcacctccccaaagcacccagcaccaacccagagcacccaccacttccccagagaactcagtacctctccagagcacccagcacctcctcacagcacccaccaccaccacagagcacccaccactgccccagagcacccagcacacagcacctccccagagcacccagtacctccccagagtacctagcacctccccagagcacccagcacacagcacctccccagagcacccagcacctcccagagcacccagcgatctccagagcacccaacaccactggctgcagggcctgtgtgcagcctccttcagctcctgcaggctcggcttccctcctcgacaaacaccgcccccctgcctcattttcctaccaacatctgatcactgcacactccacccacgggtgacacactctcacaggtacagccccatctgcttggctgccttttttccccactggaatacaggaagatttacagaagatttcacaagattaaggatttggcctgtttggttcaaggctgtggccccagcacctggaacagtgcctgtggcttaataggtgttcgttgagcaaataaagagtgacagaaggccgggcgtggtggctcacacctgtaatcccagcactttgggaggccgaggtgggtggatcacttgaggtcagaagttcaagaccagcctggccaacatggtgaaagcttctctactaaaaatacaaaaattagccaggcgtggtggcctgtgcctgtaatcctaggtactcaggaggccgaggcaggaaaatggcttgaacccgggaggcggaggttgcagtgagccgagatcacaccactgcactccagcctgggtgacagagcaaggctccgtctaaaaaaaaagagtgacagaaatgcaggcacctgcatggcaccagccgagtgctgggaggagcccaggccccatggaggctcctgccagagccagcgccaactgccatacgacaggagcaagccaggccccccaccatggtgcaagtgcaggggagaccagcggcggaggccaggcaacctccagagagagggagggagacagagagacagagagagagacagggacagggagatagagagagacagatgcagagacagagacatagagtcagagacaggcagagacaaggagagacagagacagagagacagggagagggacagagagagagagacagagagacagagacagggagagagacagagacagggagagggacagagatagagacagagagacagagacagatggggagacagagatatagagacagagaggcagaggcaaggagagacagagacagagaggcacagagagagagagtcagggagagagacagagatagagacagagagacagagacagggagggagacagagagagacagggacagggagagagacagatggagagacagagatatagagacagagacaggcagagacaaggagagacagacagggagagagacagagagacaagagacagggagagggacagagatacagagagacaaggagagagaaagatagagactgagttggagagacagacagagatacagacagagacagagagaggcagagacagagaaacagactgggggtgacagagcgagcgagaaggcaaggatcctgctgctgttaagtggagaagccgtgggggtcctgtcctgcagtcacggtggaaggaccctgacccggtggaggtggagagtgtggccagcagtggctctgtctcctcggctcctcccatttctcagccgcagcgggggtcctgcctgcctggcctgggctcaggggggcggggtgcagagccaccctggcccatcacagcttggggtgaagcagcccagagccagccgccccgctgcagccacggcgccctaaaaacggcccgggagctgggaggggcggccctggcttgcgctgtagtcacacctgtgggtccagctcggctgccccggagcggtgtgctctggcgtccttaggattcccacgagagtgtcctgctacctgcggtccctccgcctgggcaagggagtgctgctctcagcccgacctcagagtgtgcccgctggcttcacacttggctccgcccctccctgaacacctgggctcggacagctctctgccagctctgggcctcagtttcctcatctgggaaacagaagtaacccagtccctccgctcagtgtcgctgccaggattcagtgagtttgcagtcgcagatcgcagggcaggcccggcatcttagctgtcactcatgctgctttggggtgatctgcctcccgccagagcctcctaagcccccacaatccactccccacagggtttctgaaggaggccaggagggtggcagggagggacaggtgcggctgggatctggggccacccacccaccgggcagccttggcccatccaccctggatgttatgcactgaatgtctgtgtctcctcagacatctttgtgtgtgtgtgtgtgtgtgtgcgtgtgtgtgtggtttttaagtttttagtagagatggggtcttgctgtgttgcccaggctggtcttgaactcctgggctcaagcgatcctcctactttggcctccaaaagtgctggaattacaggcataagccaccgtgcccggccaccagtcacattttgaaaccatgaccgctagtgtgatggtgttaggagggggcctttggcaggcgatttgggttagatgaggtcgtgagggcggagcccccacaatgagattggtgccctggtagggggtgaagggaccagcactttctctctcgggcttgtgaggacacagtgagaaggtgctggctttgaaccaggaagcgggcctctaagaacctgaccctgccggcatcctgacctcagactcctgcagattggtgggaaagcaaatgcctgtgtggaagccgcacagtctatagcagcctgtcacggcaagctgagctaagacaccgtgcctcagtttccctccctgtaacacggcagctggagagggtgtgtcctggcctcagaggtcacccatgtggaagccgcatggtctacagcagcctgtcacggcaagctgagctaagacaccgtgcctcagtttcccttcctgtatcatgggagctggagagggtgtgtcctggcctcggaggtctcccatgcagaggcgttgtatagcacccatggggctgtgtgtttttggtcaaaagcctgggtcacgctaagggcagccagtgccttggcccggccgtgtggctcaagagagaccctgggcctccaggctgacctccctggggtggaaggaagaagggaagaggtccttgcccctcactggggtggcgtgggtcctctgacctccttcggagggttttgactgtggctgtgggctggcgatgccctgcctcctgggcctgggggcacagcttctccaagttgggccagcacagcctgaggtataagcagtgactctgaaaatccagaacgtcacgtgaagtctccaggtgtttagatggtgactcaggcgaagatggaaaactgcctgctgaagacacagaaccgaggtcccatcacgaggaaggtgcaggcggacaggccgggggcatggaccacagaaggacgggccggcagccctcataggtgcgaggtcacaggggtcggggaaggcccgggagctgtgccgggccaaagaaggctgccctgggtgaggtctgtccctgcagcatcctctgatctgagatccactggctgcgtgtctttcccaactctgaccttgggaggacacctgcgttccaggagacacagaagcgagctcagggtggtcagcgcctcccaaaggatgcagaggactctcatgctgcgggtgcagctttctatgaacatgagatcctttccacaaaacaacacgccctgcccgcgtgttcctcatccgagacgcgcaggaccagaaaagtgttttggagctcagattgtttggagtttggacactatatttgcattatacttacaggttgagcatttttctctgcttttcttttttcaaatactgccacttggccaggtgtgttggctcatgcctgtaatcctagcctcacctcagggaggctgaggcgggtggatcacctgaggtcaggagttcgagaccagcctgaccaacatgctgaaaccctgtctttactaaaaatacaaaaattagccaggcgtggtggtgcctgcctgtaatcccagctactcgggaggctgaggcaggagaatcacttgaatctgggtggcggaggttgcagtgagctgagatctcaccactgcactccagcctgggcgacaggctctgtctcaaaaaaaaaaaaaaaaaaaaaaaaagtgaaatcccaaatgttctgtgtgcaccccgagcccatcagtgctcaaaaggtcttgggttttggggatttccgactttgaatgtggggtcagggtagcctcagctgcatgtgcatatcaaaaggtgggggctcatgaaatgcgtcatgggctggcggggctccaggccctgccccaggacccagcacggccaccccactgccagagggaggtgggctgcagcatggagaggcaagttcagagcagcccccctgccccgcctacggttcacctcttcaccagagataggaccggcagaagaggcttatgacggagagtttggacttcaaaaccgcagtgagccctgccaacgtgagagcccgactcagcagacaaggcccacagccggctttgcactggggcacgacccaggacgtggggaccacggggctgggccagctgcacgggggaattcaccccacaggctgctgggcaacaaagcgtgatgaggaaacaccacttggtgcagggcagagccagtgtccccgacagacaggagggaggtcggtctttccacagactggtctgacaggcagggactcctcctgctccagggagcagatggtgaacaggcgggggacagaggacacggctggactccatgaggatgtggcctctcttcacggggaggtggcccggctccatgaggcctggcctggggcctgcctgcccggccctggcagcctcatcctgggatgggtgccatccctgggatgggacaagggggctgtgggctttggctcctgggtgccaggaagcctcatctgcaccctgggtggccccagccgctccctatgctgggcctgtggtcaggaacttcctgctatgtgggagtgaatcccccacagtccaacggccacctcctcatcctcactgagtcacgtttgagggggcacccgggccctccacagcccagggcagatgctggtgagccagagcctgaggccccgaacctgtggcccggggtgcgtctgtgccgcagagaccagaggactgtgcaccagcgggaggactgggccctgcagagtggcatcggctgcaccctctgaacaagagggtactgcaggacagacgcgtcactcgccggccagagtgggggcaggctgagggactccgctgtggatctggaggctgggagcaaagggagcaagtgacagagtggctggagctagaatcagccccttgcagggagcaccctccctccctcttgcgcagggagcacctaccctccctcttgggcgcacccaggtcccggtgctcggccgggcatcatggtctagtgctgcggggcagacagcgtcccaagtggctcacccaacaactgatgcctttcctcgggcacctcccacactcagatctcactgggccagctggcgccccgcccgcccgtgatgcccctgcctgtagcactgaggctcatcccccgctgggcctcaactctcccatctgtgacaggggcgtggggactcctcggggcacgaggactggaagagacagcgcgggacgggctgatgaacaaggaggaatgcgactgccgagacctcctgggaagcccccaccccaagtgcaggtgcgtgggcccctggtcagggtcaagccccttgaggcccgagggtacccactcccatggccctggagcaccagggagcccagccgagccgctagaaagcagggagaggtcatgttggtctggaacgcgtcacaggggggacgtgccgcggcaccatgtggggggctcgtctgtggggagggctgccccactggggacctggggacggaggccctgtgggccggcgggagcaccaggcagcagtgtgggtggggttggtggcgccggcacagagaggggtgggcccccagcccgagatgctccctccagggccggaggaggctggcggcggtgcggcctgactgggcacccttctggagcggccacccctcggctcgtcagtcaacacagtccctcactaggggacagctccgtccttgccacctgagcctgcccagccctggcggacagtgccctctgctggccttccggtgccagggtggcccgtcctcatcccgcgccagcacctcccccagggactccggcacagtccttgccctctgtggccaggctgtcccaccgcctctgtcctctcatgggctcgcgctgtgtgtcatagcgtcagggcctgggccgctgtccacagggcgcctggtgacagtggcggcagcagcagcagcatggtggcagccaccagtgggcctggggcccccgggggagaggatgccccagaggtgcatgagcagacctcgtaaccgtcctccgagcggctctggtcatgttgtcctggaggggcgcggggcccctctgccgcgtccacgcccgcagccacagatccatcggcctgtgagtctccacacaccagccagtcccggaccgtggactgtgggtacccgggtgccacctccagctcgccatccagcactttccagtactcctggccacggaagaagtaggaggcacttgagaagaggagggagagctgagctcaggggagggctgcagcaggaggggctcgagccggacagcgaggagggagcgttgggctcagggagggctgcagcggaaggggctcgagtcgggccagacagcagggggcttgcacaagactgcagtggggggtcagaccagacggctggtggggggcggctcgtgctagatggcagggggtgcccagataatatctgagatggggtcagcatctgctcagctgtgggcagctctgcaggcatggtcacaggcctgggaagctccagaggagcctgctggggcaggggatggaccaggagaccctcagagtctctttcccttactggatatttattgagggcccactctgtgcagggctgttccaggtgacaaggatgcagcgttgaaaacaaaacagaggatgctgccgtccctggagctgaccctgtggggaggtttcttctacactgtgggacgtggcaggggtgatgcccaggagggcgtttggcagggctggggccggcgagggaggggctgtgtggacatctcaggaaagtgtgcccagacgaggcatggccagtgccaaggccctggggcaggagcgtggctgggggagcagcaggggcgagggagtgctgagggcggggagaacaagggcagctcgtgggccaggccttcggggagcgactcggggacgcctgcagggtcggcagctccaggcgaggggctgggaccctcagagcccacaccgaccggggccgtcctcctttcagggaacctcttggctgccctgtagtgatgcccctctcctggtggggaaaccaaggccgcatggcccgtccccccagctggcactcaccgtcggaccagcgcatggcgtcgtccagcgtgctggggacacccctccacagggggctctgggcggggtagccggggtccatgtgcctcgtgtggtcatcgtaacgccagtacagctggtccttaaagaaataagtcctgtcattgcgggcccaggagaaggcagcgtcgatgccgccaggcgggagggtgaagacgagacggggcgcgggtatccttcctctacgttattgtccttgaacacccagtacctgtctcctgggggcgagagaaacagctgtgggccggggctcggccccaccccgaagggcaggaggctcctgcctttccttctcctgtgtcagccgcccttgccctggcccctcacctgggcttgatgggacagcggccacactgcaatcaccccacatcacaggggccacatggatacttagtgagcacctactgtgcccagtccgggccatcccatccagcctgtggacgctgccggccacccctttaccgatggaaacaacaactcgggccaaaccgaggcccacgacatgccatcctattattattatgatcattattttttgagacggagtcttgctgtgtcacccaggctggagtgcagtgacttgatctcggttcactgcaacctccgcccctgggttcaagcgattctcatgcctcagcctcccgcgtagctgggattacaggcgcccaccaccacacccagctaatttttgtatttttagtagagacggggtttcaccatgttggccaggctggtctcgaactcctgacctcaggtgatttgcccgccctggcctcccaaagtgctgggattacaggtgtgagccaccgtgccctgcgttaaatacacttttctcccaagaaatatagatggcattgagcacttgaagatggtcaacgtcactagaaacgccctcaaaaccacaatgagacgccccctcgcccccactgtcaagaacgtggaaagtcacctgtgtcgggaggatatggggacggcagagccgggcgctgccggggagggagtatgaaattgtgcagccgctgcgggagacagaacataggctccccaaaacgtcaaaaatagaattaccacgtgatccagcattcccgcttctgggtataaatccaaaagaaccgaaagcagggtcttggagagacgtttgcacactcacgctcatagcagcgtccttcacaggagcccgtcttcaccacggggctggaaggatccgcggtggcgttaccgggtttgaaaggggccgtcaaat

SEQ ID NO: 977 - DNA, 20119 bp, Homo sapiens
  misc_feature (1)...(20119): n = A,T,C or G
gtgaaacaacatttgacgccacacgcggatccttccagccccgtggtgaagacacaacataaacactgaagaatagatacaaacttcactaatcttataaaaatatctacaagaaccctatacactatgtccatttatgaaacattaaaggtatcatcatagtcatcctgagagcagcagtgaagagcacaccgtaggacacgtcaggccaaggcttccacgcactgcaaatcctcagaagaacactggttatcccatttacaactgagaaaaacaccacggagagctcagacaacctgaccgaggccgtggggtcagtaggcaacaaacattaggtttgaaccatgcagttatgactcaaaactctaataatctgcctttctactgaaagtgctctctttcaaagcaagaacaagccaatgttgtccaccactagcacgaactcaacactttactgaaagtcctacctagcacaaaacggcaagaaaaagtagtataaaaggaacaaggattataaaggaaaaactcttcagagaagtatacaaagactttgtatacaagactgtatacaaagtctttgtatacaagactgtatacaaagtctttgtatacaagactgtatacaaagtctttgtatacaagactgtatacaaagaattaacaaacagagttcagaaaagttgctgagtataagagaaataaaatcaactgtactgacacataccagcaatatatttaaaatataattttagaaaatataccatttagcacaacttttaaaaatatatagtacctagaattaaatctaacaaaagagacacaatcatgaaattttatggaaagctatttaggaagacctaagtgaaggggagaactatattttgatcatagactggaaaggctgaacttcataaagacagcaattctcacaaaacatccattaatgcaattaaattctaatcaaaactcccaataggtttttctgtgaaacttgatgagctgattctagcatgtttctgaaatagtccccaaatagacaagatcctcctaacacagagcaaggcagaagaacttacctaaccagacatcaagaactattataaagctatagtaagaaagacagtgtggtatcagtacagactggtacaaatttgccaataaaagaataaagatcccagaaagagccatgcatagaaggaaacctgttttacgtctgagctggcacttaagatcagtggggaaaagataggcttttcaatatggctttccaaatatgcattttggggaaaaaaaggaaactgcactcatttcacaacctaagagtaaaagcagaaaaattttagatgatatatctttgtgaacaagattgacaaattcaactacagtaagtcctcactaaacatcatcaataggttggttcttagaaattgtaactttgagcaaaatgacgtatagctgatcggtggacaacttgggttggaactgtgagggtcctcttccatgcagattttatccacagcaggaccaaccccttcccctccccctcccccactccctcctcatcctactcaacgtgaagatgacgaggatgaagacctttataattattcgcttccacttaataaatagtaaatgtattttctcttccttattttttaacaacattttcttttctccagcttactttgttgtaagaatacagtacgtaatattaaatacacataacatacaaaataggccaggcacgatggctcacacctgtaaacccagcactttgtgaagccaagatgggaggctcgcttgagcccaggagtttgagactagcctgaaatcccgtatctacaaaaaacacaaaaatcagctgggcgtggtagcgcgcactatagtcccagctacttgggagcctgaggtggaaggatcgtctgagcccaagaagtcaaggctgcaatgagctgtgatccgccactcactccagcctaggtgtcagagtgagactctgtctcaaaaaaaaaaaaagaaaaagaaaaaaaccacataaaatatgtgttcatcgactgtttcatgttattgataaggcttccagtcaacagtaggctattagtaagttttgaaggagtcaaaagctatatgcaaattttcaacagtgcaggtggtgggggcgggttggcactcctaatccccacattgttcaagggtcaactgtataacaaaaccaatttttttttcctcatggctataataaaacaacattaatgtaacgtcatttcacttaaagttgcagtttccaggaacttattgacaacattaaatgaggacttgctgtatgctgaaattaagaacgcctttcatcgaaaggtactgcaaagagtgaaaagacacaccaccaactgggaaaatgtcactgcaacacagaactgaccaagaattcatgtccagaatatataaagaccatcaccaacaagtcaataaggaaagaaaacaccaaaataagccaaaatgaacaaaggaagaaacacgaaaagatgcttcacttcatcagttatcacaaaagtgcaaattaaaaccacaaggagatactactttttacccccagagtggcagacaatatcaagagttcttgagatgtgttacagcaattaaagaatggcaataaaactaaagatatatatatgtaattgtttttaaaaagagttccttcttaggctgggcgcggtggctcaagcctgtaatcccagcacttcgggaggctgaggcgggtggatcatgaggtcaggagatgcagaacatcctggctaacatggtgaaaccccatctctactaaaaatacaaaaaattagccgggcgtggtggcgggcggctgtagtcccagctactcaggaggctgaggcaggagaatggcgtaaacccaggaggcagagcttgcagtgagccgagatcacgccactgcactccagcctgggtgacagcgagactccatctcaaaaaaaaaaaaaaaaaaaaaaagagttccttcctgagatgtggagcttggcacccccactctaaacaacagttactctcctgcccctgagcacaggcaagccactcatgcacacgtgcctggggaataggagaatgctcacagcaaacacagggaaccaggtgaatggccaccaacagcacaaaaaagagtcggtcacatatttacaaaaagaatactgcctggcaaagacactgatagcaacacctaacactgtggctgaaactcaggacatccaggctgagtagagagagcaagcccatcaaactgtggtggattcgttcgtatgaagttctcacacactcaggatgaacggtacattcagtcaagctgtggtgggattcgttcgtatgaagttctcacacactcaggatgaacggtacattcagtcaagctgtggtgggattcgttcgtatgaagttctcacacactcaggatgaacggcacattcagtcaagctgcggtgggattcgttcacatgaagttctcacacactcaagatgaacggtacattcagtcaagctgtggtgggattcgttcacatgaagttctcacacactcaggatgaacggcacattcagtcaagctgtggtggattcattcacgtgaagttctcacacactcaggatgaacggcacattcagtcaagctgtggtggattcattcacgtgaagttctcacacactcaggatgaacggtacattcagtcaagctgtggtgggattcattcacatgaagttctcacacactcaagatgaacggtacattcagtcaagctgtggtgggattcattcacatgaagttctcacacactcaagatgaacggtacattcagtcaagctgtggtggattcattcacatgaagttctcacacactcaggatgaacggtacattcagtcaagctgtggtgggattcgttggtatgaagttctcacacactcaagatgaacggtacattcagtcaagctgtggtgggattcattcacatgaagttctcacacactcaggatgaacggcacattcagtcaagctgtggtggattcattcatatgaagttctcacacactcaagatgaacggtacattcagggagacacacgcaggtggcagggaagaaagacagtcagggcagtgtccgacacacaacccaggagggccaggacctccaggtcaggagagagagcagcaggaggcacacagggactgttttccataaaacaggcactgctgctgttgttactcaatatattattattcacatctcacatgttttaaatgtttctttttacttactgaatgtttaataaggtagcaacagcctaccttccttggctaaattagaaagttctgtttggtggtccacaacgccttcatttgcttcctcctcttcaattgtttcctcttcatcgtccactaaaatggttatcagcaagtgtcactgagaggcaacaccacttgagtgtctgttactcattacacactataaggcttcgaaattattttgcatagctattacagaaattgaaactgagcttttaaacttctcaggttaaatttaattaaatgggcaggaaactggaagtgtatttccccttccacttcaggctgtgaatgacagccctggtttttccacacatggcagaccttcttcaggccaacatacggaatgctgtcaaccctcctaccttcctgcagagccccactgtggaaagcccacaggcatgccatctgggatcaccgtgaagtcatcatcgcccatctcacgaggcccagccacatcagcctaacactctccttgactctcctgtcctccacaatcaccaacccaagcccactccgctctcttcagccctccagccctgaacctcacgcctcactcgccatagagatcttggctcctggcagagaaaagagcagctaccagcatccccacagccaaactccctctgtccacggaccctctccccacctgggggcctgcagggggcctgcaccatctctcctctcagctggctctcaacttttcttctctcacaatctaacataacatctctcccttcctaccatcaaaactcttcctcatttcttcactacaagacccccactgcccaccaagaagggcctaggcacctgaccccaaccacacaagtcgctgggcctccaggtgctgcctttcctgactgtactcgacaccctggtggctcacgacaggcctggccatcccctcctcttggaaacgccttctgccattccttctgccttctgatcacttggtttccagggtggaattttggaaaagaaaagtaaagacgacctcgggtggttaatttggccttctctgagttaccctaagacatctttaggcattaaacagaagtcaaataaaagtctgtttcaatacagttgagcaccacataatgccgtttctgccaacaatggaccgcatatgcaatgggaccctgtaagactgtaataccgtatctttacattacctttcctgtgtcaagatatgtttacatgcacaaataccactatattccaattacccacaggattcaggagagtcacctgtgtgcaggtttgtagccggaggcacaggctgcaccatctaggtttgggtgagtactttgtacgttcacataacaacaaaattgtccagcaacgcatctctcagaatatatccccgttgttaagaaacacatgactgtacacaaatgtgctcctgagaatgtgagaaaataaggaaagcggagaggtcaatctacataaagccgaccgcagctaccagagtgcaggccagagaaaaggtgttcctcatgaagaaatgacctaatcctttccaggtaacaagaaagacacaaacctactgtactctgttgtgcttctcttgttgtctgaaaggccagagttcaatccatccccagtgcaggatggtactatctagaattcagcaccaggccaggtgtggtggctcacacctgtaatcctagcactttgggaggctgaggcgggtggattacctgaggtcaggagtttgagaccagcctggccaacatggtgaaaccccatctctactaaaaatacaaaaattagctgcgtagtagtccgcacctgtagtctcagctactcaggaggctgaggcaagagaatcgcttgggaggggcctgaaaatgccaccacaatgctgtgccagtcctgggccatgtgccctcaggctcctcactcatctgccacactgttgttttgtttctgtcatacgcagcagaactgaatactgccagtttcatgccaacaatctggccaaactccctgttgacttccaaataaaaatcaacacatagcaaagatcaatcttcaaaaatttggaaaagttaacacacttcaccaaaccaagccaataaaaccacactgatgctgatcaaagagccgaaggagaaactgcaggccttacctggcacctgacaggaaccgccacacaaacgcccaagaaagtttctccaacctctctactcctgctccccactctgtctctaaaaatccagtctactcctgaggacttctgtactcaatccacatgggtttggaaataggtcatggccgtgggctgtccccagctcacacactgagtgctcaggtatctgttctcatctgaaccaggtttctccaacatctaaaattcacatgagtttctcctgaaatcccaatggctggcaaccatgggtctaccagaggacataccagggccacctctcaaggacagaaacaggcttggccctgtgccacaggagcatggggccccaacactctccaagatgcacccaagtttccaaacctcaaaaagcagatacgaccatgttgctccagaaaacatcccaagtcctctagagatacaaaaagtactctatacactgagagacatctggataaatacaaaggttgagctttccaaccagctgaagatgacaagactaaaccccaagtcgctgcagctctgtgtcatctcatcagcagccctggagatgacaaagatagtgctgagggggaacagaccttcgtcatcagtcaaagatatgctagcttttctttttcttccagacattcctgaatcctgaaagaaaagaaagaaaaaccacaagcatgagatccaaacactcagaatgggaaaccaagacagcagtgtccatgggacaggttgggggagccccggggcaagcctgctaggctgccctcagcctccatttggggtcggggcagggcagcgggggagcgaggacatgatcaatgctcactgtgttcagctgtcactgccaaattaacaccccacgtgagactaaggctataaagcaccagtttattttcaaagtagactgagtctataatgaaagggagtaataggcggggcacggtagctcacgcctgtaatcctagcactttgggaggccaaggcggacagaatgcctgagctcaggagtttgagaccagcctgggcaacacggtgaaaccccatctctactaaaatacaaaaaaaaaaaattagccaggtgtggtggcgtgcacctatagtcctagctactcgggaggctgaggcaggagaattgcttgaacctgggaggcagaggttgcagtgagctgagatcgtgccacttcactccagcctgggcgacagagcaagactctgtctctaaaacaaaaaaaaaaaaaaaaaagaaaagaaaggaagtaatagtcacagcctacaaattcctctggataagaatgaaaaggcccactctactggagctgcttctactccttctcacacagcacagtaacaaccccaaacttaccagagaactttcctgtaatgcgtcaaatcctttaggtctcaattctttccctagagagacaaggagcacagttcgttcccaaggccccccatgcttggcgagggcgtctctgctttccaggcagggtcctgctgcctccacccacgtgcagggaaaggaaggacgcgtgagttctgcctcctcatcatcatcacgcagggcagtggtttttactaacttgtggctctatgactttcagcagcagccacctctcagcctcgggttcctcatcaataatgggggaacacaatgcccaccctcctgggggtgtcctcagaggcaaaggaaacagtgaatgctgctgccactggtgccgtgcacatcctaagtggagtggcacataacgagcggaggcagctgccgaagaaacatcaaaggaaggcgtcacccagccaggcacccaaggatcctcctgcatggcaaacacctcaggaagctcctcactcactgtccagggactgaaccccagttctgtgtcccagagtttatcaacttgggggtgctgactcacactagcacatctcaaaagcactgaagcataaaactaggatggccacacaaagagaaatgtaacaatcaggcagctggctgatgagcagatgtcctctgtgggaagccacagcgccaggagactgcctgctgagaaaagaatccgaacaaaataccacccaagcgtggtgagcctttttttaaagggtcctacctctcctggaaactttctgtaaatttaaggccttcttccttttttcttctaattctactcgtagttttatttccacaacctaaatgcaaaggattaaatgaataagcacattactaaggatgggaattacagacgttctgcatacaaaacactaaagcacataagcagagtctgaaaacagtgttttccagcctcgtcagtttggtgctttttcatttatttcatactaactacatcctgcccaggttctattaggtggtgaggtaagaattaaaatttcaaaaaaggaaagcaagtgagcgagcgaccgctctagaagtaaccgtggtggtgactcacgctaaccctgaaacaatgcccagagcccctccacggcatgaagcacctcagagggcagccacagctgaggtgcatcccctgtgcaagacagacggaggcacgagcagctcattcaaaggccaacaagcaacagcccaggagagtgcacacgttgctgactctggtgctcgaaagcttcctaagcaaggtgcccgagctctggtctcgggaagtggcctcaccagctccgacagactgattcttacgaccccatgacaacggcagcactcgcctgttcaatattcgaccaaaagcactctatctcccgggccgtggaggcggctatccgcctcagtctgctctgctcttccttcttccccctttcttcacggagctgcttctcctcgtgatggcgcaccacagttctaacgagctggtgaataaaagtgcaagaattgtatgttgtactctatgtcatgctggaaaaaaaaggatatgtaactttttttaaatcttctcagactaaaattacatacaattcactgtcatatacatcctcgtatgctcttagggtggattaggagaaacatgactataagcaaaaaccaccatcaatatttagcttgacttttctagaaagtgtttttatacttttcaccaaatacacattattttcctcaaaactagaataccacattgtgctataatcttcttttcccatttaatagatgattaacatctctccattcaataaacatgggtcggcatctcatttcatgaatgctgcaccagttatagaaattattgggctgcgataattcacatttttaaagcttttgctttaaattgtcaaactgctttccaaaagtttagacacttcacatacccaccaacagaacctcaaatgggtggagagaattaagatgagaaaacctttggagccctgagagcacaatggctgtcacccccacgcccgttctagggatggaaatgcactcaactaccgccaggactctgcgcacacgccgtgttcccactcggcctccaacggggctcactgtcgtcaacacaggccctgatcggggtgggctgctctgcagcctctccctgtctaccccagcgagaggcaggaggcacggggaagggcaggcctggctgcagatgcatcactcagctgttgagagatggccctggcctgtgccctgtaggtgctgcactgctcttcagccaaccccaccagctcccactctagcccatcggccagcccccacccatccagcccagcatccacatgtccagcctggcatctacacgtctggcctcctgccctatccagcctggtgtccaccatgttcaggactatcttctttgtggaaaggctggtttaaggaagaatctgggtttttctggaatgcttatgaatctgacttgagacccttgaccctcagaaccccacggttctcaccctgtggtctcagcttctctctgcctaccctacatgaagacagcaagggggaaaattctgggtacggagtggacagggcaagggatggaacacaaggccatagccttaagagtacagaaaatatgaacaaagaccctagggcccaagaaacagaggcagcgacacagtaatgaggaggataaagaagggccacggctgttcacacagtgaaagcacagctgcttcccactgaggcctggggtttctagaaatctaccacttgttctcacttttctagtgttagcagtagggcctccagagtcttccaaggactctgcgcctgctttggcaacagttaggagaaaaataaattctcagccaaaattaaagagaaagctagactagaagcccaggaggaagggcaggaggccgtgtggccaggcaggaaagcctaggacagccccttgctgtcccttgactgataccaggtgccttctaactcttagcctctcagctccctgaacagccccagccaccagcctgaacctgtggcactgcaggtatcctaactccaactgccaggcaaagccaggcaacaaaatgaagctaaatccacatcattgcttagtgggtgagcactgagcacaggcttgatcccaacaacgcatgctgggctctgaagacaccacctcagagacttaattacacagcacagttattctccaaacaacagggaagtatccttcccagacttcacaggttaaggcctctagagtgagtctgccaggcacagtggttcacgcctgcaatcccagcactccaggaggccgaggcaagcaatcacttgagcccaggattcaagaccagtctgggtaatgtggcaaaaaacacaaaattagctggacattccagcctggacaacagagcaagaccctgtctgggggaaaaaaaaaaaaaaaaaaaaaaaaagtgggtctggagacctgcccaccacttacaccactgcaaactcaagcccccaccaacgcacacagcacagcagctccacgcattccaacccaccttcttcgcagcagccaccttccacctcctctcctgggcaaagtctgtggccatccactgcatctcctccagcagatagtcccagtgggacttggggcgtggggcctcctgcagctttggcagacgcctctgggaccacagacctgctttcctcagctccgcaatgcgctgatgcacctggttctcctgtagatgatacatgggggatggtggggtcggcatgtgatgagtgtgttccaccaactcagaccccagaaatttgaagccctactatgcaaaaggctcagtcaggcactaagaaagagagaaagcacaaggtcccagtttaatatcaaaggtaagattcgaacacaaaggtcaaagtggttctaggagaggtctaggagcatgtgacccttccaggagccttagaagaagctggagcaatagtcctgccccagctctataaaacagactaaaactttaaaacctcatgtttctaccaaagtgtttacatgggaaaccataggatgtctggaatttgcttctagataatctggaaaggagtgggataaatgaaatgagactagctgcatactgatcactgtgataaaatcaaataatggggaacatggggtttatgacactctattttgatacacatttcttttaattcccctaatgaagttgaacaaaataaatgcttagtcatccaacccaaagtaagtgctaagggctgggcagtgactctcaaacacagggctgcagactggtggctgcagggacctcacagcctgcagggccccagcgctcaagcttgtccctctccgcctaactgctacacgtgacctctcccaccctcgtctactgcccatatgaaagcagcccaagactgcaggctttatcacaaaaacgcagactgcccccatgagtctgcttccaacagaaaaggctaaccccttggttttcatcttgtgtctactgattcccaagccatgctgaattgaccaggcattcggttttacgccatcacattcttgacaattaaaactaaatgtgcttcaccaactggagtacattttacaactttcttaagcatgcttaccagagttatttgttctgtcagcgtatcctgagaactgtcttgggacgaggtggcattctgagcaggactctgtggtttggtgggggcagatgccaccacccctggggtccgggaagtgactggagatagtgccttattggtggctgaggaaggtctatttactggagaggatcgagcaggggagggtcctgggccggagccactcacaggcgcgagggacgaggtagaagaggtgggcagaggccgtgggcagggcggggcagggtccacagggagccttgtcgatgctaccatctgtaagggcagggcacaagtggagcaaggtgaagaaaagatgtcggggcagcccacggtgccaaatacctgagcgcccacagcaccagaaacgcgcactgccagcaccttccgctccatgatgcaagcagacaaatcacatcgtatccacagcccaacactaacgtgtccacaaataatacatcctcccacttccacaaaaccaaataggagttttcattatgaactatctttaggccatgcccagtggctcatgcctgtaatcccaacactttgggaggctgaagtgggaggactgcttgagcccaggagtttgagatgagcctgtgctttgacaaagaaagaccccatctctacaaaaaaatttaaaaattagccaggtgtggtggtgtgcacctttggtcgcagctacatgggaggctgaggtgggaggactgcttgagcctgggaggttgagactgcagtgagtcatgtttgtgccactgtactccagcctgggcaacgaagcaagaccctatctcaacaaaatataaaataaaataaaatacaaattcagtgtgcctctctcatggcagacaggctaaaagggttaaaaaatcctcctcaggccaggcgcagtggctcacgcctataatcccagcactttcagaggccgaggtgggcggatcacctgaggtcaggagttcaagaccagcctgaccaacatggagaaacctcgtctctactaaaaatacaaaattagccgggcatggtggcacatgcctattaatcccagctactcgggaggctgaagcaggagaattgcttaaacccaagaggcggaggttgtggtgagctgagattgcgccattctactccagcatggggaacaagagcaaaactccgtctcaaaaaaagaaaagtcctcctcttcgcaccacctcaacgacagacttaaagtcacagagaactgctgcgactctgtgacttaaattcacagagagcagggaaggtgggctgagtgaaggctcacacaagatttagcccgttcaaaagctgaagggagacagaaccgctagagcacactctctctgagcgcccgtcccacgacgtgggtctgctttcttcacctcggcagcgccgtctcccggctggccacaggcgtttggaaatgaagctttattacagcacagccacatccacttacgtgctgtccgtgagcggctgtgtcttcacttctgccacagaaactgaacagctcgcaaagctggaacatttactccctggcccttgactgagaaagtgtgccaaccctggctaacctagaagtaacaggttcctacagactttgtaaagcgcttctttaaaatcattttccaggctgggtgtggcggctcacgcctgtaatcccagcattttgggagcccaaggtgggtggattagttgaggttaggagtttcagaccagcctggccaacatggcaaaagcccatctctactaaaaagtaaaaaaaaaaaaacagttgcctaagcatgcataagatattatgtgcattgtaaaatgatcagtaaatgatttcctctactgttgttcttaaggagagaatataaagttatttagagagctaaattgtgaaataaatcatttctctgctggaaaaaaaaaaaacctagtagggcgtggtggcgcatgcctgtagtcccagctactcgggaggctgaggcaggagaatggtttgaacccaggaggcagaggttgcagtgagcggagatcgtgccactgcgctccaccctgagggacagagtgagactctgactcaaaaaaaaaaaagataaaataaaataaaaccattttccacagctgagtttttcagtaacacaggcaggtaaattaaatctaagaaaaaccacggagctgctttaagtcagtatgtggctcgatgtgaggaagtgttcaaaatagaatcatttccacaaaaacctaaagcaagcaatgtaaggcctagaagagctcagctgccctggcatgtgtcgcctttctcaaagtgggtgtacaaggcttccctgcagacttgcacaaaaggctcccaactacagcccccccagttgctggcttttctggcctctggtttttttaatctataaaatggagatagtaaagattctacctcataaggttgtcaggtaaaggaaataaacaatgccaataaatcgctcatcacagtgcttgacaccacacctcacaagtggtgaataagagatagctattattgttactattatttcatcgttatatacttaagactttgccataaatctcaaacataaagaacctgtaggccgggtgcggtgactcacgcctgtaatcccagcactttggaaggccaaagccagcggatcacctgaggtcaggagttcaagaccagcctaacccatggagaaacctcgtctttactaaaaacacaaaattagccggcatggtggcaacatgcctataatcccagctactcgggagctgaggcaggagaatcgcttgaacccaggaggcagaggttgtggtgagccgagatcgggccactgcactccagcctgggtaacaagagcgaaactccgtctaaaaaaaaaaaaagaaaaagcacttgtagcttgggcagcatggcgaaatcccatctctacaacaatacaaaaatcagccaggtgtagtggtgtgcgcctgtagtcccagctactcagggggcagggacaggaggatcatctaagcccaggaagtagaggctgcagtgagcagagatcgtgtcactgcattccagcctgggtgacagagccagaccctgtttcaaaacaaacaaacaaaaaccctgaacttaaagcccacctaggaaattcctttgttagtgagggagaaggcaaaaggaagggaagactctctgcagtgggctccccacgccctgatgtgcatcaaacagtggagaaccaagggggctgagagtcttccctggcctccctgtcagtgccctgttgacggctggcaccgaggctgtggcatttcgctattccttaggaaccgaaaccagtttactgtggacatcccaaaaacacactgggtaaaattaatcagtggaggaggaggggcattttaactacctgaaatgtgtatcaagctgcatcagtaacgccttacacatgtgtatcaagctggatcagtaacaccttacacacatttgcagagcatatagcatcccaaaagcagcaaagcaggcgtccagggagcacgtctggtgggtggtgtccaacatggttttgcactcacatggagctagggtcaagccccgctcatcacttcatcgccatgtaacctggggccagccccagaacctctgagtatgtgtctccacactggtagaatgggtcgctgccacctacctgagggttgctaggcagatcataagggataactgacaccatgcccttcacacaacatatgggtgagtaaggagggacccctggtactaagagtgacaataataacagttgtctattattattattattattttttttttttttgagacagagtctcactctgtcacccaggctggagtgcaatggtgtgatctcagctcagtgcaaccttcacctcccaggttcaagtgattctcctgcctaagcctttgaagtagcttggactacaggcacttgccaccacgcctggctaatttttgtatttttagtagagacagggtttcgccatgttggccaggttggtctcgaactcctgagctcaggtaatccacccgcctcagcctcccaaaggctgggattacaggcgtgagtcaccaaacccagcccagttctctattactttaataaagataatatcatagagccaaataaaactgtattgcaagtactgaattgagtaattgttctaaattgggggagcaagctgctaagagaaaatacacaaattacagtgtggtgtgacactctgtctaacacacaggtagccagcaaatcctgcaaaccattttctttttttcctctatcttttctcatacctgtggcagggaggaaagctgagaggcctgcacctgcacctttccaggtgtgggaacgtggagggccagctgtgcaggctgcgagggagggatggggagttggctgctgggcggtgcagggatgggaacattgggctgctgagtcttcaccgggatttggagctgtgtctgggcctctaccacttgcggctgctgtgcaaactgcagcgcagaggagagggctgcagtgggaacaccggctgggggcagcctcccgggcagctgcggcagtggggtgtgcaagctggcagcgttctgcacgggaggccccgtggaggggtcatactgctgctgactctgcctctgtccagcgagctgcgcggcctgcggcgtggggggcattcctcctgcaaaataagaaaagtgccaaaagcactgattcccaagtgtggcagcttctaccaatgagtcacaaggagacacgtctaacaccccagtgcttgtccaagacccaccacactcacacgagaagttggccacaaccgagcacacacaaaaggaaagagaggcgcttgacctttgcaagtcagcatcaagcaaaacaagcaccagatcaccacagggcacccctacaacagcagcaattaggaaaaacataggagtaaaaattgttgaaagacactatgacaatgcgacgtgtggctcccattagtgtggcaagaatatgtctccaggggctttgcatatgatatcgactgggactcagagaagtatctcaatttcaggcaccccactgcaaacacgctacctccactgcccaagtctgagtctggtgctggtttctggaaccgcagtgtgctgcctgctcctgagcggggagctggctctgctgctgggccttaccttgtgcggtcggcattagttgctggagaggaacgcctgcgtccgcccctgggtgctggaaaactaccccttggtgacccacttcaaggcgaggcctcttagactgctctagaataattttcaaaaaaggtgcagtttgatgtaaaaataaaaccagagaagtagtagaaaaaaacatgtgtgtttttatcatcttggaaaagggaggcctttctatacatgaactaaaatccaaaagccataaaacataaggctgataaatacaatttctcattaaaatgttgccgatataagaaaaagcatcatgaaaaggccaaggacaagcaacaacctgagaggcaacactgcaacgtgtgtgacgggcagaggtgggcttgcttagcactcagaaagcacaggcacacatgaggagcatcacaagtacacggacgagagcatggagagcgggcagtggagcagactcacaaatgcccagcacacagggaatgaggctgcacagcgtgctcaaaactaaagaaacccatatcagaacaaggaatgtttcacccatcagatcaatgaggattaaatgacttatacctaataaaacgatcaaaatgtgaaagaaccagaaattgttgatggcagtgaaaactggccctgtccttttggtgggcaattgagcaccattattacttaactacatctgcgctttgatctagcaatttcatttctaggcgtttttcctttagatatattgacagacagttgggcgcggtggctcacgcttataatcccagcactttgggaggctgaggcaagaagacttgagcccaggagtttgagaccagcctgggcaacatagtgggaccacaactgtacctaaaatgcaacaatttttgcatttagctgggagtggtggcacgcgcctgtagtcccagctactcaggaggctgaggcatgagatttgctcaagcctgggaggtagaggctgcagtgagccatgatgatgccagtgcactccagcccgggtgaaccagaccctacctcaaaaaataagcagatggatagactgataaacatgtaggaaaaaaaaaccatgagactacatgttcaatccttagctcactgtaacagacacaaggtggcactaacagatgaacactgacaaggatctgactgataaagaaccaaccatccccaagacggaacagcatggagcactgagagaggttatgacctggagagatggcctcttcagttaatattcttagacataacaacttatatatgatcgcatctcaactttttcaaagtatcacatatgtaacaatgcttgtgtatgaagagaggaaggtctgtgagagagaatatgggaaacattaacagtggttactgctgtggctggggagtgggcaggtaccaagccagacatagacttaagttataccctactgaactgttgaagtcttttatataaaaatgtattaagtttatcatttgaaaaaatcagcttaaaaatatgacaactttggaaagcagatgattttgtgtttaatcacaccgtgatgactcaagagcctacaaatgcatacagaaaaccaacacggaatacacctgctcaactgaaaaattcctcacttcaggacacagaaaaattcacgtaaatattgttcagctgataatcactgtaagacaggttaattttcaaagtaggaagaaaccaagtttagcaactgctcttcagaaactcatggcaactgtacctcggcagcccaaggagaggggggcattcccgaggccacgctagccgtgccgacgtacctgccatacctgtggagggcatcgcctgctgcctcttaaacaggtccgtctctactgtgcttccggcccctgctaccaggctccctgcgagggcttgctgctgggaaaaaagatgaaaaaatgagattttgatcactgaaggccattacaagaataaactcaaattatcataattatcccaaacatcgacctccttcctttctaataacaggaatgttatctaccccgtgtctttaaatatacatgtgtaatgtatatttatgtataataaacaatttaaagttctaacttacctctggnggaaaaaagacttgtaaaagacatattattctggttntaatggaatttcaaatcaatgcaaacctacagtccttgggaaacaacaaaagggctaatgctgggaaacatgaatttcagttctgagacaaatctcaaccgactcatcaatcacactgccccacataactttacatccaaaaccaccgaataataaaaaggtgaaattgcctttcttatggaaatggaacctaaacccccattaaataaccatctaattaattaaaaatctttttttttttttttgaaacggagtcttccttttggacccct

SEQ ID NO: 978 - DNA, 19071 bp, Homo sapiens
cgccgtaccgtacctgtccttccgccccgggtgaagacccccgatgcccagctcagggagttggatgcccacagccctgagggcctgtctgaagctgtcatctgtcccaggggagttgggaagacccgaatgcctgtggtgaggtggatgcccccaccctaccctgcagccccacccccagtggccttgagtcacctgctggagaggaccttttaggagagaggctgagcatgggccaggccttggtttctgcaagggaccatttgaagtgcagggaagaggctggaggtgcttcggtcccacagccccctgcccactccctcctgggagctggtgccccctgaggttttggggacagaggagggctgccagcacagtggggagggcagaggggtctctaggaaggtgacctagggggtgacatctgtgactctggggcaaggccaggggtctagacgtgtcagtagcgaggtgggttccagcacccatgaggccagtgtggctggagggatggcagggccaggtgccctgggtaggggtgttggggaccctggctagagtgtgggcagcagatggggtgggggaagagcctccttgccagggtcctgtgggccagtcactggtgccacaggggtctccctggtgggcctctgcctttcttctttttgagacaggtgtcattccgtcacccatcctggagtgcagtggcacgatctcccggctcactgtagctgtggcctcctgggcctaagccaccctcccacctcagtcctgagtagctgggactacaggcgtgcactgtcacacctggataatttttgtatttttttgtagagatggggttttgccatgttgcccaggctggtctcaaactcctgggctcaggcgatcctcttggcttggcctcccaacatgctgggatgacgggcatgagccaccgtacccggccaggcctttgcctttctaggggtgagaggtggctgccttagtgtttgggggtgggaggaggctacagggcttcagttagcaccccctgcccagagggagctcctgtcccacacagcccggtcctgggtgagtggctgggggatggggtgctgggctcctgctctgcacacatgggtgttcccccaggatacctctgactttgacacatccctgcttgtcctggctttgctggtgggtttggagctctgatgagcaggtcaggtcttagggaacccctggctctgggatccagggcaggtggcccccagagaggagaggagaaatgtgggcacctatgggcactcactggaggggctgtggggagggtaatggtgggcccaggtcagggagtgggcatggccgtcctgaagttatttctgagtctagcttcatctccccctccttcctgggttctgcccggagctgtccctgcagtcccccttgccccatcctgtgctctgtggattgtttctccccacagctgctgggagccctgggctccccacgtgctcttcctgggcaggcaggtgaggccaggcggggcttggggtgcacaggctgtgggtggggtgggctgaggcctgcctcatggataggtcccaccttctctaggctgtgcctgggtttctgggtctccctctgggccggccctgcagtgtctgtggatcctggggttgctgcctgagcaccatcggccttagcctccctaaaggcaccctctcctgagcctgtccccactcagcatcctcgtccagcccatagctcctctgcgggggcagctctgggacacgggcttctcacgtttatgaagcaggcatcacccagtggctttgcggctgtcccccccaccaggggtgccttctgattggttggggcctcctgggactgggggctgagcaggggtcctgtgtgggacgcggctcctgaggcgctgaggggtgttcctcctgcagaccccctccagacacggctcccctttgctttgagagagcctgggctcgctcaggggtagaagtgggatggccctacaacaggtgtggactcgcttccctgtaagcacctagagcatgtggatgtgtacagggcagagggagggggctttgtgtggaaagggcttcctcctcctgttctgaggcctagagtcaggtgtgtggggcccttgctcctccagcccagcctgcctggtttgatgtggcttcctgggcctcactctccttgtctgtgaaacgggggtgatgaggactcgtccctgtggctgcggggagtgagtggtgggctacagggaggctcccagtcccaggtgagggtgtacgcatgctggccgttggggtgtgtgctgtgtctgcaccggtggcttactctgagtttcatgggggcaggaaagggcggggtactggtggcacccccggtcaggtctgtgtctgagctgagggctgagcagctgctggtcaggtcttgttggcccagcagcggagggggtggctgagacgcctctgaccgaaggcattggggcgagggatggcagcctgagctgcagccaggttgggtagggcagctggaggccgcaggcctctgcgtcaacctggcagcgccaacctgcaatctgttggcgtcttctttttttttgagatggagtctcactctctcgcccaggctggagtgcagtggcacagtctcggctcactgcagccttctcctcccgggttcaagtgattttcctgccttagcctcctaagtagctgggattacaggcacgcaccaccacgcctggctaattttagtattttaatagagacggtttcaccatgttggtcaggctggtctcgaactgctgacctcatgatccacccgccttggcctcccaaagtgttgggattacaggtgtgagccactgcacctgtttaagttttgtatttttagtagagacggggtttcaccatgttggccaggcaggtctcaaactgctgaccttgtgatccacccaccttggcctcccacagtgctgggattacaggtgtgagccactgcgaccagccctgtgggcgtgtttgatcctgggctgaggagctgagaagcttctatggcctgagggtcacacacacctgcccacacacctggccttcacccttcctgctagggggtatgtcctctgccaggagctgttgctcttatggggggaccaggggcctttgccttgatcagatggagacctggctggccacaaaacagaacacacccacctacaaagcacgtggcccagagatgtcctcgtctcccggccgctggctgaccagctaagtcctggcactgcagggcctgcccaggccgaattggggctgagccagactccctgcagtggggcccggtggcactgggacctctcacagcctcttttctgtcttgcaggaaatggctaattctgtctacctggttatggaggtgagtgccttgtggtgccaggacaagtgcaggctgatggccatggccctgggagccccacagggagggacatggctggggggagggtgatgagcaccttttctttttttttgagatggagtctcactgtcgcccaggctggagtgcagtgctgcgatctcagcttactgcaacctccacctccgggttcaagcaatcctcctgcctcagcctcccgagtagctgggagtaattacaggtgtgtgccaccacgcccggctaatttttatacttttagtagagatggggtttcgccacgttggccaggctggtcttgaacctcctgacttcaagcgatctgcccaccttggcctcccaaagtgctcggattacaggcgtgagctgccacgcctgctgagtatcactattgatgtcttccagcagggactgtggggacacctgccctgggctgggcaggtgcctgcgggctcagggagtagtgtccaagtgtgaggggtggggaggctgggcagggctgggaggtgggccctgggccctgctgcagcctgatgcgtgtctggtctcttgcagtactgcaacggtggggacctggccgactacctgcacggtgagtgcacagctgcgccacctgggctgccagccggtcccacagggcccgcacccagggccacactggcccagtctgggaggcagcctggctcgagtgggtccttggctcattgtgagattggctctttcttgtccccctgggcctcttgaggggatgcagggagctgagctgctcccggctgttaaggatgcagtccctccgctggcctcccccttgcttgaggagacagctgtgaccagaatagcccgaggggagccgcacaaaccaggggtgggggctgttgtcttcatagtgtggctggaaggcggctcttggcccacccaaagttgagccctgtggcggatgggaggggatgtgctgcacggggcggggcggggcagagggaaggacagcaggggggcggccgcgcccgtctgttcccaggctctctgggtgggggtccgggccacagtgccggcgggcgcgggggtgggtggggcgccggcggcctcttgggggtgtcctgagggtctggaggtggctctgggacagttccggggacttgggcctgagcacccgggagccggcaggactgctcaaacgccggctcagacccgcgtcgccctcatagcgctggggcgggagtgcggggctggtagatggacaggacccgctggccccctcgcctcgccccacgcgaggaggaccccacggaccaagcctgggagacagacgctgaggccgcgcgtagctgagactggggctgcgggtcgggtcgggctgtgcgcggctggcacctgtctggatgccgggaagaggggcaggagcgggacccgggcggaaccgcggtggcactgaggctgggcttcggcggcctcccgtctctggagcagctgcagcccggggctgagtggtggggccggcgcgccgggctctgcgcaggagcttcaggtgcgccctggtctcggcggcccgtggtggcttgtgcccctcctgacccggggtttcctcccggcctgcggccctgcctggcgctctccatccgtgtggcgggaccggcctggctgcgcgggactcacccctgggggaggaaacacggcccccaggccctgagccgcctctccccgcagccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcggtcagcccgcgggcaggcaggcgggcccggcggggaggggctccggggccggcgccggtcctgacgcttctctcccgcagctgacttcggcttcgcgcggtacctccagagcaacatgatggcggccacactctgcggctcccccatgtacatggtgtgtttaccttggccgggctgtgccgggtgggcgcctctctgggcttgctggttggttggctggcgtgtggtgcgctctgctctggttggctgtggcctggcgggcaccttctgtggttggcgtgcgggggcctcacactgacccgacttctggtcccgcaggcccccgaggtcatcatgtcccagcactacgacgggaaggcggacctgtggagcatcggcaccatcgtctaccagtgcctgacggggaaggcgcccttccaggtaactgggcttggccctgctccccacgccgcaccgtcagtgcaagtgtccgccagctgcggtcagacgccccctgcgagccctgcccgcgccccacgagctcccctcgggtcctggctggcggggcgggcgtccaggggtccagtggggaaggggcctcggtgtcccccagggagggcggcgccgccggcggtgactgggagctgcccccggcaaggcctccctcgcctgtctggtcgcctgtctagtcgcctgtctggtcgcctgcctggtcagaggtgagggcagcgccggggccgagtgggtgagggctgggaggccgcgttctggggggtggacaccccgagagaccgtcggcgccccctccccgcccccatgctcatacctccagcagcaaacagccgcgctagcacccggtttcccccgggcttcgcagcgtctggggcaggggccgactggggacgaacgcaccgagaccccgtgggctggtcccgctcggccgcagccctggcagtcaggctgtccccgtccccgcaggccagcagcccccaggacctgcgcctgttctacgagaagaacaagacgttggtccccacgtaagcaccctcccgccttcccttcccttcccccgcgggctccggccccgcaggccctgctcacaccagcctcctcttgccccagcatcccccgggagacctcggccccgctgcggcagctgctcctggccctactgcaacgcaaccacaaggaccgcatggacttcggtgagcacccaccaggggcgcagctggagtcccccaccctccttccttgcatttgctgatgtgagcagggcccaccggcttcacacccagccccatgtgcacactgccctttccacaagccaagcgcaggcaggggctccacctccgcccgggcaggtgcccaacgcggctggagctcaggccgtggggaggcaggggcctggggtcagagctggggtcctcctgaggcctcactcctccttcctcctgcagatgagttttttcatcaccctttcctcgatgccagcccctcggtcaggaaatgtgagtttctgtgggtcctggggctccgcatgggccctgcatgcaccccttcctccccgggtttggttagggcactgagtgtggggcagagggagcaggtcttgagctgcggccagctcccagggagggcaggacacccggctccttgctctgctgcagcggggaccccaaggccaggggttcgcatggtgcagcaggcttgggatggggatggggtgttggaggggctggtgctgccctgtgacagtcatagggtggcccaggagggagcctccctccttcctgctggtcggggtgtagccggaagtggaggggatatggttgagcttgtccagtctgtgggttggctcgagggtgaggaggagacaggaggatggcccagactgacctatgcatgtttatctcagccccacccgtgcctgtgccctcgtacccaagctcggggtccggcagcagctccagcagcagctccacctcccacctggcctccccgccggtgagttgccgccccaggggcttggcagcttctccctccactcagcagtcaggggctccagccctgggcccccgcggggacgtgctgtgacttctgttgtctgtgtgagtcacgaaagacatggatgagttcattctgtcagatgttgaagccccacaaacgggtgacagcccctcccaacacccacagccctcaggtcccagaggccgatagggcggctgtttggtctggtcctgtctttggttttgtgctgacgtggacagaagcagcgtgtggccttggcccactgacacctgcacccctggcctccctcgtgtcttccattggactcaaagcatgagtagggttgcagggtgatggccccacatgatgatggcactccttgtgtgacatgggaggggtctgcagagcacctgagtcggccatgaacccccgtccctctgtccatctgactgggagcctggctctcaggcatggtgttgtggctggtggtgatgagttcatgtctgggctctcctggcctggccccctgctctgtgaccagggaccggtcctctgaccttggttgtctgcctgtatcatggccgaaagctcagatgtggcgaggggagcgtggcagcgccctgctgtagggagctgtggcatccgcagacctgccctggggcacttggggctttagccaccaccgcacggatggtgtgccctgggccttagcatggtgctggcctcagagcagggcccaccggggtggcagcctctccactggacacgccttccatggtacctcgttctcttggctatgccgatggaaaagtgaggtgcagagggcaggtggtgaacaactccccaaaacagggcctcccagagcttctgggagctgagggcttcaacccacccaggctgcatggtgagagtggctcgtcggggggcctgtccctgcgaggtcaaagctggcctttgagtggagtgctctggaagtacagagaagagcggagcacaggaagaaagacgtgcccagcccttctcagccccagcgccccgatctttactggggctctgggccatcccaggagggggaatttgctcccctgagtgtgtaggtccctgagacctgctcaccagcccctccgttgactctcagtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtcagggggcacgctgggcttggaggtgacgcctcaggtgcggcggggacagtgcattgcatgtgttggatgcacagtgtgtaacacatttccacttatgggcagttaggatgggcccctgggagccaccggcatcggcccagcttggttggggaggccgtgtctgttaaaaccactcctggaatcaaagccgggtcctcctagtggtcagtaggaggtcggaggccataggcctggtctccttagacagtgctgctcttcggatgggtgggggccgctcacctcatgcccctcccccgccatgtacccctaccttgtttctcagcaactcttgttgcctctacaccctgcaggtgggtttattccttggcttttggggaaccccccgctccataatggccaggggctgcccacgtgtttgttgaatgaaggtgcctaaacttttggagcaggcctggggtctgtggctcctctgaaggccctgcactctgtccctggctgtcccaaagctcctggaggtctgggttggcactggtccccgtgtctgccagggacacaatgactcatgccgagccctccgcctctcccatcagcatggcttctgcgggggtggtgaggcccgagccaagccccagacagacccggggagggccttggtcctttgccagctgtcagggcaacaggaagacggacaccaggggtagggcagagcctccttgggggtgggaacctgggtattcctggagggggttgggcccagacttagggctgtagatgcctgacctcccccgcccatcctggagttagctaaaggctggggggcagggccccaggggtctctggggctgaggagacaggaggcgcagagtccaagtggggataagcgggggcaggtagcgctctggtctcccggagctggcctggggctggcagggaggatgcagcctggactgtaccacccaggctctgccccccgcaaggccgctgtacgagctgaggcccctgcaaggtggagtgtgcgtggggatccagcagagagcctcggtggggtggggtggccctgggcaggcggcaaggactccaggcccagccttgtctccccctgcaggtgacctggtggctgaggcgcccagtgccaaacccccgccagacagcctgatgtgcagtgggtgagcccccatcccttacctctgtattttaggggagagaaactgtggccttggaagtggcccgtgttatttacaatgagccgagatcgcgccactgcactccagcctgggtgacagagcgagactctgtctcaaaaaaaaaaaaagtaaatgccgttggcccgtggtggctcacgcctgtaatcccagcactttgggaggccgaggcggatggatcacaaggtcaggagattgagaccatcctggccaacatggtgaaaccccgtctctactgacaaaaaaaagaaatgcaaaaaattagccaggcgtggtggcacatgcctgtaatcccagctactcgggaggctgaggcaggagaatcgcttgaacccaggaagcagaggttgcagtgagccgagattgcgccactgcactccagcctgggtgacagagtgagactgccccaaaaaaaacaaaaaaatgcccttggcctcccttctgccccacaggagctcactggtggcctctgcgggcttggagagccacggccggaccccatctccatccccaccctgcagcagctcccccagtccctcagggtaagcagggccccaggctgggtggatggggctgtgaacagtcccccggctggaggttgggcttcctgtgtgtcgcagccagcccaggcctgctgtgtccagaggcccctgccttcttctcccaggcctcgcaggatggggtctgctgggtcgtcctgcagaagggactatagtgggaggagcattgacaggagtaggtgaatgaggaaaccaaccagggacgccagggccagcacagtcgagcctgtagggccaggaatggccagggccccggccagggtggccccccactggctgggtgcagactgggagtccaggtggggtgcaggtgccacatttctggtgtgtgtagaggcatggaagccggctcttttcagacctggcatgggtctcagggtggcctctgccctaactaggaagtctgggcctaggctttcttctggtgccccagctccatgacctcagcctcttgtgaccccagtgtctgtcatgatcctgacctctctccaccacagccgggctggcccgttctccagcagcaggtgcggcgcctctgtccccatcccagtccccacgcaggtgcagaactaccagcgcattgagcgaaacctgcagtcacccacccagttccaaacacctcggtgagtgtggagcccccaggtagccaggcgtggctggggccttgtgtggcaggagcccttccacggctcccatagagggacagggtcgtcatccatgtgcagttgtgcaggctgcgcactgcgtaactcagcaccaccatttactttgttgatgtcttgggtttctagagttattttgacagttttctgatcagtaaaatctctctagtttataaaatcaatattgactttggccagttttaacagacagaagtaaatggtgggaggaaagggtacctttcttttaactcacagaaggctgtgtgggccagtgggtgtctggcaggggatggagactttagggtgagggtgccttgggttggcaccccgggcaggaaagctaaggggccaactcctcccacacacccactgtgtggccggttacctggacagagtgcattagaggatgagccatctgtcagcactgtagccacttggcgtggcatggggtcctgggctgctggggcctcccctcctaatacctgccttgtccccaggtcctctgccgtccacaggtcaggcagggctgctgaggcctcccctcctaatatctgccttgtcttcaggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaaggtgcgcctgcaggctggggcctgggaaggggcgtctgtaggcagtgggtgaggaggctgtctctgtcccagctggaccctgacagatctctcttttccccaagttggaaccatccctgagcggccaggctggagcgggacgccctccccacagggagctgagatgcggggtggcaggtcccctcgtccaggtgggtgcagtccggaggggggagggggtgctaggctgacctccctcgctcacgttgtcatcctggtctaaagcccttgctctttccaagtgaaaaggagtgggaaggaagctggtggaacagaagccaactgcctctccacctcctggctgtgtgggctggggcaagtttcttatcccctctgtgccagtcttctgtgctggctgagggtcaggtttaagagtggcgcctcagctactcgggaggctgaggcaggagaaccgcttgaacctgggaggcagaggttgcagtgagccgagatcataccaccgcactccagcctgaatgacagggcgagaccccgtctcaacaaaagaaaaagagtggggccttggagtgcgtctaccccaaggggctccgtgtggtagcagtggggcctagggctgggccgccggaccggaaggtcgtgacgaggcgtgtctctctctaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggtaatgggcactgccatgtgtgcaggggcacagagccctggggaagatgtgtgggaatggccagtcctgaacaaagaccgaggaaggcagctctgtaccttttgacccccgcctgggctcatgctcaggctgctcccacatgcctgccagttcctgcggactcggccccttccccaggcaccgggccccagggctgcagacctgcggggcagtcttcaccccatctctgtcctcctaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtgagttgaggggacaggccttggacgggcttctgaggggcagcctctttcccctgcattgttctgctgggtacttctggggggtagaacaggaaaagcccagccttgcccttctgtgggtgcccagctgtggctgggtgccagagagcctggcccacctgtggctggccctagacccacagcaggtccccgtcctgagcctcgccatgcccgcctgtaagctggggtgacaggagcgcctgcctctcgaggtgggccaggagaccgtgcatcatgtgtgtctggcctgcagagggacctctcgaggtccagttagggtggggtgggccgggcacccagcacagccctgcacactcccacaggtctttcagcaccagcccgcttaattgacctgctccttaaggcggcgtttgggacaccatgcccccggacccgggcagcacggagagcctgcaagaaaagcccctggagatcggtgtgtgggtgggtggggcctcaaaaggctttgggatgggggtccgggggcttcgggggatgggggtcggaggctgtgggatgggggtcggaggctgtgggatggggctcgaggctgtgggatggggatcgggtggggcttggagcctgtgggatggggctcgaggctgtgggacgggggtcgggttcggctcggaggctgtgggacgggggtcgggttcggctcggaggctgtgggacgggggttggggggagctcggaggccgtgggatgggggtcgggttcggctcggaggctgtgggatgggggtcggcgggagtcaggatgctcctgagcccttccttgctctcccagcaccctcagctggctttggagggagcctgcacccaggagcccgtgctgggggcaccagcagcccttccccggtggtcttcaccgtgggctctcccccgagcgggagcacgcccccccagggcccccgcaccaggatgttctcaggtgagggctggctaggctgaagccctgtcccttttggggtggtggcagcgccctagcggacgggggcatcctttaactcgggtcactggactacagccccccagagcccaggggtgcctgaggaagcagctcaggcccctgagaaacccctgctctgtctccccgtctgcgaaatggacgtggttctggtatccacccctcagaccacccctgccactcaacctgtgagcggtaggcgctcgttcccatttatccccaaaacatgaggtgagcagggacggtgtctggatcatggcctccttgcccagctgccgtgggctgtgctgtgttggtcaggagttgccctgatgagcacaggccgtgcagacaggcgtgcccctcggttccccagccagtggtgtgtggggatgctctgggcctggggcctggctgggtccccactgcgggttctgcctggggaggggtgggcttgtgggcgtctggtcctggccaggggctgccatcgctggggtcacctgccagccccatagcgaggatgggggactgccttgccctttgaggtccttttgggccttgggcccagctgtggggcacagtagcacaccaagccacgcacctaccccattccagacagtggcagctgccctcctcccaggcagatctgggctgggggtcgggatacccagagggtcccttggtgggcaccgcagcccttggcctgaggtggggagctggggacttgggggttgtggtgagtggcaagaggttgaggagtggctctaggggcctgctgtgcttctcctgttggagcattgggatataacaggtgtaaaccgaggcagaggcacattgggccctggaggtgtgggagtctgtgggggatggatgggggccacggtgtctgctggtcctggtgtgcccctcatcgccctctccctgcagcgggccccactggctctgccagctcttctgcccgccacctggtgcctgggccctgcagcgaggccccagcccctgagctccctgctccaggacacggctgcagctttgccgaccccattactgcgaacctggagggggctgtgaccttcgaggcccccgacctccctgaggagaccctcatggaggtgagggctggagtgagcaaaggttcccattctggctggagggtgtgtggggtgtgtggggtgtcgggtgtgtggggtatagggtgtgtggggtgtcgggtgtggggtgtcgggggtgtggggtgtagtgtgtggggtgtagagtgtgtggggtgtggggtgtcgggtgtgtggggtgtcgggtgtgtggggtgtcgggtgtgtggggtgtagggtgtggggtgtagggtgtgtggggtgcagggtgtgtggggtgcagggtgtgtggggtgcagggtgtggggtgcagggtgtgtggggtgtcgggtgtgtggggtgcagggtgtgtggggtgtcggctgtgtggggtgtacggtgtgtggggtgcagggtgtgtggggtgtcgggcgtggcacatcccagctgcccgggctgcagcaggggagggtaccctgccctgcctccccaaggcgtcatcggtgagtctgaagggagacaagccccttccaagcccgggcagcacttgccgccctgacggccgcttcctgcagcaagagcacacggagatcatgcgtggcctgcgcttcacgctgctgttcgcgcagcacgtcctgcacatcgcagccatgaagggcagcgccagtgaggcggcggggggccctgagtaccagctgcaggagagtgtggtggccgaccagatcagcctgctgagccgagaatgggggtgggtgccgccagggctggggtggggcgggtggtggcctgggggccaggaccaaccggcctcctctgatctgcctgccgcccccagcttcgcggaacagctggtgctgtacctgaaggtggccgagctactgtcctccggcctgcaaagtgccatcgaccagatccgggccggcaagctctgcctgtcgtccactgtgaagcagggtgagggctgcgaccgctcagcccacatgccgggttggggaggaagcccaccttgcaactgcctgggtgacagggtaacagggaggctgcttgagtaggcccctgtgcagaggtgcagaggccccggggcctggcccagtgtgcagagcacagaggccattgggtcggacagcaccctggagcccagtatgcagagcacagaggccgtggggtcggatggcacccgggacaaggtgcggagcctggccacaccctcaaggccacggggagccagggctgtggcagggagggagggacgtgctcgctcagtgcaccgggcagatcatggccactccagccctgccccgtgtctgctgcaccctgagctgaccaccctcgtcctttgcagtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtacgggacagacagacaccagtggggcaggggccaggaacttccaggcccgccgtctccactgggacgggaccttgatgcccacagcgtggtgagactttggggggtgtcacttctggaggtcttgaaatgacagcattatgcacccccagcctcctgcaggcgctcgcagctcggctgggtgcatccttgattgtacgggtgccgtggcccatgtgcatcctgcctcgccccgactcagtttccccaattgtaaaatgagagacttggtcttcaggcctcgtagtcaggtgtcagcctccagaagcagcacctggtcccggacaacctgcctggaagtgtggtgcactcaggtggtaccacgggcaaagactccctgcttgggctctgaagagctccctctgcctctgaggtggtgcccccttttcgtttattttttgttgtttttttttaagagagggtcttgcactgttgcccaggctgaagtgtagtgtagccgctaactcctgggctgaaatgatcctcttgcctcagcttcccaagatgctgggtattacaggcaaaaactcatgagtgcctgagtctccttttttaagaaaatttaagcatgtagtaaaaatccagtctgaacaaacatgggaaaagtcagcctccctcctgccccccttcccgcccaggcaggccaggcagcagcagtaatgacactgactgagcggcgggcactctgttgtcctggggccgggctgagagcgctggccagggtcatctggttccaggcagtgtctccccttggccctgtgaccatcccctctgcacagcaggctgcaccagcacttatgtctccacgtcactgccctgagcgcctatctgccacccctgggccgctgccgtgggtgcagggcagcccttgctgggagggagtggggtgagctggccctgtccagcctctgtcctcgcccccaggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgtgagtgcccggctgggctgggggctggggactctgggcgtctccctcacactcccctctccctccacaggcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcatctgcagagagtcttc

SEQ ID NO: 979 - DNA, 129969 bp, Homo sapiens
gatcacttgaggccaggagttcaagaccagcctgggcaacatagctggacgcctgcaacttcccaaactctgaataatattaagtgctccagggcttagtcctgggtccttttctcttcttgttctagacttactcccttggtgatttcagccagcgtttaaatgtttttactctggcaacttccacattttaattttatttttatttatttgtttatttttgagatggagtctcactgtctcgcccaggctggagttcagtgacacaatctcggctcactgcaacctctgcctcccgggttcaggcgattcttgtgcctcagcctcccaaggagctgggattacaggagcccgccaccgcgcctggctaactttttgtatttttagtagagacagtgtttcaccatgttgcccaggctggtcttgaactcctgatctgccctcctcggcctcccaaagtgctgggattacaggcgtgagccaccatacccagtgactcccacatttgtatcttaaatccatacctcttccctgaaatccagactcatgtatccaactccccactccacattggctttgaattccggtctgccctttgccacacttgtaacttctctgcttctgtggtgaggatgattgcaagggcaagaacagatgtagggagatggtcaggacactgcacagtggtgcaggtgagaggcagtggtggcctggagtttaaaactccagtttttgttttaaaaacaaaaagttttttaaaaaatagctaggtgtggtggtgtccacctgtagccccagctacttgggaggctgaggtgggaggaccacttgagtctaggagtttcaggctgcagtgaactatcatggtgccactgcactccagcctgggtgacagcatgagactctgtctccaaataaaaaataaaaaagactggcactccagccaggaggatgagggtacagcatagaggctgagaagtataaataatgctaggatatgccagggactcaagtgtgctgtgtgccttgggatgaaagggtgagcaggggagaggttagaaatgtacctggacaggtgggcaggattgaatcttggagtgctattcactcattcgttcactcattcaacagatacttactgggcacctactctgtgccaggcaggtgctgtggatacaacagtgaacaaacagtagtgaaaaatccctacctgcagatagttttctttctggtagtggagacaaacaacaaataggataaataggtaaaattatagtaaagaagatggtgataagtgctaagcagaaaaacaaagcaagagaagggattaagaggttgtgtgtgtgtgtgtgtgtgtttgtgtgtgtgtgtgtgttgggggcatgtatttaggtttcagtcttacataaggtgattagggaaggcctccctgaaaaggagacatctgagcaaagacataagaaggtgaagagtttgggaggccaagacgggtggatcacaaggtcaggagatcgagaccatcctggttaatacggtgaaaccccatctctactaaaagtacaaaaaattagccgggcgtggtggcaggcacctgtagtcccagctattcgggacgctgaggcaggagaatggcgtgaacccaggaggcaaagcttgcagtgagccaagactgcaccactgaactccagcgagactccgtctcaaaaaaaaaaaaaaaaaagaaggtagagtgagccacgtgtgtaacagaaggaagaagattcttcatggcagaaggagtggaaagtacgaggaccctgtggtggtactgcccggtggcaagtataaggaacatcagtgtgcctggaacggagtgatcaagagcagagagtggaagggaatgcggtttaagtagtaaagggtggcaaggcaaatagatacaggatcctttttttttttttttttgagatggagtttcacaattgttgcccaggctagagtgcaatggcacaatctcggctcactgcaacctccacctcccaggttcaagcgattctcctgcctcagcctcctgagcagctgggattcaaggtgcccaccgccacacctagctgatttttgtacttttagtagagacggtgtttcaccatgttggccaggctggtctctaactcctgacctcaggcgatccacccgcctcggcctcccaaagtgctgggattacaggcgtgagccaccgcacccagccaggatataagatctttttaaaaagatttattccataaacaaggagcaggagtggataggatcttgaagacgactgttaggagttggctttactctgaatgaaatggggaaccactggggagcattttttgttgttctgtaggagtctgacaccatacattggagagttttgagtggaggagtgacacggtctttcattttaatggaattaatcacattggctgctgggaggaaattaaattagaagcagagggtggagtggaggtgaaagtggaggcagaagtatggttaggaggctactgcaacagtccaggcaagaggtcagttgacttggatcagagtggtagcagtgaaatagtatgttttaatttttctgattttggaacatttcaaacaaagtggaataatacaatgaacctccatgtaccatcaccagtttcaacaatgatcaacttatagacagtctggtttcaattctacccccatccctagattccctactgtgttatttggaagtgaatctggacatcatgtcattccgctggatatattttgactccaaggctgacaggtcttgctaatgggtagagtatgatgagagagaaagatcagagtcaaggtctaagtccggggcttttggccttagcaacagaaaggttgaactgcccttaactgaggtgggataggctgggcatggagatgaggaaggaactcagttttggaactgaagtttggggtgtctgtcagagacccaggtggagatatgtggtggggagttggatatgcgagtctgtattacagggaggaggtctggacttgagataaaatgtgggggtcaccggcatagggatgtttaaagccatgacactgaatgagatcaccaagggagtgatgacacagcaggaagagaaaaagacccaggactgagccccagagcacttaatattattcggagtttagggagttgcacgagtccagcaaagaagaaggaaaagaagtagctagtgaggtggaagagaaatcaggagtgatggtttgaaggccaagtgaagatattgttttaagaaagaggaaatgggatgggcatggtggctcacacctgaaatcccagcactttgaaagtcaagatgggaggatcgcttgagcccaggaattcaagatcagcctgggcaacatggcaaaaccccatctctacaaaaaaatacaaaaattagccaggtatgatggtgagtgcccatagtcccagctactcaggaggctgaggtaggaggatcacctcagtccagggaggtcgcggctgcagtgagccatgatcatgctactgcactccagcctgggtgacagagtgagaccctgtctcaaaaaaaaaaaaaaaaaaaaggagaagaagaagaagaagaaatggaaatgatccactgggttaaatgagtgccaggtgaatctgctttttgtcctgagggcagtggcaaatttaggggagtggcatgtagtggagttaagattggtctggctgcttccatggtgaggacgaaccgcagagggcaagggcagatgcagggaaatgcattaggacacttcgcaggggtgcaggtgataagcagtgaggcccaagacaaggctggaagcagtgcaggtggagaagaggggttggattctaggtctattttggaagaagggtgggcagggcttcttgttgactataggtgaggggcaaggagaagacagggatgactcccagctctctggcttgtgtccttgagtaactgttggagccaccattcccaaggagagaaggaggagtgggtatggctgtggggagttcgaggggtgcattttggataatgatttggtagtacccaaggatgagaagcgagtgacctgctccatgtaaagacatatttgatttccctcagtatacacgtggtcactggtaccttggggaagaatgaatcacaccaaaatgaactaatgtagagacagagtctcgttccatctcccaggctggagagcagtggtgcaatcatagctcactgcagcctcgaaccccggctcaagcaatcctcccacctcagcatcccaaagtgctgagattgcaggcatgaactgctatgcctggccaagccccaaatttaagtgatgagcagaggaagagaaatttaggcggtacctgctggggtggccaaagaggtgggcataaccagagttaaaaaaaagtcacccacattgctgaatgcttctgaaaagttaagaaatacagacctgaaaagtactcaagaaaacgactggtgatcaaggtgggcacagttttaggcgagaggagggagctgaagccagattaggctgggtggggtcgggggcatggagaccagaagtgcagatgattctttcaaggagtttgtccatcatgacacattccaatttaacttttcaaactggctaaccccaagtggaaagcatcacatattttaattacataaattataaaagttcttatatttccagtgtttggtagtacctgatccttcagcaataccatattatgaggatttaaagagcagtgacaatttcacaaagctaagtcaacaaccggttaagactccaaacatttgccatatggttacgatgactgacaatgaacttcaaggcaatatagaagttattcaaacaataaacattcagaccttaacctattggttttttattcgacttcgtgaaatctctgagggttacatagctttcaattatttgatcattaatatgttggatgacatttgaggatttcaaaagggaacatgaaatcagtaatgtgttggttttatggtttgttaaaataccacccagttgagcaggcatctgcagggagggagaagagccagtggataggaaggggctgagctaggttttgagcaggagaaagagacacaaagatgagtgttgtcttagcttggattcccctcaatgcagagcatgagacaaggggttgcatgaaggtggtttgttctgggaaatgatctcaaggggtaagtgtgggggattaggaagcagagaaagccaatctgaggaactctttctctttttctttctttctttctttctttctttctttcttctttctttctttctctttctttctttctttctttctttctttctttctttctttctttctttcttccttccttccttccttccttcctttctttctctttctttctgtcatctctctctctctcttttctcttcctttttttttgatgttgtcttgctcattcgcccaggctggagtgcagtggcatgatcacaactcactgtaacctcgacctcttgggcttaagtgatcctcccacctcagcctcctgagtagctgggactacaggcacaagccaccacacctggctaattttaaattgttttttgttgttgttgttgagacagggtctcactatgttgcccaagctggtgtcgaactcctagactcaagtgatcctcccacctcagcctcctgagtaggtagagctacaggcaccatgcctggttaattttcagaaaattgtttgtagagatggggtcttgctacctcagacagggctgagataggaggatctcctgaatgtgggaagtcaaggctgcagtgagccctgatcactccactgtactccagcctgggcaagggagtgagaccctgtttaaaaaaagaaaaaattgtccatctgagaggtagaagaggggccactggttctggccttccccttggttatgggttgctccatggggtgttaactcccttgaacttgcaggtttgctcatgcatcctaatgggtgagtaggcacccacagatgtgtcttatgaggtggcggagaatgccttgatagaaagcagggccaagtttcctattcatggagagagattatagaagaaaatggctcacaggctgggtgtggtggctcatgcctgtaatcccagcactttgggaggctgagatgggcagatcacctgagaggtcaggagttcgagttcagcctggccaaatggtgaaaccctgtctctactaaaaatacaaaaaattaacagagcgcagtggcgggtgcctgtaatcccagcaactagggaggctgagatgggagaattgcttgaaccgggaggcggagtttgcagtgaaccgagatcgcaccactgcactccagcatgggcaacagagcgagactccgtctcaaagaaaaaaaaaaaaaaaaaaaaaggctaacaatgcatagaataatgctgccaatttcctctcctccctgtatacacactcctctacaaggctggctttgcagctcctcccagcaagaggtggagtttatttctctatttccttcaaatcaaggcttggccatgtgacttgttttggccagtgagacattagcaaacgcgatgcaagcagatgcttaaaaagtgccggcctagggggacttgctctttctcttgctcctgtcagagcccagtgaccacatgcacaagctcaggttggcctattgggtaaggagaaacctacggtgaaggcagccctattttctcagctgatatatatacacacacacacacacacacacatatatatatatatatatatacacatacacatatatatacatatacacatatacatatatatacatatacacacacactatatatatcactatatattatatatattatatatatcactatatataatatatatcactatatattatatatatatcactatatatttatatatatcactatatattatatatatcactatatattatatatatcactatatataatatatatatcactatatataatatatatatcactatatataatatatatatcactatatatataatatatatatatataaaatacatatatagtttgtttgttttttctttagacggagtttcactcttattgcccaggctggagtgtagtggcatgatctcagctcatagcaacctccagctccttggttcaagtgattctcctgcctcagcctcccgagtagctgggagtacaggcgcccgccaccacatccggctaattttttgtgtttttagtagagacggggttccaccatgttggccaggctggtctcaaactcctgacctcaggtgatccacccacctcagcctcccaaagtgctgagattacaagcatgagccaccacgcccagccttcccagctgatattgaaccaactgccagacacgtgggtggagctggtgtagatctcctgtggcaggtgagccagatcagaccaggaaaactgctcagccaagtcacagaatcattgaacagaaaaatggatgttgtggagtgattcactatgcccagaaccaagccgggtccggctgcattttctcgaggcccaataacgagaagcagagaaactagaaaagaagggaatttattgctgtaacaagatacagggagataattccaccagaccaactcaaagtgttaccattttcttagtgcttatataggttgaggttatgtgcctatgtgccgtatggcattcgcctaagtctattggtaactaattttgtttcaactagaaggtcagaggccaaaaaaaaaaaaaaaaagacttgctaagttccattaagctgtgagaaccccggtaccttttgttttttgagatggagtcttgctctcttgcccaggctggagtacagtggcatgatttcacttcactgcaacctctgcctcccaggttcaagaaattctcttgtctcagcctcttgagttgccgggaccacaggtgcacaccaccatgcctggctaatttttgtatttttagtagagatagggtctcaccatattggtcaggctggtcttgaactcctgacctcaggtgatccacccacctcaggctcccaaagtgctgggattacaggtgtgagccaccgggcccggcggagaaccccagtacctttaaggcctgtctgttgtgtgattatttctgtcttatctcctttacagcttggtccggattgctgccttagactctccaatgaatttattcaaacagctgcctttgtgctgctgtgttttgcttatctgggagcgagagtttctgtgtctgttcccaggcatcttcttgcagctgcaggcatccccgccacgtctgcttctagcttccctgtagtctttgtgctgctctgcggaaatgggtcggtgtaacggaagtgctatgcaggtctgtgtgtgtgattgtcagggagagttggcctggcacataaaccagctggcaccccctctggcatcatctggactcctggatccacatgacagttaattttaggtatcaggatgcccagagagtaaaacattatcgctgggtgtgcctgtaaggctatttccagaggagattagcatttgaatgagtacactgagggatgaagatctgccctcactaatgtaggtgggcaccgtccaatccactgagagcctggacagaacaaaatgtgaaggaagggtgatgaatttgccatcctccttgggagctgggacattcatcttctcctgccatcagacatcagagctccaggttctcagatcttcggactctgagccttacaccactggctcctctgggtctccagcttgttgacgccatattttggaacttctaagcctccgtaatcatatgagccaatgatttggtttggacctgtgtctctgcccaaatctgatgttaaactgtaatccccagtgttggaggtgggagctggtgggaggtgactggattatgggggtggagttctcatgaatggtttagcaccatctccccttgatactgcagagtgagttcttgtgagatctggttgtttaaaaagtgtgcaggaggctggcaggtgaattgcttgaggtcagaagttcaagaccagcctggccaacatggtgaaaccttgtctccactaaaatacaaaagtgagctgggcttggtggtgggcacctgtaatcccagctactagagaggctgaggcaggagaattgcttgaacccaggtggtggaggttgcagtgagcaaagatcatgacactgcactccagcctgggtgacagagcaagactctgtatcaaaaaaaaaaaaaaaaaattatgaaggacctcccccttctctctcttgctcctgctccagccatgattgtaagtttcctgaggcttccccagaagcggaagttgcaatgcttcctgtacaggctgcagaagtgtgagccaattaaacctcttttcttcgtaaattacccagtctcaggtgtttctttatagcagtgtgagaccagactaatgcagtcaattcccctaataaatcccctcttctttatctacacatataccctactggttctgtttccatggagaaccctgactaacacggtccagttgtacctaatgttagcttcccctggactcttatgggccattatatgctatttattttgaatttgtatttgtatttttagagtcagggtctcactctttcacccaggctggggtgtagtggcacaatcatagctcactgtaacctcaaatacctgggcttatgtgatcctcctacctcagcctcccgagtggctaggactatagatgtgcgcttaccacacctacctaacttttatattttttgtagatatgagatctctgtgttgcccaggctggtctcaaactcctggcctcaagtgattttcctgccttggcctcccaaagtgctgggattgtaggtatgagccaccgcagccagcccattctacttatttttgcataaactattttgaatggggtgtctgtcacttgcaacccaaaatgtccttatgttccaggagtgaatggactggaaggataaatgggcagaaaattgaaggcatccactagggagtgactggcaggcttgaccatggggtctgggctggatagaaaggcaagtaaaccagggtgtagaagaaatgggtcagtagcccaaggtccttcctccttgaaaccttaagacttccttctctgaatctcttcttggagctgaatgaaattcactggtagcctcctggtctccccagtgatactgggctcttgctaactcatatcagcctgttttctataggcccctagaattccacagaattgtgaccgcctccctgtttaaaagtaggaaaactgtggagccccgtccctgatcattaccataattcatctccttgcattctggcaaaacagctcagttggacttctgggtcttagggactttctccttgtgatatctggagcaccacggaataaagctgcatccagttttcaacctacccaaaggacagaaacttgcacaaaaattgtctcaatgcctaatatcacaacattttctccatcctccttcctgactctaaagcaggagggagatagctcctggggattctgaaaccaacaggcaaatggcaaatgttgtcagggataaacatgcaaatttatgcataaaatatgaaaaacgccaatggtcagaacttaatcacatggtcacacccagctgcaagggaggctgggaaatgtagtctttagcctttggcaatgtgcctaactaaaaattctattgctatggaagaaagggagaaaggatattgagggaaaatagcaatttctgccacagcatgcattctgtttttgccatgttggccgtggtatagaactaagagtgagggaacttccaggactggaaagaatacaactctttagaattccctctactccaacacgaggatatgcagggagaatttggagggggcagtggaaggagctaataacagctggtagctgttgcatttagtgagcactgtgtgttaggcagtgggtgcagaatttcacctgtgtcgtgttgttccagacctcatccaatacctcattcagtcctccttgaattcatccattcattcaacatgtatttacggagctcctattatgtgttagccactgtgccaggcactgggagacagcgctgaataagacggtcctccattcctggtgagtttacagcaaagcaaagtagtcgcagcatgagctttggagccagagtgtctggattcaaatccaagtgtattcattgtgtgaatgtggaagtcatctaaactatttgtgtctcagtttccccacctggaaaatgaggatgataataggacctacatcctaagcctactgtggtgctccgaagaaggaatagatggaaagtactcagcccagcacctgacacatagttggtgctcaatgaatgtgagctattattctaatgagaagacaaatctcgaattggaattttaatgagatgagtgtgaacagaaagaagagcagggttcactgttagcagtggctagaaatctgggagccattctttatttttttttttttgagatggagtcttgctctgttgcccaggctggagtgcagtggtacaatctcagctcactgcaacctctgcctcccgggttcaagtgattctcctgcctcagtttccctagtagctaggactagaggtgcatgccaccacggcctttttttgtttttttttttttgtacttttagtaggtatgggtttttgccacattggctgggctggtctcaaactcctgacctcaggtgatccacccgcctcggcctcccaaagtgctgggattacaggtgtgagccaccgtgcctggctgagtcattctttttcccagattattcagttgagatataactcacaaacaatagagcacacaggtttgaagtgcagtggatgaggatgatggcacttgccaccagatgccccttcaggactggggcactcatttcccagctgttgggagtgttgctgctaacagctcctagttgagtccctgccagagcattgccctcagacaatgggaggttgcttcactcaagatcatatcctcagaccaggtgtgcctgttatcccagcactttgggaggccaaggagggagggttgcttgaacccgggagacaggggttgcagtgatctgagattgtgccactgcactccagccactgcactctagcctgggcgacaaagtgagactccgtctcaaaaaaaaaaaaaagaaaaaagaaaaataatggtaaatatctacaagttacaaagagttcttaaaactgataaggaagacagacagctcaatgggaaaatgtgcaaattacattaatacatagctcccaaaagttctagttgagaagtcccaaacaaatgcatttttttgaaaggtagactacaaaaccagtatgcatgatatgactccacttatgtaagctctgtgtgcaccgtacgcacatagatttcaagagaggcaggagaggctaggcgtggtggctcgcacctgtaatcccagcacttcggggggccgaggcgggcagatcacttgaggtgaggatttcgagaccagcctgaccaatatggtgaaaccccgtctctactaaaaatacagaaaattagctgggcctggtggtgggtgcctataattccagctactcgggtggctgaggcaggagaatcacttgaaccagagaggtggaggcggaggttgcagtgagctgagatcgcgccactgtattccagcctggatgacagactgaggctccatctcaaaaaataaaaaaaggcaggagagaatagtcactgttattggtattctctcagggatttcatgtgaattttatcattttccttatgcttttctgcattgctttaattttttttaaaaataagtctattgtgatattcagataatcagaaaaaattaattattattattttttgagacagggtctcactctgtcacccaggctggagcacagtggtgcgatctcagctcactgcaacctctgcctcccaggctcaagcaatctttccatctcagcctcttgtgtagctgggactacaggcaagcgccacctcgcccggctaacttttgtatttttttgtaaagacggggttttgccatgttgcccaggctggtctggaactcctgagctcaagtgatccacccacctttgcctcccaataatttaatatttaagaaatttaatatacattttaatgtatattaaaataattgctggaaagactacataaaaaatgcagactacttagcatagatcatgaacagaattaacagtcagtaaatggtggttttattattattattgatgttattgtttttattaatatctgaagcccctgagctctgaagcttgttgaaaatcatgtttgtactcatcaggaaccattttattgtccttgagtaaggtggcattggaaccaggaggttctaagcaggacaccacacttcagaatgtaacaggtgggctgtgtgtggtggctcacgcctgtaatcccagcactttgggagaccgagttggtaggattgcttgagcaacagagtgataccccctgcatcccatctctacaaaccataaaaaaattagcttgatgtggtggcacatgcctgtggttccagccacacagaaaggtgaggcaggaggcttatctgagcccaggtcaaggctgcaatgagctgtgatggcaccactgcaccactccagcctgggggacagagggagatcctgtctcaaaaaacaaaaaagagaatagtatagcacagtatggcaacaacaaacaaacaaaatggctatccctaacattgtacggtatccttagacaatgaaggttatttccatttttttctcttaaaaaatgctggaggccgggcgcagtggctcacacttgtaatcccagcactctgggaggccgaggtgggcagatcacctgatgtcaggagtttgagaccaacctgaccaacgtggtgaaacttcgtctctactaaaaatacaaaaattagccgggcgtggtggcgcatgcctgtagtcccagctactcgggaggctgaggcagaagaatcacttgaacctgggagatgaaggttgcaatgagcagagactgtgccactgcactccagcctgggcaacagagcgagaccttgcctcaaaaaataaaaaataaataaaaataaaaaataaacagggcccaacaccctgcaagcaacctttctaatcccaaaggattagagagaaatcacctccttgggttgggtgggaatccatcatttggaagtcccatttatttccccaggccatgatggaatatggtaacacatgcatttatgggaggacttaatctccaaggtatcgctccagtcctgtctccctgaaaaagggcaacctccactctctcccactggattccactttctcaagcctcccgaggccaggttggcaaagcggccctgactagtttctctggacccgacctgtcgctgtctttacccagagcatcgaaagccgggagcttatccatccaaatgactccgctgctcttcctggactggacctggagggacagggagtcaggggcccttgtcccctccctgtgccggaccacagtgatattgtaggccaggctcttgctacagtgaaccaattctcttcaatgaagctgatgatactgtctcgcagctgtgcctggtcttggacgctggagaagcagctcaggaagagaatcaggtccaggtcagagctgtagttcagcatcgtccccttccctgtggagacgctctgtggaggatgacatgggtgagtgtcacctctgctgagatctgatgctttggggttaggaatgaagccagaggcacccaggttaggctgttcacccaggtcccaaaggagcccttggtctccatcatacatcatggtctttgctgagtattattacttttttcattgattcaaaaaaattaaatacccggtaaacacttcaaaggatgtaagtaaaatgtaaaactccactcctcttaaagcccgaaactccttttccagagacaaccacagttacaagcttcttgcatatcgctccataaatgtacagcaagacctgtatcacccaacatggtatccaagaaccacatgtggctatttaaatttaaattaattatgctgggagcagtggctcacgcctgtattgccagcactttgggaggctgaggtgggaggattgcttgaggccaggagtttgaggctgcagtgagccatgatcaccccactggtactgcagcctgggtgacagagacactgtctccaatagataaataaataaatttaaatgaattaaaatgaaatgaaataaaacattcagtactttggtcctactgacctcatttgacgtgctcaagggctgcccagaaatagtggctattgtattggacggtgaatgtatagaaccttcccacagggtgcggtggctcacacctgtaatcccagcacttcgggaggccaaagcgggaaggttgctttgagccaaggagttcgagatcagcctgggcaacagggcaaaaccctgtgtcaacaaaaaaatcagccgggggtagcgctgcatgcctgtagtcccagcttctcgggaagctcaggtgggacgatcgcttgagtcagggaggttgaggccgcagtgagccgagaccgtgccatggtactccagcctgggcaacagggcaagaccctgtctacaaaaaagaaccttcctatcatcatagaaaattctatgaacagttctgactgaaacatattgttgtgcatatattttgtatacatctatttcgtatgcgtagaggcatgtgtgtatgtataaccatttttgagacttttaatttggaagtaattacagattcacaggaagttgtaaagataggacagaggcgtctggtgtgtcctttactcagtccccctcaatgctcacatcttacacagctatagtggaatgtcaaacccagcaaattgacatcaacacaatgtttgtattcgttgtgtgacgtatcatcacatgcagggattcctgtaaccaccactgcaatcaagatggagaactattccattactgccaagacgggcctcatgcagcttcttcatgtcacacccacctccctcccctcctccatcctgaaatcagggaaaccattaacctcttttccatctctgttgtcttatcattttgagaatattatatacatggaactatatggtatgtgaccttttgaaattggcttttcccctccactaagcaaaatgcttttgatatccactggtgttgcatgtcttttgtgtgtgtgttttcttttgtttatttatttttttgaggcagggtctcactctgctgcccaggctggagtgcagtggcacgatcttggctcactgcaacctccatctcctgggttcaagcaattcccatgcctcagcctcccgagtagctgggactataggcatgggccaccacacctggctaatttttgtaatttttggtggagatggggtttcactgtgttggccaggctggtctccaactcctgtcctcatgtgatttacctggttcggcctcccaaagtactgggattacaggcgtgagccaccgcgcccagccatcactcttgttacagattattcaagatttgactccagtccctaatctgcctgcctgctatttagtttttggagtcctcaagtacttgctttctaatgtctgtccagagttttagttgtaatttgtgagatgtttactacatcttggctggcaccggaagtttataatcacttttgaaataagtatatttatagttacacatgaaataaaatattttctagttctttataaacattgaaaatgtgatcatagtgcactaaaatataaatggtgcttatctatgaatagtaagggcattcatttgagggttttttttggtattttcctatatttttgtgactcaatgtatgatttttgtaattaaaaacattatgaagcaattttgacttcagattcctctgtaaccttaatttagacattggattccttgaccagaggacacagaatagtagaaaaggaagaatatcggtgtcaggtggagttagtgactaagtactgcaagagatgtccttgcaaacgttgtccctggtcccagaagactctccaagatattcatggcaggaaatcaaatggaaccagtatattcgactctagaaaaatacagcactcttgtcttaataaggatgaatgaaagctagaagactaaaatgcaactaagaaaacttagggctgggcgtggtggctcacgcctgtaatcccagcactttgggaggccgaggcaggaggatcacctgaggtcaggagtttgagaccagcctggccaacatggtgaaagcccgtctctactaaaaatataaaaaattacccaggtgtggtggcgcatgcctgtaatcccagctactcgggaggctgaggtaggagaactgcttgaacatgggagaaggaggttgcagtgagccgagatcatgccagtgagctccagcctgggtgacagagtgagactctctctcaagaaaaaaaaaaaagaaagaaaagaaaacttaaaggccgagtatggtggctcacacctgtaatcccagccctttgggaggccgaggcgagtggattgcctgagctcaggagttcaagatcagcctgggcaacatggtgaaaccccatctctactaaaacacaaaaaaagaaaaaaaaaattagctaggcgtggtgttgcgtgcttgtaatcccagctacttgggaggctgaggctgaggcacgagaattgcttgaacctgggaggtggaagttgcagtaagccgaaattgtgccaccactgaactccagcctgggcaacagagcaatactgtctcaaaaaaaaaaaaaaagaaaaaagaaaaaaaaaaccagaaaggaagaaaacttagtgcttgaaaagctcaagcaaatgttgaattatatgcaatgtactcccttcttcccaatacagaaacaaagtccttcttgttgcttgtttaccgatgtttattcaaacaggatctctagctctatagataactttgttgtaggcattttctgtgctggtcaaaactggtggaaataggtattctaggggcgtttccacctctggaaatagagatggttgagagagcaagaggaaaggtaaaatgcatttttttcttatacagacaaatagtctccatttgaaacacatccccgtagaggcgggaataggaacttcacgttgtgagtgtttgagatcatatgaatggtgcgcctcccatcaagacagtgcctttcaatcagtagaagaactttattatgacatatgttaaagtacttgaacaccctcgaacccattcttaagagaatacgcattctatttctggttctgatcgggattccccttttctttgtgtttttgttttggatctggaaagcaaagatgctgccagagctctgcagcagagggaccttagggcacatgcagatgtgtggacgagccagaagccagaagggcaaagttgtatctttttaagcaaccatggaagctcgaatttctgttttgaagctcagggtttgctagtaacactcctgattatttgccttcgactccgtatttaaagattctttttttgagacactgtcacccaggctacagtgcagcggcatgaccacagctcactgcagcctcgacctcctggcctcaagtgatcctcccacctcagcctcccgagtagctgggaccacaggtggatgctaccatacctggctaatttttttgtgctttttgtagagacaagttttcgtgatgttgcccaggctggtcttgagctcctgggctcaagcaatctgcctacattggcttctcaaagtgccgggattacaggcgagaaccactgtgcctggcctgaagattcattaaagctgcatttccttccttttcagtcgtattctcggcagccattgccactcccaggtgaagtctgatttgcttaagataatgttagatgtctttcattctagcaaaataaaccaaatctagatttatggttaaggcatttttgatttagggtgatatgttaaaagttgaactatagtttagtactttcccaggggaaaccatgctataaatacgtatttgattccatggtcagcctctaacaaaccctctgaacccagagagtaccctctgatattacctaattgctaggtagtttctaacaaaatcagtcagcgccattttatttttttacttttttttttttttttgagatcgagtctcactctgtcacccaggctggagtggcgtgatctcagctcactgcaagctctgcctcccgggttcacaccattctcctgcctcagcctcccgagtagctgggattacaggcgcctgccaccacacctgactaagtttttttttgtatttttatagtagagacggggtttcaccatgttagccaggatggtctcgatctcctgacctcgtgttccgcctgccttggcctcccaaagtaccgagattacaggcgtgagccaccgcgcccggccagtcagtgccattttagaaggaaaatatagatgatcttgatgactttaggggttaagtggggctggttaaagaggaaacaaaaggcataaattttattttaatttctttaaaaattttttttaaataatatataaaaaagtttaaaattttaaataattgagatgaggtcttgcaatgttgcccaggctggccttgaactcctgggttcaagtgatcctccccactcagcgtcccaaagtgctgggattacaggtgtgagccactgtgcctggccaaaaggcataaattttatacaaacctgctacccatagtccacttgattccctggcacttagagagctggatcccaaatcatcatcatcatcatcatcatcatcatcatcatcatcatccagatttgtagaatagtttactgcttaagagcacttttctatgctttatcccatttattgttcattagaaaccggttttagagaggaagagaccgatgctcagagagacaaaataactcatcccttacctatcccacagccccacagtcccacagggcagagctgggatttgaaccccgggggttcctgagtgctcacctttgccatcttcagcaccctgacttcctggtccagaatcagctcattatagaagaactgatccctcaagaactgctcagttcaatgcccggcatccttcacttcatccttccagtctccctggggctggaggctgttttacgaaggcagactggaaggatgttttatgaagacatccagcctgtccccaggggtgtcatacaggtcctggaagcctgccatctctgtgggaccaggaatgaatcgtctctgcttctgcccagccctgtaaggggcaactcccagcctttgtccagtaggccacagaactgcagaagggcagggagatggtgtgggttagagagagagttagctgccctttttctttcttttttttttttttttttgatacagagtcttgctctgtcacccatggcgtgatctcagctcaccgcaacctctgcctcccgggttcaagggattctcccacctcagcctcctgtgtagctgggattacaggcacctgacaccacgcccggctaatttttggtatttttggtatttttagtagaaacggggtttcaccatgttggccaggctggtctcaaactcctgacctcaggtgatctgcccgccttgggctcccaaagtgctgggattacaggcgtgagccaccgacggaagaatcactaagcttactttcctctttttagggtgcagagagggctagggggccctccaggcatcagctgagcctccctctgctgggctgccttagttcagcagccatctctcctgccggctgagaatggaaactgaaactgaactttgttttgtttgtttgggtttttttgttttgttttgttttgttttaattggaaacagaaaatttgctgagctttgaaagaggaattttctctttccatttgaggttgccaggaaaaaaggctggagatggagccaagtgccccttgggcttccttgagaggaaggttctcaggctgggagtttcccagggtgtcctggagctgggctgcccccacctctccatcccctatttcctgctgcaggagcagaccttgtctccctacgggaactcagtagtgtctgccccggaatcagaaggtgctggctccttggggtgaggggatgggggcttgggctgagccccgggagtcctggggcctgggattgactctttattttctaaaagcaaagacatactcacccctttactacttgttttgttgcgtatatttaggtctcccctatcccctcaccaataatccacaggaaggaggtaatcttttaaaaaattgtctttagggggcgctgttctctcaagaacttcattttgaagagcaaactgacagtttgtggtagacacattggcttttaaagatctcaactagcgaccaggcgcggtggctctcgcctgtaatccagcactttgggaggccgaggcgggaggatcgcttgaggccaggagtttgagaccagcctggctaacatgatgaaacctcgtctctactaaaaatacaaaaaaattagccaggcgtggtggcaggcgcctgtaatcccagctacttgggaggctgaggcaggaaaatcacttgaccccagaggcggaggttgcagtgagccgagatggcatcactgcactccagccagactgtctcaaaaaaaaaaaaaaaaaaaaaaaaaaaaaaggaaagaaagtaaatcccacattgatactgtggaggccataagtatgcacctataggatgcattttaaaaatgccctaacaacgcataaatatgtcactgaggtttgttaagaatgtccagatttccagcctgggcagcatagtaaaactccatctctacaaaatatacaaaaaaattagccgggcatggtggcatgtgcctgtagctactagggaggctgaagtgggaggatcacctgagcctgggaagtcgaggctgcagtgagctgtgatcaaaccactgcactccagcctgggcaacagaatgagaccctgtctaaaaaaaattaaaaataaaaatgtccagattcatgacagcctgtctctcactctgcttaacagagtaaaaaatactgagccctgaaacacaggcttagaaaattcaaaaattgccttggagagggaaaaccactaagtgggagatgcctgtgaagagcttgagttacaaaatctttttgaaaactgaaagtggaaaagagtaatatttgtatattaccccataacatatacaaatgtatagctgtatctaaataaattaacgaaatattggaagtgcatatttgatttcccttaagcttatgtaattagggctatgccaacatatttttatttttcatttatttttatgtttttccccattgatccatgtgattctcaaacacatttttattttctccctggcaaatatttgttattagtccattggaaaaattgattggatttggggatcaccttgcattagggcatttttggtatatgtactcatattttaaaaactgtgaattccaatatatattcttaataggaaactgcgacatttttgtcaattttcctctcttccacaagatgatgctccacacccacctaaaacaatcaccatttgtagttcctaggatcctagtacagaagagacagaggggatctgcttaatccttgtttttcagaaggcagacaggagcccagagtgtttaccagggctctttgacattatggtattgatattaactccaatagctatacttatcaagcacttcgtgtataccaggctctctacacagtttattttattctttattttttttgagatgggatctggctctgtcacccaggctggagtgcgtggcatgatctgggctcactgcaacctcacctcccaggctcaagtgattctcccacctcagcctcctgagtagctgagactacaagtatgcatcactgagcctggctaatttttgtactttttttttttgtagagatggggttttgctatgctgcccaggctggtctcaaactcctgggctccagtgatccgcctgccttgacctcccaaagtgctgggattagagtcgcgagcctccacacccagcctcttttcacagtttagttcccataatccccacaagactctgtgatgcaggttcacaccatgttacattatgaagaaatcgagtctcagcaagatgatgtggcctgcccagagtcacacaccaaagaagtggacaagctgtgattcaaacccaggttctctgattctaaatgccagaggtttacccacgacattatcttactgcccaaggcacttattatttattgagctcctactacgtgctgggcactgggcgaggcttggagaatacataaatgaataaggcagccccattctacgggcagtttgttatgtgtcttctctactgggaatcttcagcgtgagaagcacgtggtcccagggtctagcacatttcttggcacacaatggggcctcagttaatgttggctgaataaatgaatgaatgacaccatgtttcctaggaagcaaaagcacttcaatcttgtgactattttttagtccataaaacggatagatggtggaggacagagaacttcctggtgaccttctgcttgcttcgtcaaggcatctatcaagggtccccatctttgagtatggtggctcaaccacagtggaccatcccaaaggtcctctctggttctgcattgcagacactctgtgcatggtggtgcgggacctccttcctggaggtgcttgcttcttcatttaccccagtgtttcttaacattttgaagtcttgtgagcaccagagaaaatgatgaatgcaaggggccctccctctaaaaaacatgttaatgctaatattttgcatgcaatttcaggggcttcctggaccccaagttaagaatctctgctatggggccggacacgatggctcatgtctgtaatcccagcactttgggaggttgagacgggtggatcacttgaggtcaggagtttgagaccagcctggccaatatggtgaaaccccatctctactaaaaatacaaaagaattagtcaggcgtggtggtgggcgcctgtaatccaagctgctcgggaggctgaggcaggagaatcgcttgaactggggaggcagaggttgcggtgagccaagatcgtgccactgcacttcagcctgggcgtcagactctgtctcaaaaaaataaaaaaagaatctctgggccgggcgcggtggctcacgcctgtaatcccagcactttgggaggccgaggcgggtggatcatgaggtcaggagatcgagaccatcctggttaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaatctctgctgtggaagatgcttttttttatttttcaaaatttttattagagatggaggggcgtctcgctatgttgcccaggctggagtcaaattcctgggctcaaaggatcttcctgcttcattcagcctcctgaatagctgggattacagtgcatgccaccatgcttggcttctcctgtggaagattcttgaggaccaaaagacatcctaaacaagagtcacatctcaaacctttttattgaattcctgttttttgtgcatcatgctgggtgctaagggatagcgtagggaaaatctccagccttcatatcagtcagaagggagccctggggcagcagggcatctagtcatcagcctctcagctctcaagtcacatgtgggactgggatccgggtgtttcccacctccccagtaagcctgcaactttttcttccatctggctcccattttagagccttgcatatgtttcttcaagggaagcctggataatcctgaattgcctctaataaccacattctttttttttttaatttttttttttttttttttttttttgagacagagtctcgctctcgttgcccaggctggagtgcggtggtgggatcttagctcactgcaacctctgcctcctgggttcaaatgattctcctgccccagactcctgagcagctgggattacaggcacaagccaccgcccctggctaatttttgtattttttgtagagacagggtttcgccatgttgaccaggctggtcttgaactcctgacctcaggtgatccgcctgcctcggactcccaaagtactgggattgcaggtgtgagccaccgcgtccggctgtaaccacattctttaattcttgtttccaacaggtattcccaggaagaacaaaaagcggttccactcagggttctaagttcgaagttgccctcatctcaaccatcatcaacaaaacgccagaatgattttcttcttcttttcgttaatggtaaaaataagattttgccatttgttgggagcatacgtattgagcacgtttggggagcttgtgactctgggtcacaaaataagactgggtttttggaaatgtgggtggataaggtggagtgagaggggcgggataagctcatggctggctgcaaaagcctatccagggtttgtggagcttctaaaattttctagatccctttaaagaaaaatgacataaaatagtgaataaaaatttcagctcaaaagtgatgttgtttctgacctattttccttgtctctgaacaagttttttttttttggtttttttttttaaataacatttcttacaagatagatctactggcgataaattactgatgaattttgcctcaatgcaattctccatttccctcattctttctgcatttatgaaatggaaatctatattcttccaaaatgccccaccattttttgcttacctgaaagttctttatttctctttcacttttgaaggataattttgataggtacagaattctaggtgtgggggctttttctttcaacactaggtattttactccactctcttccttcttatgtggttcctgacaagaagttcaacgtaattctttttttttttttttcccctgagacagggtttcactctggtgcccaagctggagcacagtgccttaatcttgacttactgtagcctcaacctcccaggctcaagtgagccttctgcctcagcctcccgagtagctggaaccacaggcaaacactggcaagccttgctaatatttcatattttttgtagagatggggtttctctatgttgcccaggctggtctcaaactcctgagctcaagcagtcctactgccttggcctccaaagtgctgggattataagtgtgaaccactgcaccctgcccagtgtaattcttatactagtgcctctatgagtagtatgtatattttcctttggcttctttcaaagttttttttttttctttttcttttttttttcgagatggagtcttgctctgttgcccaggctggagtgcagtggcgtgatcttggctcactgcaagctccgtctcctgggtttaagcaattctcctgcttcagcctcctgagtagctgggactacaggcacccatcacctcgcccagctaatttttgtatttttagtagagactgtttcaccatgttggccaggctggtctcgaactcctgacttcaagtgatcagcccaccttggcctcccaaagcgctgagattacaggcctgagccactgtgcccggcttctttcaaagtttttatctttgattttacaaaatttgaatatgatatgatgagatattgacttctttgtatttatcctgtttggtgttctgagattcctggatctatggcttggtgtctgtcaataattttggtgagttatcagccattattagttaaaatatttcttctgcttctttcatttttctccttttagaattccctttacgaagatgttataccttttgtaattgtcccgccattttttgatatttttttctgttttcctcagtctttttttctcttgcttttcagtttgggaagttctattgacattttctcaggttcacggatttcttcatcaaccacgtgcagtccactgacgggtccatcaaaggccttctccgtttctgttacggcattttttatttctagcattcccttttgattcttagagttttcacttctctacttacatcccattggttcttgaatctcatccactttttccattagagcctttagcatattaatcatagttatcagtctgataatcatcaaatctctgtatattgcagtctggctctgatgcatgctctgtctcttcatactgtggtttttgccctttaatatgctttgaacattttaggatgaagatgagagagttgttatgtttcaaagaaaataggtactggttgggcgcggtggctgacgcctataatcccagcactttgggaggccgaggtaggtggatcacctgaggtcaggagtttgagaccagcctggccgacacagtgaaaccccttctctactaaatatacaaaaaattagctgggcgtggtggcatgcacctgtaatctgagctacttaggaggctgaggcaggagaatggcttgaacccaggagatggaggttgcagtgagccgaagtggtgccattgcactccagcctgggcaacaagagccaaactccgtttggaaaaaagagtcttctcgttatttatcagtttgggacaggtgctgaggagcggccaagcactgaaagaattttactggctgtcccaagtggtgtccccgagctctcaaaatctacgagctgtccgaaagcatttgggctttctaagtgggtttcacataatgactatgataaacctgtggtatttatgcactaatacctgtgctgggctatgtgcccactgacaccagcatatattgtggatagtgtgtaggaactctataggctcagataattccagacgtgtcaatacatacagatgatggaactcttttgcacagtgactggtggtcccacagctgagtgatgatggtgcatccgttgctcagagcctcggcgctggagccacatgcttgggttcccatcttggctcttttacttaggagctcataaacttgatcacattcatctctgtctctttttctccaaccggtgaaaggtgagagtaagccatgccatacgtatgtggtgacttctgaattgttcaatgtgtataatgttatcagtgcaaatgctcatgaagcttaattatcagtgaaatgccttgctttagattgcacgacttaacaagctcaaagattcatgcaagcccgggattccgaactcccaagccattgttctttctatgacatcttcctgcttggtctacaaccaaccactttatccaaattcatactcaattttgaaatactcagataaagctttcaaaaatgctgtctgtgtctggctgagtgcacactcaatggccactccacataaaagggcacattaggaggcctggcacggtggcttatgcctgtaatcccagcactttgggatgccaaggcaggtggatcacctgaggtcaagagttcgagaccagcctggttaatatggggaaaccctgtctctactaaaaatacaaaaaaaaattttttaaagggcactatggtcctccagagtggtccagttgcttgagtcatggtcaacagatgagctgtgcgaatgagatgaataccagtgtcctgggtggagccgcttatctactgacaagtctgctgtgctaaaagtggtgaaaaatatcatcttgccttatttattcctaacaaatgtaagtgcctctaaccttagattgcttccgagtcatggaaccaacagtatcttagcatcaactccgggtgatgggttaggggaacaagtcacacaatatatcaaaacaatataaacagtttttcagagctgcagctctatatgcaaacttgtacaattatcaccttattatttttaaatttatctttatatatatatccatatgacttacttgtttcttggtgtgaataaatctgtatattcttggttaatagtgtctaccgattcatttcatgtccctatctttattcaatatgggctactctttggatgagaaaaaaatgattgtacttgagtatatttacctttggaaaggtaagtatgttgggtgattgactgtagttgatacctctatgattctgcataaactcatttataaaataaactcaaatcataaaataaataataaaaaataaaagtggatcttgttttacacacgaacacatagacaatacacattcttattatctcttttttaaaaagttgatttatggatataaatgacatatcccaagtttactaaactaaataaacatttcatcaagaggaaatacatattaaaagcaaagataggtaaacttgattgcgtgaaaagccacaaagacatctgcatctttctaggtttgctccaaatttttgaaattaattattttagtagctacttaattaggtaaaaaaactgcattacaacaaactttgccatattttccccaggagtatacctaattgggcagtttgaggggtacaggatgtaataggaaatagcacatgttctttaaaggaaaaattcaaagggaacctgcttgacgctagaatcaaatatataaattaaggaataaaatagatccccaaaacacatttataaccgcatacgaaaaatacagaggataatttttaaatacatttaagaggacagcattcaacaggccagtgtgaacatacctctaatgcaggaactcaggtttcccataagaaataccaaaatctggccggcacggtgcagagtgagactctgtctccaccacgcccggccagaggttccattcttgaaattccatcaccagatatttctatcattcctaagtgatctaatatttctagaagcaataagcaaactgttcagaattagataaaagacagcataaatagatattcagttataaaaatcatatttctctaaaagttatatttctaaaagtcatatttccctaaaaagtcatatttctaccattcctgagagatctaatatttctagaacctataaacaaactgtttggaattagataaaagatagcattagttgatattaaataaaaatcgtattttttttactttttaaaatatattttttattaaaaataaaaaatagtatttaatattttaattaaataaaaatcatatttctctaacaatataattatcaaagttaatttttccacttatctctatatattactatgcatttagttatctcccaatctttgtgaattcatagacgaatttatctatcattgtgtatgtaaacggctggctattcactgagtctttaggggaaaaaagtcactatgttttcaccagtgcatctcctgagggggtgaacagtttgggggaatacatatatttttctttttttgagacagggtcttgctctgtcacccaggcttgagtgcggttgtgtgatcacggctcactgcagccttgacctcccaggctcaggtgatcctcccacctcagcctctcatgtagctgggatgtactaggcaagtgccaggagtggtggctcacacttgtaatcccagcactttgggaggccaaggcaggtggattgcttgagcccagggtttcgagaccagcttgggcaatagggtgaaacctcatctctacaaaaaatacaaagagtagctgggcctggtagtgcacacctgtagtcccagctactcaggaggctgagggggtaggattacttgagcctaggagtttgaggctgcagtgagccatgagtgcaccactgcactccagcatgggcaacagaacgtgatcctgtctcaaaaagaaaaagaaaaggccgggtgtggtggctcacgcctgtaattccagcactttgggaggccgaggtgggcggatcatgacatcaggagatcgggaccatcctggctaacatggtgaaaccccgtctctactacaaatacaaaaaattagcctggcgtggtggcacgcacctgtagtcccagctacttgggaggctgaggcaggagaatagcatgaacctgggaggtggagcttgcagtgagctgagatcgcgccactgcactccagcctgggcaacagagcgagactccatctaaaaaaaaaaaaaaaaaaaaagagggagaacacaactaagcaaaaggccccctaacaacctcaactgaatgtgggatgttgcctagaggaaccagactaaccagatcatgttattcaatataatattttagggaaattatccctaaattgagaacttcttctatttttaggtttaatttcatatatttgactcaatcatgtgaacaccactgcaagaggagttttttttgttttttgtttttttgagatggaattttgctcttgttgcccaggctggagtgcaatggagcaatcttggctcaccgcatcctccacctcctgggttcaagcgattctcctgcctcagcctccagagtagctggaattatgggtatgcactaccacacctggctaattttgcatttttagcagaaacgggatttctccattttggtcaggctggttttgaactcctgacctcaggtgatccacctgcctcggcctcccaaagtgctgggattacaggtgtgagccaccacgcccagacaagaggagttttgaggtacaatttacactgaattgtgatgattacaaacttccaaggataactagtcatacattatggtcctaggatctttttaaaaatgtgattcagtagataactttagagaaaacagcaaatgaaagacctccaagaattctctcctccaaaaaaatcaatgagaaaactggcaaaaattatcaccactaatatttttagacctctagaaattagccaaaagcttgcagtaatccagagggtgttgattaaaaaccaagcagaatctcaataagagcagtgagttttgtggcagtttaattttctctagtcctatttcctactctgtagttccatggtaacccagaaaattaaggcccacatttgccgtgaccagcaacctgccagccactgcagggagcagaataggactggagctccctcaaagcctcattcccagagaattatcactatttgaagtcatatttgaagtctgtataagactccaccttgttagactgtatttgacctgacttgaaatttgtccaaggcaaaaaaaagccttttctgtggcacaactatcaaaaacaatgagaggcaattgtttaactttgtggctgcttgaagtggtggattacagttggggcaaacaatagactaactaaaaagcttaaaagaaaagctgggaagttagatgaccatatggcttgtgaaaagttctgacacattcctgggtatctagaaaatgcgcaggggtcccattctccgataagaggagctcactgtgcctaaaatgctttcacaaacactatggttcttgccaaagatatttttctatctgggatactggaatttaggtatgggctaggaagaggacaccaaataaccagttcccgttaaaaactgtgggcacttagtccctagtgagcctccctggtggacaatgtttcatacatgttgtcgcaactcgttggagaaattttctgtgcctgtgtgatttgtttggacaggattcttagaagcttgtgcctagtttcctctggattttgccccatgcaccttttttcttgtttattttgctaggtgtgctttcaccataagaaatcacagccaggtgtatgactatatactgagtccagtggtttatcctagagaatcactgaacctgcagtgctctagggcctctccaacacaggctgattgatacactagagaaaaaaagcaactaatagataccatccatgaggaagtccatgaggaagtccaggcattggatttactagacaaagattatattagctgttttaaatgtattcaaagaattaaataaaactatatataaagaattaaaatatagtatgacgattgtgtttcatcaaatagaaaatagtaataaagttataaatcataaaagagaactaaatagaatttctggaattgaaaactaaaactacaactaaaaatttattggaggggtttgtatttgtttcctagggttgccaaaacaaatcatctcagtggcttaaaacagcataaagttatttgcttacattgctggaggatagaagtccaaagttaaagtgtcagttgggctgtgctctatttgaaggctctagggaattatctttctttgcttctttctagcttcaggtggttgctggaaatccttggctttccttggcttgcagctgcaccactccaatctctgcctgtgtcatcacatgaccttctttcctctgtgcctgtgttcaaatttccctgctcttataagagaaacagtaactggattagggcccaccctaatacaagatgacctcatcttaattgattacatctgcaaataccgtatttccaaataaagccacatttatagggactaagtaagagagccttgaacatatcattttggagaacatgattcaacccacaacagggctgaacagcagatttcagcagacaaaaaattcagtgaatttgtagattggtcaactgagattatctagcctgatgaatagtaagttaaaaaaaaacaaaaggaaagagcctcagagaactatggaaccctatcaagcaataccaatgtatgcataaagagagtcccagaaggagatgagtgagagaaaggagatacaagaatatgtgaagttataatagccaaaaacttctccaattttatgaaaaacactaatcaaaatatgcaagaagttcaataaactccaagtagcataaacgcacatcttaataaattaatcaaaagccaaaggcaaagaaaaatcatgagagcgataagcaagaaataaatcatcatgtataaaggatcattggtaagattaacaactacaaactttcagtttaagttctaagcatctaatgtatagcatggtgactgtagttaattatactgtattgtatacttgaaatttgctaagagagcagatcttaagaattctcttttcaaaaaagtaaccataatgtgatgaatgtcttaatggacttgattgtggtaatcatttcacaatgcatatgtgtatcaaatcaacaaactgtatatttaaaatataaacaatgctgtttgttagttataccacaataaagctgaaaggaagaatccatggaggccaaaaggcagtgggatgacatattcaaagttctgaaaggaaaaataaatgtcagccaagaattttatatctagcagtggtgtccttcaaaaaatggagacattaaagcattcccagatagacaacatttgagagaattcattgctgtcagactagccccatcagaacactaaacagagtccttccagctgaaatgaagacaagagagtaattcaaatccacatgaagaaataaagagcacaggtaaagttatgtaagtaaaaatgagacagtatgtctaaataaataaaatgtatggggtggacacggtggctcatgcctgtaatcccagcactttgggaggccaaggtgggtggattgcttgagctcaggggttcgtaaccagccttggcaacatggttttaccatgttgagaggctgaggtggaaggatggcttgagcctgggaggcagaggttgcagtgaaccgagatcgcaacactgcactccatcctgggcaacatagtgagactctgtctcaataaataaataaataaaatgtatgtagtaaacatgtataaataatgtatttttcctgtatctgttctgaaggacaactatgtaaagcaaatataaatctatgttcttgagcacacaatgaataaagacgtgttttgtatgacaataccaacatacagaatggggcatggaacatgtataggagaaaaaagtttatatgctattgaaattaattaatcatacttaaatgttataagttaagatgttaattgtagtctccagggcaactactaaaactactaaaaaaattccaaaaatatatatgacaaaagaaatggcatagggattaaatcagcacaataggaaatacctaacacaaaataagatggtaatggaggaatatcaaaagcaaaagacatcccacatatagaaaaatagcaaaatagaatatttcaatcatgttagtattttactaaatccccattggtaattaaatcaaatggagtttcattatacacttcagttaactggcagagagtggtagaacagataaaaaatgtgatctacctatatgctgtctacaacagtcaaactttaaattcaagacacaaagatgatcaaagtaatagaataggaagaaatgcagcaagcaagtattaaccaaaagagagccagaatggccttattaatattagatcaaatagacttaggacaaaattattcctagagatgaagaagaacattttataaggatcaaacggtccattatttgagggtataataattacaaaattgttataaaattataaatgtataaattataaaattgcatttggcacttaacaacagagcttcaaaatacatgaaggaaaactgacagaatagaaagttgaagtagacacttcaacaataatatttggaggaacagaaagaaaaaagattgccctctccctctccctctccctctctttccacggcctccctctccctctctttccacggtctccccctgatgccgagccaaagctggactgtactgccgccatctcggctcactgaaacctccctgcctgattctcctgcctcagcctgccgagtgcctgcgattgcaggcgcgcgctgccacgactgactggttttcgtatttttttggtggagacggggtttcgctgtgttggccgggctggtctccagctcctaaccgcgagtgatccgccagcctcggcctcccgaggtgccgggatttgcagacggagtctggttcactcagtgctcaatggtgcccaggctggagtgcagtggcgtgatctcggctggctacaacctccacctcccagccgcctgccttggcctcccaaagtgccgagattgcagcctctgcccggccgccaccccgtctggaaagtgaggagcgtctctgcccggccgccatcccatctaggaagtgaggagcgcctcttcccggccgccatcccatctaggaagtgaggagcgtctctgcccgggcgcccatcgtctgagatgtggggagcgcctctgccccgccgccccgtctgggatgtgaggagcgtctctgcccggccgcccatcgtctgagatgtggggagcgcctctgccccgccgccccatctgggatgtgaggagcgcctctacccggccgcgaccccatccgggaggtgaggagcgtctctgcccggccgccccgtctgagaagtgaggagaccctccgcctggcaaccgcccgcctgagaagtgaggagcccctccgcccagcagccaccccgtctgagaagtgaggagcccctccgcctggcagccaccccgtctgggaagtgagaagggtctccgcccagcagccaccccatccgggagggaggtgggggggtcagccccccacccggccagccaccccgtctgggaggtgaggggcgcctctgcccggccgcccctactgggaagtgaggagcccctctgcccggccagccaccccatccgggagggaggtggggggtcagccccccgcccagccagccacccagtccgggagggaggtggggggggtcagccccccgcctggccagccaccccatccgggaggtgaggggcgcctctgcccggccgcccctactgggaagtgaggagcccctctgcccagccagccgccccgtccgggaaggaggtgggggggggtcagccccccgcccggccagccgccccgtccgggagggaagtgggggggtcagccccccgcccggccagccgccccgtccgggaggtgaggggcacctctgcccggccgcccctactgggaagtgaggagcccctctgcccggccagccaccccatccgtgagggaggtggggggtcagccccccacccggccagccaccccgtccgggagggaggtggggggtcagccccccgcccggccagccaccccatccgggaggtgaggggcgcctctgcccggccgcccctactgggaagtgaggagcccctctgcccagccagccgccccgtccgggaaggaggtgggggggtcagccccccgcccggccagccgccccgtctgggagggaggtgggggggtcagccccccgcccggccagccgccccgtctgggagggaggtggggggggtcagcctcccgcccggccagccgccccgtccgggaggtgaggggcacctctgcccggccgcccctactgggaagtgaggagcccctctgcccggccaccaccccgtctgggaggtgtacccaacaactcattgagaacgggccatgatgacaatggcagttttgtggaatagaaagcggggaaaggtggggagaggattgagaaattggatggttgctgtgtctgtgtagaaaggggtagacatgggagacttttcgttttgctctgtactaagaaaaattcttatcctgttgatctgtgacctttcccccaaccctgtgctctctgaaacatgtgctgtgtccactcagggttaaatggattaagggcggggcaagatgtgctttgttaaacagatgcttgaaggcagcatgctcgttgagagtcatcaccactccctaatctcaagtacccagggacacaaacactgcggaaggccgcagggccctctgcctaggaaaaccagagacctttgttcacttgtttatctgctgaccttccctccactattgtcctatgaccctgccaaatccccctctgcgagaaacacccaagaatgatcaataaaaataaataaataaataaataaataaataaatttaaaaaaagaaaaaagattgaagaataatgaaaaaataataatatttggagaattcaatacctaactttaaatagtagataaaaaattaggcagaaaagttcaacaaggaagtagaagacttgaacaatactagctaaggaacctaatgggcatctatagattgctccatctggcaatagcaagacacacatttttctcaagcacacatcaaacactccccaaaatagaccatatgataggcaagaaaacaaatctcaataaatttaaagtgattaaaatcatacaagttatgcttttgggccacagtgtaataaaatcaataataggcagaaatttaggaaattcacaaatataggttaatcaaacaataccacttctatatagcttatgggtcaaaggcaccataataggaattcataaaatactttagatggatggatacaataacgcaaaatatcaaaacttaaggaatacgacaaaagctgtgcattgagagaaatttatatcctatattaaatgtctatattaaatgcatttaatataggaaatgcctatattagaaaacttgaaataactcaaatcggtaacttaatcttccacctaagaaactgaaaaaagaagcacaagctaaaccaaagaaagcagaacgaaggaataaatagagattataatgaaaataaataaaatggagaaaataaacataatagagaaaatcaatgaccaaaatttctttgaaaatatcaaaaaaattaacaaacttttagctagactgacctagaaaaaaagaagactcaaattaataccaaccctacgaaaacataaaaagattataataccatgaacaattgtatggcaacaaatgatataacctagatgaaatgaagaaatatctagaaaggaacaaaccttggccgggcacggtggctcacgcctgtaatcccagcactttgggaggccgcagtgggtggatcatgaggtcaggagatcgagaccatcctggctaatatggtgaaaccccgtctctactaaaaatacaaaaaattagccaggcatgatggcaggcgcctgtagtcccagctactcgggaggctaaggcaggagaatggcatgaacccggtaggcgcagcttgcagtgagccaagatcacgccactgcactccagcctgggcgacagagcaagactccgtctcaaaaaaaaaaaaaaaaaaaaaaaaggaacaaaccaacaaaactggaaaaaaaaaaaaaaggaaatctgaatatacctatagcaaggtatagattgagttattaatttttttttaaaaaaagtcaaaatccccataaagaaaagctcagggcacgattgattcactggtgaattctaccaaaagtttataacagaattaaatctttcacaaacttctaaaacatgtaagaggaggggtcatttcccaacaacccattctataaggttaataccttgatatcaaaaccagacaaagacattgcaagaacagaaaacaacagaccaatatctttaatgaatacagatgcaaaaaatcctcaacaaaatacttgcaaaccgaatgcaacaacaacaacaaaaaagatgatacacgggccgggcagggtggctcacgcctgtaatcccagcacttcgggaggccaaggcaggcatatcgcttgagcccaggagtttaagaccagcccgggtaacatggtggaacctcatctctacaaaaaatacaaaaaaaaattagctgggcgtagtggcatactactgtagtcccagctacttgggaggctgaggtgggaaggtcacctgaatctggggaggtcaaggctgcagtgagctatggagagccactgcactccagcctgggcgacagagtgagaccctgtctcaaaaaaaaaaaaaaaaagaaaagaaaagaaaaagaaaaaagagagaatgatgcatgatgaccaaatgggattaattttaggaacgcaaggttggttccaaaaatttgtatcaatcaatgttaatataccatattaataaaacaaggttaaaaatgcataatcatctcttgtgcgcctgtgtcttgatcatggagcagcctccccaggtctcctctgcaaatgggctccgtggcccagtgcccctgaccccaccacctgtgatcgtgtgccaaggccagagaggggtcgccgcccaggccgcctgggttccacttccagcagcagctcctgtggcaataccaagtgccctggggaagccatcccccacccaccggctttccccaaggctgacccaggtcactggtgggccagcttatttttcgggaagtccaccctcctgttcatggccacggtgttggagttggtagagcacccggaaccccccaggcctgcagcagcatgaccacctggggcctggctcgggaaaccccgaggaagcagcccggtggccggtccagcacagccccatcctggacccctgtcctgacctgagtggccaccaccagccccaggcctatggagggactaggccaccagaggccctgtctgtctccctcccagctcctcaccctgtaggactaggcagctgcagcaagttgactttcacatcaacacagcagacactgaaaaggagtgagaaagccctgctccctactgccccagtacttgtgagctctcttgatacctgaaaatgtgcacctggcaccaagtggaaaataaactccaagcaaccagaaaaacaaacaaaaaaagcataatcatctcaatagactaaaaaatgatttggcaaaatgcaacgccctatcataataaaaatagttgaaaaactaggaatagaagctaacttcctcaaccttataaagggcacctatgaaaaacccaccactactttatacttaatggtaaaagactgaaaaatttcccccgatattaaaagaagataaggatgtccactctcaccctacccctcgccccccgcctttttttttttttttctaagacagagtcttgctcttgtcgcccaggctggagtgcaatggcatgatctcggctcactgcaacctccgcctcccgagttcaagcgattctcctgcctcagcctcctgagtagctgggattataggcacgcgccaccacacctggctaattttgtatttttagcagagatggggtttctccatgttggtcagacaggtctcgaactcctaacctcgggtgatctgcctgcctcggcctcccaaagtgctgagattacaggcgtgaaccaccgcgcctggccaactctcatcacttttgacccaacactgtaatggaaattccagctacaactactaggcaagaaaaagaaataaaaagcatacaaataggcagggaagaaataaaactgtcccaatttgcagatgacatgacactgtatagaaaaccataagaaataaatgaaaaactatttggactaataagcaagttcagcaatattacaggatacaaaatcaacaggtaataatttttctcaccacaaaaatgataagtaattgaggttgtgtatatatcaattagcttgatttaattatcccacattatatttgtaaatcacaatatcactttgcacctcataaatatatacaattataaattgtcaacttacaatgaaataaaaaaaatttcttgggcaagaattactgtgtcaaaggatatggtgcattttaaggatcttgataactagccaacttgctttccagaaagtttatatgagtttattcttccacttgtccataagagaagatttcgaggttctttgaacataatcctatattgagaaataataaacctttgacaaggcttggaggcttgataaaccaatcaattgtatttctatgaacttgcaataaacaatctgaacttgaaattaagaaaaaattccttttgcaatagcatcagaaataaatacttagaggccaggcactgtggttcatgcctgtaatcccagtactttgggaggttgaggtgggcggaaaatttgaggtcaggagtttgagaccagcctggccaacatggtaaaactctgtctctactaaaaacacaaacattagccaggagtggtggcacatgcctgaagtcccagctacttgggaggctgaggtaagagaatctcttgaaccggggaggcagaagttgcagtgagctgagatcatgacaaggcactccagcctgggcaacagagcaagactccatctcaaataaataaataaacaaacaaataaatacatagaaatgaattcatcaaaagaagtacaaaacttgtacattgagaactatgaaacatcatttaaataaattttaaaagatctaataaatgaaaagacatatgttcacagactggagtacttatacttaagatgttatattcccctaattcattgacagattcagcaaattcctgtaaggattccagctgccttgaaactgacaaggtgatcccaaaactcataaaggaatagaaaccaatgtagagaaaataatcttaaaaaagaacaaggactcagacttcccaacttaaaaacttaatataaaggtagtataatcaatctgtgcagaactggtgaaaagatggatgtatacatccatgaaatagaattgagagtctggaagtaaaccctcacatttactgtcaatttttaaaaagtgtggcaaggccaaagacagaatattcttttcaacaaatggtgccaggacaatgagcatccacatgcaaagaatgaggttggacagctaactcacaccatacacgaaagttaatttatgcctgtaatcccaacactttgggaggcgaaggcgggtagatcacctgagttcaggagttttgagattaacctgaccaacatggtgaaactccaactccactgaaaatacaaaaattagccaggcatggtggcacatgcctgtaatcccagctactcgggaggctgaggcaggagaatcgcttgaacccgggatgcggaggttgggatgaaccaagatcacgccattgcactccagcctgggagacacggcgaaactctgtctcaaaataataataataataataataataataattaaaaatggattaaaggcttaagactttgataaaacataaaacaaaaaacattaaagagctaaactatatgaatctcagaaaaaaagggcatagatcttcattttctaacatttggcaatgaattcttacatgtgtcaccgcaagtacaagcaaccagaggtaaaataaataggacttcaccaaacttaaaatcttttgtgtttcaaagaacaccatcatgaaagggatacaaaaacacagagttgaataaattatctgcaattcatgtatctgataaggtctattatccagaagagataaagaacactagcaaatcaaaaataaaatgtctaacaaattttcaaaattaaaataggatttgcatagatactgccctaaagaagatacacaaattggcaataaataaatgaaaacatgtttaaaatcattagttaatagggaaatgccaatcaaaacccctgaaatatcacttcacatccactagcatggctataatttaaaaagcaaacacaagtgttagcaatgattacagaaattgggaccttcccacattgcctgtgcaaatataaaaaggaaaaaagactttggtgattcctcagacagttactcacagagctacgaatatggcctagcagttccaatgctagatatatatccaggagaaataaaaatcatatgttcaccaggcgcggtggctcacacctgtaatcccagcactttgggaggccgaggcgggcgcatcacctgaggtcaggagttcgagaccagcctcaacatggagaaactccgtctctactaaaaatacaaaattagctgggtgtggtggtgcatgcctgtaatcccagctacccaggaggctgaggcaggagaattgcttgaacctgggaggtggaggttgtggtgagccgagatcgcatcattgcactccagcctgggcaacaagagtgaaactccatctcaaaaaaaaaaaaaaatcatacgtttatacaacaactcgaagatgggtgttcatagcagcactattgatagtagccaaaaaatgaaaataacgcatctgtccatcactgataaatggaaaaacgaaacgagttatgctcacacaatggatggtattccaccataaacaggtaaggtccaggtatggccacaacacaggtgaacgtgaatactttctgcctactgaagaagccaggacatagaagacagcccattgtatgattctatgtatatgaaatacacagaatacaaaaattcgcagacagaaagcagattagaggctggcagggcagggtgtgtggagagaatggggttggctgacatgggcaaggggtttctctttggagtggtgaagtactagaattaggtagtggggacgatggcaaaaccagaatatactaaaaaccactgaattgtatccttcaaaaaggtgcatttatggaatgtgaattatatttcattatatatcaatacaaaagaatatgacaacaatttattttgtttctaaatatgatgcactaaactgcaacaattgctagtgaataaattcaatgattaaattcccgcaggcacttcagtggagggggtggtacaggatgatatttgaggcttaacctcgttctttagccagatccggttttgatgctgctgaacagctgtggggccagggggtacattttcttccccaagaatccatccccatgtacatcctttattggaatccattatcttcttatcactaactgtccagtggggcatttgaatgaaagtggagttaggaagagggatcctgcagtgtggtgtgcctaaaataccccacagagggattgtgtgggaacagtggctttctttagataacagtgtagaaagtcagcacaacacagtgaccagagcatgggtgctggtgcctgatggcttgagatcaaagccacgtgtgcctgggactgtcactcagtccctttgtcctcagctctctgttctggggtgagaacatgttactagggcttgcgtagtactaccatgttataagggctaaaggtaaacacagacacagcctagagaaaaatgacgggtacttcataagcactgcctacctaagtgttcaatgattacacatctggaaaaataaaaaagacaagcagcattggtgacccccagagaggcaacatggagggtgacagacgggggaaggacagggccctactattccacatgggcatgtgcacgacactttacacctcctggatgggcagagcaggggctgtaacatttactttatggttcagggcactgaaattgacagagattcagtgacgtgctcagaatagcaacactgatgaataatgaagctcaggcagggaatttagttggctcccaagggatggagatccctgaacacctgagactgaggcaggagatcaacaggactcactttctgagcaactatcacagccctgctgatgaaaacaagatgtagcaaagaaaccagcccaaaccagctaggactaggaattctattgtatactcttgagtcacccccaccagggccatgacagtttacaaatgccatggcaatgacccggaagttaccatatggttccgggactcctggttcttttccagaaaatcgtgaatagcccaccccttaattggcatataattaagagtaggtataaataaagctagccatcatgccactggtgctacacgcctctgggacagccctgctctgtctgtggaacagccattttggcagacactgttgttcacacaaacttgccggctttcaccattggctggctcttgtttcctgagcaaatccaaggaccgtcatggcctaaggtccaattttggagttcgcctgcatcaagaccattagatcatgccctggacgctgaaccgaggaacctccttactcctttcccaaatcctcccacccccacggctgctgcagggagacactgttgcctggaggaggtgcttggcccaagagaagggcccaaaccctgactcaactcccagctttacatttcaacccctgacccaagatgtgatgactttcccccaaatgaagccctgctgaatgcgtggggtccaaatttgtgtctgtctcccaccacacttgactctgtggttgccttgtgaagagacttccctgtggtctggtgactgccctgaatgaccagtagcctccttgactcccaactgactcggaatgcaggaggtcccccaccaactgcccacgtgaccgttggactttgaatcagattcaccttcaactgaccaaaccgggctgctgggcagtgcagattctttcaatgaaaaagcggcctgctgggctggggcttgggcagcgtagggagtgaagccggcaagctgccagggtctcagtgcctcctcttgatcacagcagctgccccagcagtctggactcaggcctggctgagaagaggcagtggctgccccagctctgagtgggcgcctccctgctcctgtccttcctcaccaagactcaggccctgctgtacaaaccacagcaatgattccaatctcctgatagcttcaggtccaggacgccttcagtggaggagctggcaggtggtgatgtctgaggctcctcctgcctttgcccagatgccgacgggatgcttctgggaatggccaggaggttttcttcagcccagatcacttttctggcatagtctggatttgaatcttccatgatctgttcttgttgtatctctgagccatgagctttggaaaaatgcattgaaaatagagccccctgttgatacggtgcaggcaggagacggtgggcaggtgttcacctttcccaagtcacacttgtctccaacagctgcctcggggagcaaccgagtcaaagctggcttagcgggaggcgtcctgaggtgctgtgagcacttcacataacacccggatgattgcgtggggacgttactctaatgagacaattcaggagggcagctgagctcagtgacttagagcaagtggcaggtgcctgatgtcctgggctcagatcctacctagaagcagacccaaacgaagccaacagaaaaatgactgacacttcataagtgctagaaaactgctcaaatacataatgtctgagggaatgaaggagatctgtagtagtggttgcctcagagtggctacaagtcacgagtcactttccagcctttccatgggcaggaacttctagctcctgaagaggatctgttgtcatccctcatgaccctcacaggagccccgtgaagtgggcggagcagggctgtgacccacattttacagttgaggacactaaaattgacagggcctaagtgacatacccagagtcacaacactaaggagggacgaggctgagccgggaacgtagttggtttcctggagacggagatccctgaagcccagtttcctctagatcatgccctgggtgcctgacccagggcttccctcaccccatttcccaaatcctcttgttccaggattactttggagagaggtgatgtcctgcaggaggtggctgacacagcctcctgcatctatgttgtaatccttgacccaaaatatgatgcagctgaccccaaatgaagaccctttgaaggatcagggtgtccaatctgcgccactcctgccccagcaccttcacaccatgagccacctcaaggtgaggcttctggatgtgccagcgaccaccctgaatgactagtgtccttcttgactccccactggctcagagctcaggactcccatgccagccacacccataggacagagcctcccaaagaattcgcttcactgtaactgacaaactcttacgagcagggaaggcgagttaactggggaggaggcctgctggactggtgctctgctatctcaatcagtgaagcccgtcagccccctgcttccctttccctttatggactaaagatctgagcagctgtctgagcatccccgactcaggcctggctgggaagaggcagtgaatgctccagcacatcatgggcacctccttgctcacattcttcctcaccaagacgcaggaggtgctgccaaacatcaccaaagactttggagttttactgacgcaaaggcaggaaagacacggttttccgggaaagatcatttttaaaaaatcacagcaagaaaagatgatgacaaacactgcacactcaaagcccagaggcaccaaacctctccctattgagtcagtaaggatgacaaggacaaagcagccttccatacacgtttcctttcactttctaatttcatcccccacttcctcagtctctaaggcagcaggccaaccccaactgctacaggcaccctccttcattgggtccctcctgggttgttttaaacctggagtgtcttcttcatcactgcttgaatcatgtcttctgttgacaatggagtctctagagacaaaagtgggaagacaattattccagaggaaggttcatccatccctcctcctccagctgaggtcaagctggatcacacaagaccaccctgctctctctcttggtctgttcaaccctcctttaactctgtggagtccagagtctctaacaagacacagctcacgggtgcaaaccctcaggagagagcacccccatcatcttcccacttccgcatttccgctggatcgttagagctcgttcctccagtcccattcacctgaaattccaactttgatgcacaggtttcttagttagatgagttccatgaacagaccccatgccaggctcagagcaggttcccaagagtgtgttctgtgtggatggaaatgttctctgtgctgttgcataaggtggccgctggcacaaactctgtggggcactggaaatgtggccagtgtgaatgaagattggaatttctcattttattgtgattaactgcactaatgaatgaatgagttatacacagcacctccaggctgggattcccacgctagatgctgcagctctagagatacaaacatgaaaaggacatgactccctccctgggtgtttccttgcagtggggttgggtgctctgatcccatcattcatgtgtggcttctgagggcctctgcaaggaaacaggattttttttagcacctgcacaagggccaggcactgtgtgagatatggggatacaaccatgaggacagtgccttggcctagagggaagccgtggggagggggttacacttgcacacagagaagtgaaaccaaccttgtctaaacagcatcagagcagagagaccccaggaaaatggacatcccagggtctgcaggagcccaccctcaccaccctctgacttgggtcagatcctgggaagacgcctcgttcagtgagaaggtccaacaggctgaacagtgtgaggagggaacctttgcccactcgagctagagcccagcccaggggtgttttcatgagaccttcatgtggcctaagacaggctgcccagggctgagcgctgtgatgagaggaaatgcggagggcacattcctgcccctgcactgaacagctgcagccgcattgcggatccccatgagtgcgaggactcaagagtttgggcctgagaactctaagaccatttcagagaaaatctcaaacccacgtcctctgggctgtgaaacagaggatcaaggatgatctgggctctgggatcagcctccatcactttgctgagcttgccctgaacgggagccggtgccctcgctccttccagggagctacagtgtgagcagctgccctggccaggtggggccacactgccttcagtttcaatgcacttctgggccaggcaatctttggctagtgctgtctacagagggcgcttgacaggcaacttccggaagcacgtggaagatggaaactggtttctgtccagccccagaaaggtcagtctgggaacttctgtgtgtctggcctgaccttgacaaccatccctgctgaactatgagccccaggaaggtcagtctgggaacttctgtgtgtctggcctgaccttgacaccatccctgctgaactatgtcccccagtctggctcagaggaccggaaacctgattcctactctctgcctctcgccagcttccaggatggaaaggcctgctttgtcacacagcatgatgaagacgcccgtccccagctcctgtcacagcttcaacaggaaggaactaccctctcttaagaaatgtcagcgatgtccatgcagggtcactccagccaggaccgtcccccctgctctttcccacttagaaggagcaggaaaatcataggactcaggggatgatgatgtcatgagtctcctgacattaaaaccctggaatctatcctccccaaccccaactcaccgggcccggggacccttgtgacttccttctatccctctatatcttctccctctgcaggcccagcctggggccggagccctgccttctcccacagagtccactgagcggccatctctggattcctggagtccttgatcttgtcgtcactgcttttagcattgaggtcctcaccttgggttttttctcaagcaccactgggaaactgtgttctagagagtaagaaatgtctaggacagccttgttatgagaagcatgtttctgtaggcaaaagtgacccttttcaaatggagcagtctcatctttttgctttgtggggataaatatcaagaggtcaattgcaggctaatggatttctatgatgatacaaagcatttcacgtggtgttcatgatccaaatggttcctcaagccatagtatgcctcattttacacctacttttgcttaagcaagaatcctgttttcttgcaaaggccctcagaagccagcagacacctatttcacccaggaggttcggcagggaatcgggtggggatttctttgtcattacactgacttgatctttccccaccctgcaatgcacaacctaacatgtcctcctcctaggaacagagccatgtgcctgccctgatgctcagccattgatgaagcccctttgtcattttacatagtgcatgtggcccaaccacacagaagccgtggctggcagaggtgatgatgggaggcagattttccacattcttggcaacattatctgtagtgaaactttagacttcagttgagaaggtcgctgagtgcatggaagatccttctttccctgatttctaccagaactggctgggcagtggctgcagggttactgggaaatttcaaacttggggtggagccacaggactccagtgcagggggctgctggtgtccctggtccaggccttgctgacactggggggcgttggaagggcctgggcagatgggaagaagctcccactggagccaacaagagaccttgcaaggaaaagctgggaagggggagtggcgaccatggggtgacctcaaagacagatgctggcagtgaatgaatattgctgaggaggataaggccgtctgaaaaagctgcctactccatgattccaagcctatacaattctgggagagaaaactctagacacagtgaaaaggattcttgttgccagggcttctggcaaaggggagagggatgcacaggggaaacacaggaagtgtttaaggcatgcagctacttcgtatgggtggtgaatggcattcggagtttgtcacaacccatagagggcacaacacggtgaacctccatgcaaactcctgacttcagatcgtaaaaatgtatccatattggtttagtcattgttacacacatggaccacaccactgaaaatggggttaagaaaagaaaagggtggacaaaggatctgagacctttctgttctgtctgttccattttcatgttaatttcaaactgttctacacaatgactattttagtcaaggttggcaacactcttttgagtggatgtttaacactcaggtgaatgtgtcaacataagattgagacgttgctttccagtaaaagggtaccatcctttaaattgtaaatacatctttacttctacagttgcagaaacagcaatgacttcattttagatgtgtgtagatgaactgcaagaagactaaggcgtaacagtgtgagagttctgacttcagtacgggacacagaaccccctagaatcttgatgattgaatgaacttcactgactttccacagcaccttcaatggatggttttctgggatgaactcaattgtctgcccagttgtgggtttttctgacccactgcgtggggccagcaatagacggtgctgactccttggtaaccactgtcagatcctggaggcaacagcctcccaaatgtatgacgataaagacagctgttgacatcttgttgacaggatttatgagaaattcatacaaattgattcacacttcaaccttttgattctcttgggatcttgagagatgtggctgagcccagagaagagctcatctcagatgatgtttaacactcacctgaatatgtaacattagattgagatgttgctttctatgaaaagtgtcgcaactttacatagtatgtttcttttctagttgtaagactagtgattgacttaacaatttagatttttcacagatgaactcaaagaagaccacagcataacagtgttaagagttttgtcttaaatatgggacactgaacccaccaggaaccaggatgattgaatgagcttaactgattttccacagtaccttcaactgatggtttttcccgctgcacagaatggtgtggccagctgtggatttttctgacccacggcctggggccagccataaagtgtgccgactcctcaggaacactctcctaccctggagtcaacgttctcccaagttattacaaggaagacatcttgctgggagaatatcatagagaaacttacagcaattgattcccagttcaaacttttgacccttttcaccatctgcataagaatccacctgaatccgagtagggctctgggaagcccctgcagtgtgtgttgcacttagtactcagcagactgtgtaggcaaatacctgccttcagaggagatgatatagagaggcagcaagtactgtgtccggaattggtgggttcttggtctcactgacttcaaaaatgaagccgcggactctcgtggccagtgttacagttcttaaaggccccctgtctggagtttgttacttctgatgctcggatgtgtttgcagtttcttccttccggtgggtttgtggtctcgctggttccagagtgaagctgcagacttttacagtgagtgttacagctcataaaagcagcgtggacccaaagaatgagcagtagcaagatttattgcaaacagcaaaagaataaagcttccacactatgaaaacgggtcggagcgggttgccactactacctctggcagcctgcttttattcttatctggccccacccacatcctgctgattggtccattttacagagagccaattggtccattttacagagagctgattggtccgttttgacagggtgctgattggtgcatttacaatccctgagctagacacaaaagttctccaagtccccaccagagtagctagatacagagtgtccattggtgcattcacaaaccctgagctagacacagggtgctgattggtgtgtttacaaaccttgagctctatatagagtgccgattggtgtatttacaatcccttagctagacataaaggttctccaagtccccatcagactcaggagcccagctggcttcagccagtggattccgcacgagggccgcaggtggagctgcctgccagtcccgcaaggtgcgcccgtgctcctcagcccttgggcagtcgatgggactgggcgccgtggggcagggggcagcacttgtcggggagactcaggcagtgcaggagcccacgggggcggggtggaggttggggagactcaggctcaggcatggggggctgcaggtcccgagccctgccccacggggatgcagctaaggcccggcgagaagtctagcacagcagctgctggcccaggtgctaagcccctcactgcccggggcggcggtgccggccggccgctccgagtgcagggcctgccgagcccacgcccacctggaactcgcactggcccgcaagcgctgcgcgcagccctggttcctgctcgcgcctctccctccacacctctccacaagccgagggagccggctccagtcttggccagaccagaaaggggctcccacagtgcagcggcgggctgaagggctcctcaagtgccgccaaagtgggagcccaggcagaggaggcgctgagagcgagcgagggctgctagcacgctgtcacctctcactggggggccaggcagtcctgctcttatcccaagtcagtttcccacaggagggatctgcccaacctagtgctggctttttcaagtgcttcctttgcatattctaaatcaactcaaaatggattagagacttcaatgtaagacctgaaatcataaaactacgagaagaaaacacaggggaaaagcttcctgacgttgcaaaccgtacatctcataaggaggcaatatcaagaatatatacggaactcatggaacacagtagcaaaaaacaaatcacctgattgaaaatgggcaaagaacctgaacagatatttatcaaaagaagacatataaatgcccaacgggtgtatgaaaaagtgctcaacagcactaatcatcagggaaatgcaaatcaaaacctcaatgagacatcacctcacacctgttagaatggctattatccaaaagaggaaagataacaactgttattgaggatgtgggggaaagggatcactgtacactgttagtaaaaatgtaaacttgtacagccattatggaaaataacatccatccacagatgaatgggtgagggaaacgtgtctatgcaatggaatattattcagctccaaaaaagaaggaaatcctgccatttccaacagcctggatgaacctgctatgctaagtgagataagtaagcacagaaagactaatactgcatgatctcagcctggtacagtggctcacgcctgtaatcccaacacttcaggaggctgaggcaggtggatcacctgaggtcaggagtttgagaccagcatggccaacatggtgaaactccatctctattaaagatacaaaaatagattgtggtggtgcacgcctgtagtcccagctactcgggaggctgaggcagaatcgcttgaacccaggaggcagaggtcgcagtgagccaagatggcaccactgcactccagcctgggcgacagagcgagactccacatcaagaaaaataaataaataaataaataaatactgcatgatctcacttatatgtggaatctaaactaaccaaactcatagaagcagagagtagagtagaatagtcgttgccagggactgagggttggagaaaacggggtgttgtttaatgggtataaagtgtcagttatgcaagatgagtaagttctggagatgtaacgtacagcgtgtaacaacactctgttgtatacctgaaatttcttaagagagtagatcttaagatccttaaccaccccacctccaaaaaagaaagaaagtggtaacaatgtaagatggtgggtgttttagtttgcggtgatcatttcacaatgtgtattaaatatccggttgcccactttaaatatatacaatgtttacttttcaagcatattcagataaagctgggggaaaacaaacagctttctggggccattgtttgcagacccctgagttagggcattctgtgatggctgggtcaatttcacttcagcatggtaagaggcacgtgacaaaaactggcatgaaaggggctgttggaaccaaggggcaggaaagggctgccctataggatccgccagaagacagaccggcattccacgaagtgagcaaattccggaggaaataaaggatttccgttttaaggggttgggaggcaagagaaaaggctgagagggtgtgtgtgtctgaaatggggtctctgggtgagaaaacgtgtgagataaagtgcgaggctggaaaaacgcgcacgtgtgcaggaggcggggatctgctgcaccgagtgtgcacatttgcacgaaccgtgggggcgtctgcggctgtgggtggagaggaaatcctggatcacacatctgagagagggggtgtgggtgggagtgggagagtatgtaagagcgtgggtcgtgacaggtgagggacttgtgtgtgcaactgtgcgtcctgcgagagtgaggaggtctcggactgaggaactgcgttcagtgctcagtggtgagttcccacgcaagagcctggggagtcaaccagaaagacccgaacgcggggcgggcccagcgacctcgggcgccatctgctgattaccagacgccactacctgagaaaggcccctccagtcccctcattgcccagctgcggaccctaagcggagccataaccgtcctaccaacccacgtcagcagaagagcccagtgggagggcgtgtgttcacttctgctcctctgggcaaagacgcccaggtcagaaacacccacccgaccctcccactacccagagacagccccacctgcacagctcagagcaggaccactgaccctctggctctccggtcatatttgctattgaagaccagaataaagtatttttatcaggattgaatacatgactcatgaatgaataaattcattctccttacatatcggttcctattgagaaatatggtggctagaatttatttcctccggaaagaggaataaatgtggagcccctgggtttggtgctatttattacccatttctctgatgttgtaagaaaagagagattcagaagaaatatcacatttcagccccgaacttacgtagcttgctgccgttctaggtgatttacttagattggcttctgcattttgacaaatgaggaaattgggagaattaaagcctctggttttaaagcctgctgctgggtcaagtagaactgtgacttttattttttttttttagacagagtcttgctctgttgcccaggctggagtgcagtggcacaatctcagctcactgcaacctccacctcccgggctccctcagcgattctcttgcctcagcctcccaagcagctggaactacagatgcccgccaccacgcacggctaatttttgcatttttagtagaggtggagtttcaccgtgttggccaggctggtctcaaactcctgacctcaaatgacccacccacctcagccttccgaagtgctgggattacaggtgtgagccaccgtgcccggcccagaactatgacattttgtttttgtttttctctgtttctttgaaaagaaatggagtgaaggtgcagagatatgagataaattatttaaacacattattattattgttgttgttattattattattattattattattattattattattattattgagtcggaatttcactcttgttgcccaggctggagtgcaatggcatgatctcagctcactgcaacctccacctcatgggttcaagttattctcttgcctcagcctcccaagtagctgggattacaggcatgcgccaccacgtcggggtattttttttttttttttttttttagtagagatgggtttctccatgttggtcaggctggtctcgaactcctgacctcagatgatccacccacctcggcctcccaaagtgctgggattacaggcgtgagccaccgcaccctgccttaaacacgttattaaatcagtaaaatgaagggcctgacaaataaatgaccactgagctaggatgtagaagaccaaggcctggaagaaggggagtctgcctcttctgtcactggtgagctacgaccttccctgtaggcacaccctacgctgtccttcaggctggctctccatgccctcgggggcctcggtccaaacatctggacaaaggccctatgaaaggacctctaacaaaatattttccaccatattcagctagagttgcatgtttttctatttttcctaatgagaacataggacttgagaactgatcatgtgtcttcgctttaatttgaaatgatcagaataatctgaaaaaaacagaactattgtccaggaaatgagagagaactgaattcaatcacttaaatatataatcaaatcccttccccagctttcccccacatgtgctggttttttcattctcactcttcaaactgatcacctattaatcatctaaaaccacaacaaaatgcttttgaaaactttttaaaaagaagtgcatctcattttatgtaagttgtgatataagaaaaatagtaagattataaaaatattttttacttttgatacagtgactagcaaaggtaaaaaaaaaaaaacataggacatcgaacggtcaattcattgtctgggaagaggttttggatttatttaccaagcttctaaacatggatcttcctaatcatagagaaaaagccctttcaaagcagttgttgtaggccgggtgcagtggctcaggcctgtaatcccaacactttgggaggctgaggtgggtggatcacctgaggtcaggagtttgagactggcatggccaacatggtgaaactccatctctattaaaaatacaaaaatagattgtggtggtgtacgcctgtagtcccaactactctggaggctgaggcgggagaatagcttgagcctgggaggtgaaggttgcagtgatcgcgccactgcactccagcttgggcgacagagcgagactccatctcaaaagaaaaaagtgtggtctagtgagggtgattttaaactgattaggtttaattcatttccttgatctaaatatgaagtgtttttactctgtgagcagaaagtttttgaaactagttcatgaaggtgagtccagtggtatttttcttttttacttctcagccttctacgaaaggcaaatataagacagcaaaatccaaagaatggagttattaaggctgcaagtggagtccgaggccagttccatgccaggcatggtgcgtgcactgagagacagggatcctctgctccaggagccgaaggcacatgctgttttgcttactactgaactctactacacatttaaagaagaaccattaccaatcctactcaaactcttccaaaaaactaaagaggagggaacacttccaaactcactttacaaggccaccattaccctgatacccaaaccagacaagaacacaacaacaaaaaaaagaaaactacaggccaatattcccgatgaacatagagccaaaatcctcaacaagatactagcaaactgaatctaacagcacatcaaaaagaccattcaccatgattgttgatggctgatgcaagacctcagttcttgtcttcttagtttaagaaaatttaaacagactcacagcaaaggagatgcaacatagagtaatttattgcaaaagaaaaagactattttgggctaggtgcagtggctcacacctgtaatcccagcactttgggaggccgaggtaggcagatcacctgaggttgggagtttgagaccagcctgaccaacatggagaaaccccatctctactaaaaatacaaaattagctgggcatggtggcactcaggaggctgaggcaggagaatcacttgaacccaggaggcagaggttgcggtgagccaagatcgtgccattgcactccagcctgggcaacaagagcgaaactacatctcaaataataataatattttgaaagtttggtgcaaaatagataatataccctgggagagagaattttgttgctcataagggcgagacagcaaaaactggcactaggaagactctctttatggaagtcttacacgattattcttaaagggttggaagaggtgttggtagtaagcatcttctgggtggtcctcttgcccatgcacagtagctgtacatgcttgttcatacattgcatgtctcattcgcatcttaaatctccacccaggggtggttttttttactattataatgagcaaagggtcagtttgaggacaggtaaaatcaaactgttcatgctctccagaggggaaagtccctactgaagatagctttgcttgaatgagctcaattacaatgcaaatactgagacttattgtgttgactgtatagtcacaacagttactgcatcctgagaacatggttacttctttgactactatcctgcttcatgatcaagtgggattcatcccaggaatgcaaggatggttcaacacatgcagatcaataaacatgatacataacctaaacagaagcaaaaacaaaaaccatatgattatttcaataaatgctggaaaataattttgtaaagtttagcatattaaaaaccctcatcaaaatggttatagaaataacatagctcaaaaaaaatgaaagccatgtatgacaaacccatagctaacattgtactgaatgaggataaatggaaggtctttcctctaagaactggaataagacaaggatgctcactttcaccactttattcaacataatactggaagtcctggacagagcaattaggcaagaacaagaaataaagggcatccaaatttgaaaggaagaagtcaaataagccttgttcacagatgacacgtcttatacctggaaaaatctaaaaactctacgaaaaaactgttagaactgataaacaaattagtaaagttgcagaatacaaaatcaacatacaaaaatcagtggcatttctaatttttttttagacagtctcactgggttgcccaggctggagtgcagtggcacgaacatggctcactgcagccttgatctcttggacctaagcgatcctctcacttcagcctcccaagtagctgggaccacaggtgcatacctggctagattttttttaaatgttgtagagataagatggggtctcaccatgttgcccaggctagtagcagttctatacaccaacaaagaacattctgaaaaagaaatcaagaaaggaagctcatttacaatagcaccaaaataaaaataaaacacacaggaataaatttaccaagaagtgaaatagctctacaaggaaaactataaaacactaatgaaaaaaattaatgaggacacaaaaaatggaaagatattacatgttcatggatggcaaggattttattgttagaattataacactacccaaagcaatttacagattcaatgcaatccctatcaaaaccaatgacattcttcacagaaaaagaaaaaatatataaaatttatgtggaaccacagaagacctcaactagccaaagcaattctgagcaaaaagaacaaagctggcggcatcacactatcagacttcaaaatatactacacagctatagtaaccaaaacagcatggtactggcataaaaacagaccacacagacaaatagtacagaataggtaatcctgatataaatccatgcatatgaatttacaacaaattttttttttttttttttttggagacggagtcttcttgctctgtcacccaggctggagtgtagtggcacgatctcagctcactgaaacctccacctcccaagttcaggcaattctcctgcctcagcctcccaagtagctgggactacaggcgtgcaccatcgtgcctggctaatttttatatttttagtagagacagagttttgccatgttggccaggctggtctcgaactcctgacctcaggtgatacacccacctcagcctcccaaagcgctgggattacaggcatgagccactgcacccggccttacaactaactcatctttgacaaaggtgccaagaacatacatggggaaaaggtcagtcttttcaataaatggtgctggagaaactggataagtatacacagaatgaaactaaactatttttgtctcttaccacacacaacaatcaaatcaaaatggaataaaggcttaaaactttttggaggcaggatcttgctctgtcactcaggctggagtacaggggcattatcctggctcattgaagccttgaccttcccgggctccagtgaccttcctgcctcagcctcccaagtggctgggactatatggacacacgccaccatgcccagctaatttttgtattttttgtagagatagggttttgccatgttgcctaggctagtctcaaactcctgaactcaagcaatcctctgctttggcctcccaaagttctgggattacagacctgtgccaccatgcccagcaagacttaaatctaagatctgaaactatgaaactactagaagaaaacattgggaaaatgttccaggacattgctctaggcaaagactttttgtgtaggacctcgaaagcacaggcaaccaaagcaaaaatagacagttggaattacatcaagctaaaaaataagggaaacaatgaagtgaagagattgatgcagggcaggtgaaccccaaaattagcccgggagggttcttggctttgcccaggaaataattcaagggcgagctggtggtgttaggcagcaacttttattgaagcagccgtgtacagcagtaacagaggtactgctccctgttgagcagggtcaccccataggcagtgtgcccagagcagcagctcaggggcagttctgcagtcctatttatacctacttttaattatatgcaaattaagaggtgaattatgcagaaatttctagaaaaagggtagtaactttcaggtcgttgagttgttgccatggaagggggcagtaacttccaaatgttgccatggcaatggtaaactaacatggtacaatggtggccaagtcttagggagagatgcttttgcctcttccctgttttagctagtcctcaatctggtctgatgtctgagccctgccactggcatcaagtcccacctcctacttcaagacaacccatcagataggagaaaatatttgcaaaccatctcacaagggattaataaccagaatatataaggagctcaaacaactcaatagtaaaaaaacaaataatccaattttaaaatgggcaaatgatctgaacagatatttctcaaaagcagacattaaaatggccaacgtggctgggtgtcggtggctcatgcctgtaatcccagcacattgggaggccaaggtggaagaattacttgaggccagtagttacgacaagcttgggcaacacgatgtaattctgtttctacaaaaaataaaaaattatctgggcatggtggcatgtgcctgtagtcccagctactcaggagggtgaagcaggagacttgctttatcccaggataaagaagatgtggcatataaacattcagccgtacaaaagaatgacatcttgtcatttgcagcaacatggatggacctggagactattatgttaagagaaacaagccaagcacagaaagacaaatatcacatgtccttactcatctgtggaagctaaataagcagatctcatgaagatggagagcagattgattgttaacagaagcagcaaagagaagagggaaagggagatacaagggggaaaaaaatacatatataactttatttattaccaccaattttcacttaaaaatggtaaagatggccaggcgcggtggctcacacctatgatctcagcattctgggaggccaaggtgggaggattgctagagcccaggagtgcaaggttacagtggcctatgatcaagccactgcaccccagcctgggtgacagagcgagatactgtctcaaaaaaaaaaaaaaaaaaagtaaagccaggcacagtggctcatgcctgtaatcctagcactttgggaggccgaggtgggcagatcacctgaggtcaggagttcgagaccagcctggccaacatggtgaaatcccatctctactaaaaatacaaaagttagccaggtgtgatgtcaggcacctgtaatcccagctactcaggaggctgaggcaggagaatcacttgaacccgggaggtggaggttgcatgagccaagatcgcgccactgcactccaacctgtgtgacagaccaagactccgtctcaaaaataaaaaataaaagaagaaaaataaataaaagtaaagatgacaaattatatgtgtatattttacctcaataaaaagagtgttgctaatttccacatttttgaattttcctgttttccttctgctattcatctccagtttcattgcactggatattcaatacagacccattttgggctcatttatataataccttgttcagatctatttgcttatattttctctttctccacacacagaaaaagccaagaatttgtcattctgaccctgatttggctttctctgggaaatcaagtccctcttcctacaatataaaaagcaaaggcttgacagagccctggcttcacttccatccatctataaagtgttttcaatggagagttttaccaatgaggtctgtttagatccggcaaagagaagaatctgctgacagtcacatggaagagaattggcaactaaaataaaataaaagccaattcttggcccagtgattattgggtacatcagagtatgttatccatgaattcagtatacccttactggaagattctgcttattgaaagagtgcatgggccaggcatggtggctcacgcctgtaattccatcactttgggaggccaaggcatgtggatcaattgaggtcaggagttcgagaccagcctggccaacatggtgaaaccccatctctactaaaaatacaaaaattacccatgtgtggtggcgagcacctttaatcccagctactcgggaggctgaggcaggaaaatcacttgaacccaggaggcggaggctgcaatgagcaaagatcatgccactgcactgcagcctgggtgacagaatgagactctgtctcaaaaataaatttaaaaaaaagagagtgcatggaattttgattcagaatgactaatgcaggttattagtaatattctagtacaataccgggctttaaaaaataaaaatttctgggcttctagacaaaaaagcgcaagtgacataataagggaaagaaattagaatctacctttttgagagcaatactttgtacctgaggaaaatggagtacatatttaagaaaagaaactgtaaaccgtgaatgttatatccagcaaaactcacatttgggtagagaagaccctgacgtgccatgctgtgacagaagacctcaggtgctattattcccatgatctcttccagagaaataacaaacttcagacaacaaaatgcctagaaagacattgacacagggcagatcttgagtcctaaatttgctacttgtataaataagactaaatgagggtgatatgagagggtgtggggcccctcccaagatcaggttcacagggtgctaagacctgtttgctgctctttgctgggtgtatgatctgtccacagagagtgtctataaatatcttacaggagcaaattaatccgggcatttacctaggcagtcctcaggagactggtgccctggctagtgaaacaggtacagatgaaagagaaggtctgtaggactgcacaatgaaaagacagagtcctggctgggcatggtggctcacgtctataattccagcattttgatagactgaggcaggtggatcacctgaggtcaggagttcgagaacagcctggccaacatggtgaaaccccacctctacaaaaatacaaaaattagccaggcatgatggcagacgcctataatcccagctacctgggaggctgaggcaggagaatcacttgaacccagaggtgcagattgcagtgagccaagatggcaccactgcactccagcctgggtgacagagtgagactctgtctcaaaaaaaaaaaataaaaagaaagaaagaaagaaaagaaaaaacagagtcccatgtacctgggccctgtgaggagccagaggtctgatgacatggagtagtcgggggatagtggcgaccctgtccctctacttgaaccatcaatatgatccagccaggaggcctgcacattaaatatggacagcatcctggagctcttttctttttctgctaataatcactattctctctaccaccaccacaaccaaactttgcctgtgcttttcaattaaaaaaaaaaaaatcacagagagtggagcaggatggctgaatagaaaccaacaccatttggccaggcgcggtggctcatgcctgtaatcccagcactttgggaggccgaggcgggcggatcatgaggtcaggagatcaaggccatcctggctaacatggtgaaaccccatctctactaaaaatacaaaaattagctgggtatggtggcaggcacctgtagtcccagctacttgggaggctgaggcaggagaatggtgtgaacccgggaggcagagcttgcagtgagccgagatcgtgccactgtactccagcctgggcgacagagcgagatctgtcccaaaaaaaaaaaaaaaagaaacctacatcatctgacccctcacaggaccaccaaattttaacagctaactacacacaaaaagcaccatcacaagaaccaaaaatcaggtgaacaatcacagtacccggttttaaccttatatcgctgaaagagatgctgaagagggcaggaaagacagtcttgagttgctgatgccacccatcccccaccccccagcagcagccccgtggcacggagaatcagtgtgctttggagagggagagcatagcaattgtgagacttcgcattgaactcggtgctgcattgtcacagcagaaagcagaaccgaggtgtacttcgctgacactggctcacacaaggagcgcttggactggcactcaccggaattgcccatcttagcagttggagcttgagttctggcaagccttgccactgcgagctggagtgctctggggcccttagcagacttgaggggcagtttaggccatcaggactgcaattcacaggcaaacccgagtgccgagctgggctcacaaccagtggactgtggagtcaggggcacacaacctcctgagacattagctggggcagctaagggagttctttgggccaccccctactcccacccctggcagtggccatgtggcacagacagatctgtgcatttgggagagggagagctagcaacttggggactttacattgaactcagtgctgtcccatcacagcagagacctggcagcattcatcatctgctgactaaggagcccctgggccctgtataaccaacagccatagccaggtaatatgctgcaggcatctacagccaactcagctggctgagttcctcgcctcatgggggacgtgtgcaatggctgcaaacagcagcttccttggtggtgtatgcagcctgtttcttgtatggctgctctaagggaccttggagacaggccctcagatggatgttcatgtctctgaccttgcactaccccaatgtaggctccaaaaaggtatgcgaggtgcttttggaaagccccggggcaccgtggctggggttcacattggccaattatcatgtccatccgccttgaacccagagaacaaggagcatgtgattaaggccctgctcagggccaagttcaagtttcctggctgccagaagatccacatctcacagaagtgggtcttcaccaagttcagtgaagatgaatttgaagacacggtggctgagaagtggctcatctgagatgggtgtggggtcaagtacatcctcattgtggccctctggacaagtagtgggccctgcactcgtgagggcttctgctgtgctgccccttcttaatactcaccactaaatcctacttcccatccacctgtgggcactgggctctgagacatgctggcttcaggtgtgatccagcacatttccggctgtggtggctacagtgaaagatgccttctgtttgagaaaagcaggaggaagagtaaaggggactttgtcttgccccttaggtaccagctcagccacagtggggtagagcaccaagcaggctcttggggtccctgagtacaggcctaggctgttggtcagcatttgcggacctgccctgggccaaggggagcccactgcctgaaggatgagtcacaggcctgatagcattcatcgcaggctgcctgaagagccctcggggtttttgtgaacatcagcagtggcctggcagaactccttgcaggctggtggaagtggtggccacaaggagaggttcctctgactgaggaaaggggagtgaagagtgggaaggactttgtcttgtggtttgagtgccagcttacctgcagtggaatgatacatctatagaattctattctatcttagaatagaattctaaggtttatcaatccctggctcccagacagcatctctggaccttcccagggaactcactgccctgaagggagggacaacaccctggctggttttgccacctgctgattgtagagtcccaggcccttgagtgaattcaggtgatggccaggtagcagttctagcagaccttaggtgagacccagtgctgggctgcttcaggtctgaaccagtgcagtcccagtggtgatggccacaggggttcttgtgtccttccacccccagttccaagaggcctagcttggagagagagagagagagactccatttgtttggaagaaagcaagggaaaagaacaagaatctctgcctggtaatgcagagaattcttctggatcttctccaagaccactaaggtggtacctttacgagtccgcagaactacagttttattgggttcagggttcaagtccctttgaatacctgaaaagccttcccaagaatcacaggcacaaataagcccagactgtgaagactacaataaatgcctaactcttcactgctcagacactgatgaatatccataagcatcaacaccacgcaggaaaacatgacctcaccaaactgaataaggcaccagggaccaatcacggagaaacaaaaataggcaacctttcaggcagacaatttgaaagagctgtattgaggaaactcaaagcaattcaagatgacacagagaaggaattcagatttcctatcagatgaatgtaacaaggaaatagaaataattaaaaagaatcaagaggaaattctagagttgaaaatgaaattgacatactgaagaatgcatcagagtcttaatagcagaattgatcaagcagaaggccgggtgcggtggctcacacctgtaatccccacactttgggaggctgaggcagctggatcacttgaggataagagtctgagaccagcctggccaacatggcaaaaccctgtctctactaaaaatacaaaaaattaggctgggcctggtggctcacgcctgtaatcccagcactttgggagggtgaggtgggtggatcacttgaggtcaggagttcgagaccagcctagccaacatggtaaaaccccaactatattaaaaatacgaaaattagccaggcaaggtggtgtgcacctgttatcccagctactcaggaggctgaggccagagaattgcttgaacctggtaggtggaggttgcagtgagccgagatcataccactgcactctggctcggtaaacaaagcgagactctgacaaaaaaaaaaaaaaaaaaaaaagactttgagaccagactggcctacatggtgaaaccctatctctattaaaattacaaaagttatctaggcatggtgggaagttgaggcaggaggatagcttgaacctgggaggtggaggttgcagtgagccgagatggcaccactgtactccagcccaggcgacggagcgagactttgtctcaaaaaaataccaaaaaccaaaaacaacaaaaacaaaaaacatcaaaagactatgaaaaacagtgattggatgtttggggtgtggatatcggaatctggagctggggacaggtgtgtcatttgatagtcccttttgagaaccactgttgatctaaagctattccagttccctaggggattgctaataaccggtgcagctgctgagacagggaaaggggcctaattccttttgcaaaacaaggagcaatatttatatgagaactcagtacatttcatcacataaaaattgcaaaacgccaggctctgtcatttttaaactaatatttttgggagtccaccaaacagtctctaagatggaactgattgtgaatatgctggtgccaggtgcaatggctcacacctgtaatcccagctacttgggaggctgaggtgggaggatcacctgaagccaggagttcgaggccagcctgggcctctctaaaaaaaaaaaagctgtaagtcaaatgatatagcctctagaagccacagtttgctcatttacaaactggaggagaataagatgagaattgtctgatattgaggatcagaaagtgcttcatgatgcataaagcaggtaatggattatcaatgctttgctgctcagacacacagcaatgggttcataccattctgagagtctaaatttaggacgtggtgtgaccaaaattaccagtaattaagtttcttatgtttctgaggctctgcttcctcatctgtacactgtggcaagaccttgttctgactatgcactgaggataaaataaggccttttgaaaaagatgatgacactgaccactaattaatgatttcaatgttcccgtccaaggtcaggcaaaagcaatgcagagccatagagaatgttggtgcaacactgccctctgctggtcagtagcagcaccaccatggttacagagaggaaaaggtctttacaaagggattcctgggaaactgaggcagagagtggaagggatttgctcaagggcacagagttagctttggacaaagtgatggctcgaatctgagattcctaattcctagttctttctagagggagaaaaataagggctggaaactagtggattgtcgtttcactctcactaggctctgcacggcattttaaataggctgattggaatttctctctcctgttcttcccttgccacccatactgctcgggtttcttgtccttttcttcataccaggataaccatctgtgtggccccataaggcccaaagtcctcttgggtgctgccggagttccaacaaccagtaaagcacggaagctgggatctgaacactcacttgagaccccaaggcccacaatctatttgccaccaaaaaacaagacaaagcaaaacaccatggtaacttgtgttgaaaaagatagatcttgtgttttgttatttccccgaatggtatttgttgggcagacacatgtgtgtgtacagggtagcagtcaggatggaccacaggcccccacactacgaaacccttcagactctcccacagaaatgaggggaactgagccaggtgcagtggctcgtgcccgtaatcccaacttgggagactgaggcaggaggatggcttgaacccaggagttcaaggctgtagtaagccatgattgtgccactgcactccagcctgggggacagagtgagactctaactcaaaaaaaagaagggaaggaaggaagggagggagggagggagggaggggagccaggcacagtggctcacacctgtaatcctagcactttgggaggccaaggcaggcacatcacttgagcctaagagtttgagaccagcctaggcaacatggtgaaacccatctctacaaaacatacaaaaattagctgggcatggtggcacatgcctgtagtcccagctacttgagaggctgaggtgggaggatcacctgagcctgggaggtcaaggctgcagtgagctgtgatcgcccctcaggactggaagtcctcctggtctgggttcaaaccctgcatttctgaacactactgtgtgccaagccctggcaaatcatatttcttttaatttgataacactgtgaggtcggtacaattattatcaccattttacaggtgagcaaatggaagctctgagacattaagtatcttgcttaagagcaagagttgtggggaacccaggtgttgataatttgccagcatttgatgtgatgcttcatggttttattcctccccatttgcagacgggaaaaccgagttgcagacaaatgaaagtgacttacctcagggcctttgcatgtgccatcctctctgcctggaatgctcttctcagatatcaccttggcatcccccatcaccttcttaaggtcttcacttaaaagtcatcatctggccgggtgcggtggctcaccctgtaatctcagcactttgggtaggccaaggtgggtggatcacgaggtcgggagatcgtagaccatcctggctaacatggtgaaacccagtttctactaaaaatacaaaaaattagctgggcatggtggcaggcacctgtagtcccagctactcaggaagctgaggcaggagaatggcgtgaacccggaaggcggagcttgcagtgagccgagatcgcgccactgcactccagcctgggcaacagtgtgagactccatcttaaaaaaaaaaaaaaaaaaaagtcatcatcttagggaggtcttttctgatcaccctatttaaaagttcaggctgggcgtcatggctcacacctgtaatcctagcactttgagaggctgaggcaggagaatcacttgaacctgggaggcggaggttgcagtgagccgagattgcgccactgcactccagcctgggcgacaggatgagactctgtctcaaaaaacataaaaaaataaataaataaaaataagttagctccatgcttttaactcagtaacaaaaagacaaatgaccaacgtcaaaagtgagcaaaggactatctaagaagatatatatacacggccaatgggcacatgaaaagatgctcaccacgtaatgatatgtattagggaaacacagatcaaaaccacaggacacacgacttcctatcactaggatgactgttattttaaaaatggaaaataacaagcattggtgaggagatgaagaaattggaagctttgtatattactgataggagtgtaaaatggtgctgctgctgtgggaaactggccattcctaaaaaagttaaacatagaattaccatatacccagcagttccacttttaggtttttaccccaaagaattgaaaatggggactcaagcagataccatttttatttttattttttatttttagtagagatggggtttcaccgtgttggccaggctggtctcgaactcctgatctcgagtgatccacccgcctcggcctcccaaagtgctaggactgctggtgtgagccaccatgcctggcctcaaacagatacttgtaacctaaatgttcacaacagcactattcacagtagccaaagatggagacaacccagatgtccctaaacagacgaatggattaacaaaatgtggtctatccatgtgattcaattttactcagccataaaaaagaatgaaaggcacatgctaccacatgaatgaaccttgaaaacaaggtgagattcttgtgaaaggagctagtcacaaaaggccacatagtgtatgatgccatttatgtgaaatatccaaaaacagacaaacccacacagagaaagaaaagcaacggttaccaggggctggaggaggaggaatggccaaatgggtacggggtttccttttggggtgatgagaatgttctggaactagacagaaatagtggttacataacactgtgaatgaactaaatgccactcaattgttcacttaaaaaaaaacagagatggagtcttgtcgtgttgcctaggttggtctctaactcctgggatcaagcaatcctcccgcctcagcctcccaaagtgctgggatcacaggcctgagccaccgcgctggccaattgttcacttttaaatgattaatttcatgttatttgaatttcacctcaatggaaaaactcagccccaaacatgccttatcttccctccctacctgatttttctcctaatgcacagggcccctcacatatggtatgtccggcctatgtgtccattgttcatcctgcttctttaaaatataaattccaacagggtaaggatttcatctgttttgttaactcacatatgcccaaagagtctctggtactcgataaatatttgttgaataaatgaattagatagggtgtggtgatggagagagtcccgccgccatccctgcccccatctctaattctaacgttctaacccggctcttgaccttggagccggttaacgatgatcctgtctgggctcattttccctccttttcctgaagagcagcatccacaggccctcactcagctcagtcccttttaacccttgtctgctgagagtttgagataaagggggccacgagagaagacaatgaatccattacaatgtgtgatgagctgtctgctctgtggcttcccacagcaatttatcatgacctggaaccacagctgtgaggccgggtgtgcccccgccaggacctcactccccagctgcttcagaagggaacatttacaggaacctgtccatacctatttaatgaacagctgctcggatgcagccctgtcccaggcactcagccaaatgacaaatgaactatataatcattcattcattcgatgattcattcattctatgattgattgattcattcattcatgtggttgtcaaacattcattgagcacctactatgtgccagacactgtaccttgcactgtggcccttaatatcagagatgtcaatgtatgatagaccaggattcctcagcctaggcactggggacacttttgttttttgtttttgttgttgctgtttttgagacagggtttcactctatggcccaggctggagtacagtggcacaatcacagctcactgcagcctcaacctcctgggctgaagcaatcctcccacctcagcctctcaagtagctgcgactacaggcacacgccaccatgcctggctaatttttttgtattttttgtagagatagggtctccctgtattgcttaagcttgtcttgaacttctgagctcaagctatcctcctgtctcagcctcctaaagtgctgggattacaggtgtgagccaccatgcctggctactgtgcacattggaaccagatatttctttgtcacaggggttgtcctatagattagcagcatgcctggctgcagatgccagtagcactccctcagtcgtgacaactcagatgtctccagacattgccaaacgtccctggggcacacagtcatccctagttgagaaccactggtctagacaagtatattttcctcaaattatcagagaaaaaaatgcttttatttttgctgtttcctccttctctccctctctctctccccctacatacctacctacctggctagttaaattggaaagcaaaagcataattacagctaacatttgtaaatagcacatagtaaggggtcattttatcttggttattctcgcaacaactatatgggcaaaatgccaccaatgttcactttacagatgaagaaatcaaggcccagagatgctaagcaagttgtccagggtcacaccaagatgaaggggcagagctggggttcaaatccaggtccatatgactccagagcccgggtgccaccagattaagattaagattaagagaccaggttaagcaatataggaagaccctatctctacaaaaaaatacaaaaaaaattagccaggcatggtggcatgcacctgtagtcgcagctaactgagaggctgaggcgggaggattgcttcagcccaggaggttgagggtgcagtgagctgtgattgtgccactgcactccagctgggccatagcgtgaagctctgtctcaaaaacaataacaacaaaaacaaaaaacaaaagtgtccacagtgtctaggctgaggaatccactgtgccacactccctggcacagagcctcacacattgtagtgagcaataaacatttattacctcagtgaatgaacacaagaatggggcaaggattctgagaaaggcctggagaagcataggctgcaattggaggcttgatgttctggagggacgtgtattatcttaattatttccatccatcagtccatccattcatcgatccagccactcattcaccaagcattccccaaacacctgagttgtgtctggcacctaggaggaattctggtttcaagatctcatagctggctgggcacggtggctcatgcctgtaatcccagcactttgggaggccgaggagggcaaatcacttgaggtcaggagttcgagacctgcctggccaacatggtgaaaccctgtctctactaaaaatataaaaattagccgggcgtggtggcatgcacctttagtcccagctactcgggaggctgaggcaggagaatcacttgcatccagcaggtggaggttgcagtgagctgagatcgcaccgctgcattccagcctggacaacagagagagactccatctaaaaaaaaagaaaaaaaaagaaaaaaaaattctcgtagccaaggaggacgcattaattgtgctcaggaataattgccacatcagatacaaagtgagaagccacgttatgaaggaacacaaagatgctagattagccaagactcttggtcaaaagtgatatgtatgcctgctccaattggcttaagcaataaagggaggttattggctcctaaatctagtgaggtttcaggtatggcttgatcagtgtgttcaaatgatgtcatcagaaatccctccatcattaccctctgcctctggttttctctgagtcaacttaattccctgctggcatgacggccaccaagagctttaggcttatgtcctgccagcttagcaactccaactcaaagagcaccactttttcaatgattttagccaaaattccaagacttgtctcagaccaacctgaatcatgtgcctgctcttgaacaaagcacagtagccagggaaaaattgtgctttgattatctaggactggatcctggacctgcccctgggacttgcggaaggggacagctcaatctgagccatatcaactgagaacacaggaagcatggtcctaccaagagatgtctattccaggtatggtggagcctcagaggacagcatgactctcgttcagctggtggatcagggaatggtccaataagccacagctgtggatatgaaggtctgttgatttcagattgagctagagggggatactgggcatggcagaaaaatctatcaatctctgctatagttaaatatttgaatattggattgtttgcagatcttgtgaaatcagtgacctctgggtcatgtagaaacccagcacattcccacaggacacagcctagcagttgatcagagcagtagttcatacctgagaccctggattttcagaccctcccccaggccccaccagcctctgtcagtgccaagctggacggaacaaaccacatgaggttggtcaggcctctaccccatggaaaaacacagaatggtgattttttgcctgtacattcctggacaaataaattctcttttgggagctttttcctggctgggctatgttatatgcctcagagctgcccagatcccctggaaacccaaagatttccttccatgtgtaggactcattcagccccagctcagaggactgtttcatgggtactggtggcaggaattcttggttgtcttcaatgtctggctccctgattttcggtagggaacatggtcagcagaatgaggatggcatttcctaccttctactgcaggtaggtgtgaccatgtgactacgctctggccaatgacctgcaagtggcagtgacagatcccatccttcaagggaggaacatgccttctctttctcctttcctctttcttccaggcttttaattttttatttattgattgattttgaaaaacggagtcttgctctgtcacccaggctggagtgtagtagtgcaatctccgctcattgcaacctccacctcctgggttcaagcaattctcctgcttcagcttcccaaatagctgggattataggcacgtgccaccacgcccagctaattttttgtatttttagtaaagatgaggtttcaccatgttggccaggctggtctcgaactcctgacctcaggtgatccacctgcctcagcctcctaaagtgcttccagcctttttagaattcagttctggtgggaaccattttggatcatgctgatgaaggtaacaccatagagatggcagagctggggttgggtctggtgactcacgcttgtaatcttaccactctgggaggccgaggtgggaggattgcttgagcccaggagtttgagaccagcctgggcaacatagtgaaacctcatctctacaaataaactcttggctaaagcaatcctcccacctcaggctcccaagtagctaggctacaagcacacaccaccatgcctaattaaaaaaaatttttttttgtagagacagggtctcgctatgttgcccaggctggtcttgaactcttggcctcaagtgatcctcctgccttggcctcccaaattgctgggattacaggcatgagccgctacacatggctcatattctcaatagagcagtcccaattggccactgaccagccaatagtcttgctctcctgggcagatgttcaccctggtccaataagccacagctatggatatgaaggtctgtgatctcaaattgagctagagggggaagatgggcatggcagaaaaatctatcaatctctgctacaattaaatatctgaggtcagacatggtggttcacgcctagaaacctagcactttgggaggctgaggtgggtggatcacgaggtcaggagttcaagaccagcctgaacaagatggtgaaaccctgtctctactaaaaatacaaaaattagctgggcatggtggcaggcacctgtaatcccagctactcgggaggctgaggcagagaattgcttgaacccaggagatggaggttgcagtgagccgaaatcgtgccattgcactccagcctgagcgacagagcgagattctgtctcaaaaaaaaaaaaaaattgaatattggattattgaaacttggcatagagcagccactgtccttgtcttctaagagcttatatcatattattattttattattattaataacatatcattattaattaatagctgcagttcactgaacagtattagataccaggcatggtgcttgtaattagtcatctcattgaattcccttaatgacaattaggtagtcagagacctttcttcatggatcgcaaccccaggggcatgtgggatttcagagatgtgttttggggaaagaggtataattattcaactttcagttaattagccacttagagaaattaagtggtaggtggagttgtaaaggaaggcaaagtactgggcaggcagatgctaagtgggagactgttctaggcataagagaaatgggggtgggtatgaaaaaaagcaagagagagagagagagagagagacaagggaaatttggtttgactggataaaaaggccagtgaaaagagggagttttggtaagagctatgccatgggcagggagaagtacagagatcttcaatcatggactctatagccatcccctcttctcttcctgcaggtgggcagagccaaggtcccctccctacaccttcctggggcctccagcgatcctgagctcagcctcctgacctgcagacccctcagctctggccctcacgtcctgcttgctgtacctgctttatcccatgtcaccatctccattcctcagcatagtgacaatcccagttcctacccattccactggcttctccatttggcttggagctctttagctggattgagacgactactctgatgagtgccatgtcactggctcaacaaaatgggcccaagtgagtcaatgtcattgacatgaaggtgctgtcagtttggtgggaaccaagggaatgagactgtgttttagctgcgttcgtttgaacagttacacacttagggcttcttatgcggatgctcagagagaaatatggaagacgagatctcgtagaaaacaagaagacatgttgtaaatgagtcaggcctcctggagtccaggactagggaggaactctttattgaggatcactcgagggagtcttggggctggtggtcttcacgccacagccccataactcagctcctctcttccttctctcagtctctctgcttctgttttttgtctcatgtcctaaatgtccaactattcagcataactttattctgcttcccctctctatcctctgtagcaaaatgcactgttggaattacatttttatttttatttttatttttttaagacggagtctcactcattgcctaggctggaatgcagcggtgtggtctcggctcactgcaacctccacctccaaggttcaagtgatccccttgcctcagcctcctgagtagctggaactacagatgcctaacaccatgcccagttaatttttatatttttagtagagatgggatttcaccatgttggccaaggtggtctcgaacccctgacctcagatgatctgcctgccttggcctcccaaaatgctgggattacaggcatgagccaatgtgcccagctggaattaaattaataatttttatttctgctttagcgagagaggcggtgactcactgatacaaggaagatatttccccttccaagggtgatgtattcagcttttgggtttaaaaggagatgctatcaggcacgcgtggctatcctggcagattacataaaaacacagaagaaatgttctttgtgttaaaagaataaaaaagaaaaaacaaaacgtgtttcctcaaaaacttaaatacagaattaccacatgacccagcaattctactactggctatatccccccaaagaattgaaggcaggaacatgaataggaatttgtagaaccatgtttataccagcattatccacagtagccaaaaagtggaaagaaactaaatgttcatctacggattaacagacaaacaaaatgtggaatatctgtacaacagacttattattcagcctttaaaagaaatgaaattctgggccaggcgcagtggctcacacctataatcccagcactttgggaggtcgaagcggcagatttcttgagcccagcaacatgacgaaaccccatctctccaaaaaatacaaaaattagcccagtgtggtgatgcatgcctgtagttccagccactgggaggctgtggtgggaggattgcttgagccctggaggtcgaggctgcagtgagctatgatggtgccactgcactctaacctggatgacaaagcaagatcttgtctcaaaaaagaaagagagcgagagatggaaggtaggaaggaacgaaggaaggaaggaaggaaggaaggaaggaaggaaggaaggaagggcggactagttagaggcagtcaacccatccattatttgaatgagagcatctcttctgtgttagttggactaaaggagaagctgccagaactctcaaggggaatgagaaaatggaagggaattgaggctttggttctataaggtagtagacacctgagccacattccagtaccttattccaggacctatcaatgaccaggagatgccagggcaaggacaccataggaaagatgccagcgtgggtggcccattgtgtgctagatttgagactgatcccagcacccaggcaggctgcctccagcaggcggatgtttgcctggatgtttgtctggctctgttctgcagggatgctgtggtcagtcttctgatcatcacagaattctttggctaagagtaaatgaaagcccagttaaaacgacttaaacaatatttcagagagagagagagagagagagagagagaagtcccaaggtagggtggctcctgggttagttaactcagcggttcaaaccaagttctttccatcattctgctctaccacccagagcgtgtcatttcagaaaggccatctcttcttgtgtctctttcttaggaatgactccttccttctttccttccctccttccttcctggcttctttcctactttccttggtttcctctgtccctccctcctgccctccctccttccttccttgatgggctctcactctgtcacccaggctggagtgcagcgatgtgcaaccttgactcctgagctcaagtgaccctcccacctcagcctcccaagtagctgggactgtacgtgtgcaccacccacgcctggctaatttttaacatttctgtagacgggcttcactatgttgcccaggctggtcttgaactcctgatctgaagcaatcctcccatctcagcctcccaaagtgctgagattacaggtgtgagccactgtgcccagcccctacatctttctttagaagccccccaacaagtttcctctcacgtttcatagccatatactcattttcatatccattcctacacgagtcaaccacaagcagaatgagactaacgtgatactcctgaattggggatgaagctgtctttctcaagggtttcaaacccgaacaaaattggggattctgttaataaggaaaatagaatgctttatttatttatttatttatttatttatttatttatttatttattgagacagggtctcactgagcactcaaggctggagtgcagtggcatgatcacggctcacctcgacctcctgggctcaaatgatcccccacaattgccacccagcttccagagtagctgggactataggcgcatgcccaccacacctggttattttttctatttttttgtagagaaaaggggtctcgctatgttgcccaggctggtctcgaactcctgggcccaagggatcctcctgcctcagcctcccaaagtgctgggattacaggcattagccactgtgccctacctaaaatggattttgaatgggcaactaggagtgtctgctacacccctgatatggacgagctctaaggattaacggacacgtgggaaggactgtttcaagcacgcttctattaccaattaccgggtagggatatgacccacactctgggtaaatggtggctcacctacagattctcattccagcctgtgagatggagaaagggaagagtggggtgtgctctttatttttaaggtcctgacctctgcatacaaagttccctctacttcctgacctgagtaagacctggctcttccctgacagtcctcgaagcccttcccaggggatggtagtccgtctcccacccccatggtgtcctctatgctccacacctctatttccagatccatagtcctccatcttgagtaagcactgaggctcctgacatctagctgtaccaccttctgtgccttctcattgatgatgcctactcatcaatcaatcaatcaactgttattctcagagggctttggcaactggcttacctttctcgccccagttcctaccgccatattggtgactttaatgacccaggacctggccgaactcctggcccttcagctcctgtcccttcttattccaatgaccttcacctccactctactttagccaccatctccctggaccatgtactggccctcagtttctcctggaacgaatcttcctctaaagtctcacatttctctgatcacagacttgtaccttctgttcttttgatcattccagcttagcagttcttcgaactccaggatcccttggcccttccactttctccctctcaggaccctccttcctccaattcctttcccatccagcctagattccatgatctttgctatacccagtcatggatgttgtgaatgactccccaacatccattccaacccagacggttggtccaagttggtcatggtcattccctgtctcttatcaggagagaaacagtcatgtgactcacttctagttctagagggtagagtgaggtggggtaaagaggactctgggaaagattttcccatgaaagagacaaaagaactgatgatctttcctcctgaggatgaacccagcaacaagggtggcagtgcatagagacaggaagaacccagatctttgatgatgttgtcaaaccactaaatcaaccccatctgaagtatcttcccccaggatatcccaatacatgaaataataatttatttcatatttaagccagcttgagtcaggcattctgctactttcagacaaaacaccctaaataacttaatttgcaacttgcagcaaaagcccagtcctggatcaatgtaaatttccttccattctgtttttatacctgttctgcttagactggtggagaaaacaataggtcctcagtcctccagaaacctcagacgtctctctacccatccaccattaggagagcgtttccccatccatctccagcctttgtttagggttgcagaagacctgcgttgttatgtgaagtggccagctgtcttgactaggaaatagatattttttaaagttcccaaggatagcatggatatttggcttgggtagaggggaacagagggaagatcttgaggttaaaagaaatccagcattcataaggaggtagggtagttatactcagattaagttgaatgaacgaagtcattcccagtggctgagttgagttaggggacaaagagaagcttcctgccccgtgttgtggcctggcaggggtgcaagccccaggggagggtgacctatgggcagagcaactgaatcagccttttgctcctgtatcttggacctgactagctactgtcccagtaacacatgtcaacaccataacaaacatagtagataccaatgatgacacatcttaaaactatgtgaaccagttggcaagtcctggtggttactgagtgtggaggtaggaggcggttcctattggtgggaaggcccaggcctctaccataatctcagtcacctagactgttggcaataacaaattcatggtctctaattcttaccactactctggaattcctgttttccctgttggctctctcctcccattcaccatagcaactattttgaatcttctctacactcatcccacctcccacctgcctgccttccctctcactctcaggcacctctgcctccccttccttccttgcttccttccttccttcctccctccctccctccttctctctttctctttctttctttcgttctctttctttctttcttttctttctttttctttctttctttctcctttctctctctctttctttccttcctccctccctccctccttccttccttcgaatcttctctatactcatcccaccatcccacccacctgccttccctctcactcttaagcaactctgcttcctatttctttctctctctctttctttcctttctctctttctctatttctttcttttttttttttcagagtcttgttctgttgcccagactgaggtgcagtggtgcaatcatggctcactgcagccttgacctcctgggctcaggtgatcctccctccttagcctcccaagtagctgggactactgtgcctcctatttcacacagaaaaaaaaaatttttttattttcgtttcattatgttgcccaggctggtctcaaactcctgacctcaagtgatcctcccacctcagcttcccaagtagctgggactacaggtgtgagccacctcacaaggcttcacacaaaatagatgccatctatctgattgggactatccttaccttgcttgcttacctgcaactgttgtagcactgtccagttgagctttctatactgctgggtaagtaccgtatatctttgctgttcaatatggtagccattagctacagggggctatcaaaatatggcttgtacagctgaaaacaagaattttaaattttacgtcattttaattaatttaaattgaagtatgtgtgagtggctgccctattaggcagcaccagttcagcataactaaaagaaaaacatttgtggataccaaggcactggggtttctgcgaaccctctgacatcactaggcaatagactctcgaccaacgattataggaattctgaattaggtgatgagaaggaagtaagatagagtttaaaaaaaaaaaaagtacattcggcagggtgcagtggctcacgtctgtaatcccagcactttgggaggccgaggcgggcaaatcatgaagtcaggagttcaagatcagcctggccaacatggtgaaaccttatccgtactaaaaatacaaaaaaattagctgggtgtggtggcgcgcacctgtagtcccagctactcgggaggctgaggaaggagaatcgcttgaacccgggaggcggaggttgcagtgagcagagatcacaccattacagtccagtccgggcgacagagtgagattccgtctcaaaaaaaaaggaaaaagaaataaaaaaggcacattcactgagaaattgccccggagaaataaagaggaaaaaaatattgctttgacgtgttgttttagtcgtggcagttatgaagaaggaaaccacacagtgaaccatggctggaacattggttccatggtggtacatggctctgtacacatgacagagaagaaaagccttgtatcatggctgcaaagccccactggtactgacatgctcacagcgtctgtgggaggaaagatggaacaccagccacgtagagaagagagtgaggtgtcgtcatcagttgagtaacttcaaagagtgtccagttatctttgtttgcactttctacctttcatgcaaaatgtgtgcaacacaaacatatgggtaacttgcacgtcccattttgtgtagctgattttgctcacttttggagactctgctcctggggcagtcctggagaaacagccgagagagcaaaccagctgaacactcattattttcttaagcagtagatagctgcaaaagctccatttcgtttcttaaacagtttctttcagtctctttacctgtaggtatgctagtttacaaggactccagatggcctgggagcttcagaaccttttgccaattatcagaggaaggtaaagcctgctggaaaccagagcaacgcagaatcagggactccttgctatctttagaccattaatatatcattataatactaaaattcccacccagagaagaaaattgctattttcttttttctttttttcgtttttctttttttgagacagagtctcgctctgtcgcccaggctggagtgcagtggtgcaatcttggctcactgcaacctccacctcctgggttcaagtcattctcctgtctcagcctcccgagtagctgggattacaggagtgcgctgccacacctggctaatctttgtagaaaattgccattttctaaacatgcatcctgtgaagagacatgtttatgatttgcacctgcacatctaaagttcctccctgcacaaacatacaaacctccccgccccatatctaactccttaaaattccccagctacccacatcttggggaggaggaggtgtctctggagcaagaggtcattccttctccttctctggccaaagaataaatcctgcttgccttcctccccgcaaccctccaatttgtgttctttctttgcggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacctttctttgcaactgacacaaagtagggaaaggactcagtttacccatggcagttctatcacattttaaatagttacacacctttgcaaatctgtaaagtttgagtacattttcctgtctcctctgacctcccctgaacgagcagccaattgtttaaagatcctatttggagaaatttctttctcccctgatttaaatgcttttattgcacactaagttcctactcttttttttttttttttcattattgcatacagagtctcactctgtggcccaggctggagtacagtgacataatcttggctcactgcagccttgaccttccagggtcaagggatcctcccatttcagcctttcgagaagctggaactacaggtgtgcactcccgcaactggctaatttttttattttttgtagagacagggttttgccatgttgcccaggctggtcccaaacttctgggctcaagcaatcctcctgctttggcctctcaaagtgctgagactacaggtatgagccaccgcacccggtctgcacctatctttgtgtttaatacgtgactccaccctgttccaataatgtgtctgtcagttcccttactagagctgctttaattacacagatttaccatcgctcttaatatctccgtggtcaccggtttatttgtgaagtgttcaccccatggcctctggggactcactgtctttcggctttcctctcctccctactctgcctcagcttagtctccttggtgttggtgtccttcagggatctgtcttcggtccccctccatgtcactctaccctctccctgggcagacccctggctccactcttgccccttccgcccattttccatggtgcagctagagtgctctgactgagctgcaaatgagaccatgcacacccgtttataaacccacctattgttctcagggtaaattccagacagactctttaacaccagaacataaggctggacgagattcaggtccaagtagtttgtttgggaggcgacccaggaagaggagtggggaagtgagacaggaaagggaaggcagtcaacacaggaagcattaaagagtaggtcaggaggccggacgcagtggctcacacctctaatcccagccctttgggaggctgaggcgggcggatcacctgaggtcggcagttctagaccagctagggcaacatagtgaaactccaactctactaaaaatacaaaaattagccgggagtggtggcacgcgcctgtagtcttagctactagcgaggctgaggcaggagaatcgcttgaacccgggaggcggaggttgcagtgagccgagatcgtgccactgcactccagcctgggcgacagagcaagacactggaaataaataaaactaattaattaattaaagagcaggtcacggctgtgggcatctgggctcagaccccctcaggccctctggagactgcctagacttgtctcagagttgtcccacctgggggaggaacgggtatttaaccagcagtccctcagccttggagcctctattctctgagagtcacattctcattctctctctccctctctctctctctcttcccaccccccttctctctctctctctctcccgccatcttcctttctttcctccctcccttctcccccaacggaggttggcccttgacgccctgtgtgattatggccccgcccacagccatagctgattggaccagggataaagaattaggccaatcagattcattccccttgagttctggaactgggcaggggatctgggcttgcatttgaactgtggaacctaacttggagagcattgctgaaccacgtgccctgggagaaacagaggaagccagtgtttagagagactcgcaatgggcacacagagacaaacagaggcgggcttcagacaaactgaaagagcaacctcagcacaggacagtttggtttctgattctattaataggttctcatgaggttgggcacatttcctgcacttgcagtctgtgagataagtgtttcctcaaaaaaaaaaactcccttttctgctgaagaatgtcacttgattttctgtaaattgtaaacacacccacacactcacaagactaagaaatccaccgttcaatccccaatttttttttttttggtaactttatattccttccatcacgaggtcagaacatttcattgctgctgtgagactctccagagttctcattaaagagttcaagacaatggctgttccgttagcctcgatctctgagtgattacagagagctgagccatctgggagacccatgatggacatatagtgtgagtgagaattaattcatcactgctataagccatgagacactgagagtgctttgttattgcagcataacctgtcctatcctgatagaatcataagaagtgctgagagacaatttgctggaactgatatttacagggagaagagagccagagaaagataagacaaagattggatgcagtggcttatgcctgtaaccccagcactttggaaggctgagtcaggaggatcacttgaagccaggagttcgagaccagcctgggcagcatagcaagaccctatctctacaaaattaaaaaaaaaattaacgaggcttggtggcatgtgcctgtggtcccagctactcaggaggctgtggtagggggatcactggagcccagaagtttgaagctgcagtgagctatgattgcgccactgcactccagcctggacgacagagcaagacccagtctctaaaataaattaattaaattaattttttaaaaagaaagataagataaagagtcatagaagtacaaatgagaaaccaggagaacatgggacccaggaaagtcatggaaaccaagggaaaatactggtccaagatgcagaaagtagccagtgatgttgaatgcatccaagagatcaagtaacataaggaataaaatatatccacccagtctggcaactgagaagtctttggtaacctcattgagaacagaatccatggagtggaggaggtagcagtgatgaaatagcggacaagggctgaaggagtggagaggggagagcatgagggaccagtgcaagagtgcagcagaaagacaacaaacaggccgggtgtagtggctcacgcctgtaatcccaacactttggtaggctaaggcgggcagatcgcttgtgaccaggagttcgagaccaacctagccaacatggtgaaaccccatctctactaaaaacacaaaaatcagctgagcgtgcgcatggctgtaattgcagatactcatgaggctgaggcacaagaatcgcttgaacccaggaggcaggggttgcagtgacccaaagtcttgccactgcactacagcctgggcaacagggggagactccatctcaaaaaaacaaaaaaaaaaaagaaagaaagaaaagacaaagaaagaaagaaagaaagaaagaaagaaagaaagaaagaaagaaagaaagaaagaaagaaagaaagaaagagaaagaaggaaagaaagacaagaaaatagatgtctttgagtggtagcaagagcaacactgaagtgatttgcctattctggacatttcctataaatggagtcgtaaaagatgtatccttttgtgtctggcctctttcacttaagcgtagtgttttcaaggttcatccatgttggagcatgggtcagtgtttcattcctttttatggctgaataatattcccttgtatggactttcgtgcttttgtgtatccatccatcagctgatggacatttgacttgtctgcctgttcactgccatatctactattcctggtgctcttgggaatgagtgaatgaatagcataaacagagctgtccaaggtcacagagctggtaagatgtgaagccaggatcggaagccaggccattagtcccctagagcctatgttctaagcatcaggctttacctgtgaatctcctctttttacagatgaagatgactgtatcactcagattcccggcaggaaagcaatggcatactcaagtggggtaactaatgatggaaccatttacaaaggtgtggacagagttaagaaaaagcaataggagatagtgagcttcctggggctggtaagagtggggagcccttaccactcccaggactaaaggagggagtggtgcccagaagccctgcctatatgcaactgagaagggcagggccagggagtcacgtccatcctcactgctctccagtctcctgaactggaagccagaaggtgaggggaaccctgatgcagtttgtatgtgtgagaaagtacaattagtttagactgaaaaactgaaaatctacccggccacttagcaggctggaataacagaaatggatcaagccagctgtaaagataacagggaacaataattctctgtagctgtaaagtgataatacaaccctgcatctttgagtgactgctgaaacattgtcctttaaaatcagagaccttcagaaacttcgctgtttgaaattacatgactaagactgaaatattccaattttgcctggaagatttaagtcatcttgacacagagaagcagcctcaatttacaactcaggagcagagcttcagataaagattttctggacacatttgacatgtatcttagctatgttgcttcctaggaaacagggccctgggtcctctttgcaatccagactgaagttgactgctttgtacaaacctgttttgctttgagtccatcaaaacatgacttcatttagattttatctcaactccactttcctcggaatcctatactaaattgctgttttcctttgtttggtgatgtgcgtagctcttctggtgggtggtgtccctcactgaataggtcaacaaacctaactttgttggactgccactgtgtccctggtgatctttggctgattggtctaggtcatagatcgacctgccggggtgcagaggagggtggagagtaactcagagggtcaagcatgaaagatctggcagaaaaataaagcccctccacccccaccacccctacccctgcaaatctgatttcccccaccaactgcagaccagagtattataaggggcggtggaagaagagggggagatcttcatttacccagagctcctatacatcaggggctgaataaagggttgtagaaatgaatgaatcaatctctgagtggggcttcaggcagtggaaagatctcagtccttttctgaggcataatggaagctcccagtcttgtgacatttgcaaggctgcccctttctcccaagagacatgagaccaaaaaagtgaaaggaaaggggggaaaagggagaattctgaaaatgcccatcctctgaacaccatctttgtgtaggcatctgggggaggccagctggggtgaggtcatctgccagccaggcccgtaggacttggcgcttcttgtttatcacagccacatgtggggccactgccagggcccgccccaactctgcagtcattggaggagcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttggtaagtgggatctggggaggacccagatctctgcagtggccgacagcacagaaagccccagcgggcagcttcaggtgcacattctgaatctcacatggttttcgaatctgagacgtgctctcacagccagctgggcgggagggaggaagcagcagcaggcaagaggaaacggtgccaggctgcagcagagagaagccacaggacaagcgggattcctttctgctctacttcaggcccgccagggcgcgcagggcagggcgtgcctggggaaggtaggaaagcgcagggcaacaccctggatccccagggaggaggcgaggatctcagggcacgcctggtgatcatgctggcatctgagtcaccatgcttgggaggaataggaccaggcttgaaaatgtgttataactttaggtcctcaccaacgtcaggaaggccctgctttttggtttttgtttcttctaaaagaaacttactgagatataatttatacaccatacaattgacccatttaaagggtaccatttaatgattttcagattattcccagagttgtgcaaccatccccaaaatcaattttagaatattttaatcgactcaaaaggaatcccacactccttcaccatcatttccaacactgttcctcctccttcccacccatcaatttcctttctgcctctatggatttgccgattctggacatttcatataaatggaatcacataatatgtggtcctttgtggcacttagcgtgttttcaatgctcatccatgttgtagcatgtgttgatacttcattcaatttttttttttaaagagacggggtctcactattttgtccaggctggtctcaaactcctggactcaagtgatctgcctgcctcggcctcccaaagtgtcaggattacaggcgtgagccattgcacccggctgatacttcattcctttttacggctgagtagtactccattgcatggatagaccacttttttctatccattcatccattgatggacattggggttgtttctcttttttggctatcatgaataatgccacatgaacatttgtgtacaaggttttatgtggatatatattctcctttctctcgaatatgtacctaagagtaaaaattgctaggtcatatgttaactatgtttcacctttggggggaatgtggagctgaatttcacagcagctgcagttttttacattcctatcagcagagtatgagggatccaatttctccacatcctcaccaacgcttgttatcgtctgtctttttgggttttgttgttgtcattttgtttttgtctttgagatgaagtcttgctctgttgcccaggctggagtgcagtggcgcaatcttggctcactgcaacctccacctccccggttcaagcgattctcctgcctcagcctcatgagtagctgggattacaggtgtgcgtcaccactcctcactaatttttgtatttttagtagagatgaggtttcgccatgtaggccaggctggtctcaaactcctgacctcaagtgatccgcccaccttggcctcccaaagtgctgggattacaggcatgagccgccacgcccggctgattgtctgtcttttttattatagccatgctagtgggtgtgaagtggtagttcattgtggttgtgatttgaatttccctgatggtgagtgcctcttattctctgtgctgattgataatgatgatgaaggcaatttgtatctatagagtggcagtgtagtttactaagagttagggtaacttatttcatagtactggctatgtcttctgggccaagtcattaacttctctgagcctcagtttctgcatctgttcatagggttgtggcaattaaccaaaaaaaaaaggcatgaacagcccttatcatgatgactgacataggataagagctccataactagtatctatttttaaaaataatctttttaagtctgggagtggtggctcacacctgtaatcccaacactttgggaggccgaggcgggtggatcacgaagtcaggagtttgagaccagcctggccaatatggtgaaaccccatctctactaaaaatacaaaaattagtggggagtggtggtgcacacctgtaatcccagctactagggaggctgaggcaggagaatcgcttgaacccggaggcggaggttgcagtgagccgagatcaagccactgcactccagcctgggtgacagagcaagactccatctcaaaataataataatagtaataatttttttgattatataatagtatatatgtatataaaatacatgtatgtatttttatctatatcctctgctctgaccctcaaagtaaccacgtccaagttcaggatttgaaatctggaaacgtggattcaaaaatccttcacctctttgagccttggtttcatcatctgtaaaatggggagaattgttgataggaatattaaatgaactaataaatgcaaagctgtttgagaaatatatggcatatagtaatccctgattaagtgttagttcttattattaataatgctattattaggattattattattcgattcatatgtttactgttcaacaaatattgaatgataaacatatatgctgggtccggcatggtggcccatgcctgtaattccagcactttgggaggccaaggcgggcaggtcacttgaggtcaagagtttgagaccagcctggccaacgtggtggaaactccgtctgtgctaaaaatacaaaaattagccgggcatggtggtgggtgcctgtaatcccagctactcgggaggctgagacaggagaatcacttgaacccaggaggtggaggttgcagtgagccaagattgcaccactgcactccagcctgagccacagagcaagactctgtctcaaaaaaaaaaaaaaaaaaaaaaaaaaaatatatatatatatatatatatatatatatatagtatttttagtagagatggggttttgccatctcttatatatttttatatatttatattttttatatatttatatatatttatatgtattttatatatttatatatatgtgctgaaatctaaaataagacatatcacttaaaccagctatcacaggaccaatggtaaagagcataattagtaaatgcccccttctgcattaatacgtagattgtatgtcacaatttcatgtagcaggtgatggggcttcctgacattcttgggcccagcatacaatctttttatttcttttttagagacagggtctcattgtgttgccctaggctggagtgcagtgtcattatcacagctcgccacagcctcaacttctcaggctcaagtgatcctcccgcctcatcctcccaagtagctgggaccataggcacacgccatgatgtctgactaattttttatttttttttgtggagatgggggtctccctatgttgctcaggctagtctcaaactcctggactcaagtgatcctcctgctttggcctcccaaagtgctgggattataggcatgagccactttgtctggcctacaattccttttctttctttctttcttttttttttttttttttgagttgagtctcactctgtcacctaggctgtagtgcagtggtgtgatctcagctcactgcaacctatacctcccaggcccaagcaatcctcccacctcaacctcccgagtagctgggaccacaggtgtacaccaccacgcccagctaattttttgtatttttggtagagacagggtttcaccatagttgtccaggctggtcttgaactcctgagctcaagcaatccacccgccttggcctcccaaagtgctgggattacaggtgtgggtcaccatgcccagccttcaatttcttcagattattgtataataataaaatttctaaaaacagattactatgagaacaccttgtaatgataaatatttttctttcacatggtgaaatcataacttacatgtatttaactccctcaaattcagttatacatgttccatggggacatggagagagagagaacaatataaataatgcaatgattcagcaaccgggttcgctggagtaggtgtgagatgggatactggcatctggtgttccctccgtcaatctctgttcccacgtgctttttagcgagcatcttgctgctctacttattaatctaggtacatatttttcagccacatgacccctaaaataagtcaactccttcaccttcacctggagcaaaactgtaaaaacagcaacttgttctagatctggaggcaaaattggttccagcagacccactgggaagtgggaggtgtttgctatgctttgtggacaatttaagtgtttaaaaggcaattttgatgagccatgattttcatcttaagtgccaactttagaagataaccttcatataaaagtttctctacagtttgtattttaaaatataaaatggaagaaaaaactatcaccagctttgcttttttcctcttggttaatggactatctattaacgtctcactaaatggccaaatggagtctcacagtacacagtttgggaaatgctgccttaagttgctctgtgaagccttaagttcgtgtaaccatgacttagccatctgtgaaatgggtagacccatggggcataggaattggggaatgtattttgcatcaagtaggactggtgtggaccacaggtggaaatccagacaggctcgagcaatgttcaggatacagcagcaagtgacaggttctggccagctgtccctactggggctgcaaggactaagagccaggataaggagacagggcctcggttattgaaaatgggatacaaagcagggactggttatggcggaaattaaccaagaggctgttcagcttcttctattctcacaaccaattcagatctggattcaaaggcagggatgcagctacaagaggagtttgtgttggaggtctgtgtagataggatgctaagcaggtctgtgtcagccaggatcgtttgggcagtaagtgacagaaacccaacttacgttaaccacaaagcctcaaaggggaatttattggatcatgtaactggccagttgaagagatggtgctgtcctcggacgtggatgaagataagagttcaaactgtgtcatcaggacggatccgtctccctacatcctggctccatttgcttctatttggcttccttcttgaacaactctgtatgtacaagatatcctcacattctcttcttttaacaacctcagaggagcaaacaagtctttcctgatagctctgctaagaaagtcccaggaaagactctgattgatcagatgtgagttacagatccatccctgaaccaatcactgtggccagggccaaggtgtcatcccattggccagcctgggtcatgtgctggctcccgtagcaggaagtagggagaagacgagggagccgtgtgagccctacgtgaaccacatccagtggattttccttaggaaggaagattctgtgaccagaccaaatggaaaaggaagtggggagggtaggcagacaaaaatcggtgatctattacaaggtctttccaaaagccagaaattagggatttctaagtgtacctctctagtcctggcttgtctcagccctgcagctgggctgtggagactccatcagcaattgctgaccccctattcttacctcggccccttcctgagtcccaccaggagccctgctcctcatctgggacatgcttcttggcccatggaggttgacagctcaccttggtactttactactatttggtttctgtgaccaccaagctgttgcttaaaccaagccgcctatggtggcaccactttggagaattcttttttattttttgagacaggttctcactctggttaccgagactggagtgcagtggtatgatcttggctcactgcagcctcgacctcccgggttcaggtgattttcccacctcagcctccccagtagctgggactattggtgcatgccactacacccggctcatttttgtatttttagtagagacggggttttgccatgttggccgggctggtcttgaactcctgacctcaggtgatctgcccgcctcggcctgtcaaagtgctgaaattacaggcgtgagccaccgcacccggctggataattctttagattttattccaagtgggttgagaagccatgggaagattgtaagcaaaggaataaaagttggttgcattctctttggaggatttccctcttccctggagaccagtcctcacagaagcttttccaatggccacagaagactaaggaagattgagagaggcacaggaaacaattccactcagagctgctgcttcgccactgcccagtcagcctccactggcgccaacatgagcctatgctgtcattcctgggcccaggctggctgtcgctgtggagatggtgctgctgtgctagtttgtggctgttaaaatggagctcctggctggacacctgtttcccagtgggtggccacaaacctgtgagtctgggcctcctccagctgagtagaagtgagcccagcacagaggccggggaggccccagacgccaggaggagcaaatccaaatccaacccaagcatggcccctctgaccctgaccatctttttttttttttttttttgagacagagtctccctctgtcacccagactggagtgcagtggcacgatcttggctcattgcaacccccacctcctgggttcatgcgattctcctgcctcagcctccctagtagggactacaggcatgcaccactacacccagataatgtctgtatttttagtagagatggggttctgctatgttggctaggctggtctcgaactcctggcctcaagcgatccgtccgtcttggcttcccaaaatgctgagattacaggtgtgagccactgcgcccagcctgcccctgactgtcttcagaaaagtagaagcaggaggtctgccacattctcatcccacccttgacacctgggtgatgtgctagagcttgaggggaaggtcagaggtaacccagttcgggaagtgaccccgtaggaggagaagaatccagccatgtgacacacagtacgaagagaacagtaaatgcaaagacctggaaacaagaggaacagcaaggacagcatgtcccagaacctggggagagaggagggagcagccggagctgagggcagctcaggggaagagttgctatttgattttcagtgcatgggaagccactgaaaagttttatgcagagaagtaaaaccatctcactcatgtttctagaagccttatgggccactgtgcagagcatagagtgtggtgggacaagaatgacggtgaggaaccagtgagaaggttcctggagtcaccagatgcgaggagatagaggcttgggctagaatgggctggcggagctggagagaggtggacaaagctgagatgtgttttggaggcagaaatgatagatttgctaggaggtgaaagatggctctagattcctgaggaacgatgatgccttttaccaacctgaagaagaccaaggagaggcttgaggactaacacggaactgtgaaggaggccaggcaaaggtggagactgccgtgagctgtgatcacgccactgcaccctcgcctgggtgacagactgagaacctgtcttaaaatatatatgtaataaaaaataataaataaagggccaggcgtggtggctcaacgcctgtaatcccaacactgggaggctgaagcaggtggatcacctgaggtcagaagttcaagaccagcctggtcaacatggcgaaatcccatctctactaaaaatacaaaaattagccagacatggtggcacatgcctgtaatcccagctacttgggaggctgaggcaggagaatcacttgaacctgggaggcagaggttgcagtgagcctaaatcacaccactgcactccagcctgggcaacagagtgagaccccataaataaataaataaatacataaataaaggatatcaggcaagcaattaaaacacctgcctactaccatctatccgcatcctttttttcatgtctaacaccaaaacaccaaaatagctggaaacatatcatgtcaaaagataagcatgattctttcaaatgaatggctgtggacttatgaaaagctgcctccgcatctgattttcttgtttcaaggggtaatgatggaggtttctctcctgcacctgcaggcctccggggatgctgccccagtgcagcctcccaccctgggctggagcctcccagccccgctgcatgggtagcacagtgttgggaagaggaaggagcagtttgtctggctttttcacaggcccacagctggccggtacagtggcagagaaggcgaggctgaggtggggctggggaagccagcaggggcctgatcatggagcgccttgagctgcatcccacaggtactgagaaagcatggagagctgtcccccagcccccagcatcttattagaaaatattgaaacataacagaaaacatgaagggttttatgttcatattttcattttagagagatcattctgcttgaaatataacacctactgagtactgctgaggacttagcatgtgccgggttctgttcttagcatgtgacatgtattggcctatttgattctcctacataatcctggaagattggttgtgggagtgggtgatcatgacctgaacagcctaaccatgtttagggaacactctgtgttatgcgttccaccacacaatccatgtcacagctgaatgtcccagtttcccttgcagctaggacacaacaggagacccaagctttccaaacatatgccccaggcaacactttgatacacaaggaataacactggatgctgggtgtgcacagaattcaaattcaggaatggagggaagtactgccctttgacccatacaataggggatccccttccttggaccccatggcttagagggccccactctgtccctctgcagactgtgagctgccctatggaatgaggggtgtctgaggctgtattagtttctatttgttacacagcagtggaaactaatacagtcccacaggcctaaatcaaggcgtcagcaggctgagttcctgcctggagactctggggaaaattcacttccaaactcatttttgttgttggcaaaattcaatcccttgaggctgcaggactgggctctgctcctcactggctgtcagcctggggccactctcagattctgaagtcctcccacattccctgccacatggtcctctccatctccaagcctgctatgacacaacgcattgttctcatgcttcaaatctctgacttctctcccgggaccagaagaagaatactctcttcttttaaggggctcatgtgattgggtcaggtcaactctatcatatcatggagtctcaccgtcttgcccaggtgggtcttgaacacctgggctcaagtgatcctcctgcgttggcctcccaaagtgctgggattacaggcgggaactgctgtgcccagccaaggccagcatcttcagacttctctgccctgttttcacatggtcttctcctctttgtgtgtgtgtcaaatctccttctgcctctcttataaggacgcgtgtaatagcactcagggcccacctggatgacacagggtcatctcgccatctcaaaatcgttaactttggccaggtgcagtggctcatgcctgtaatctcagcactttgggaggctgagacaggtggatcacttgaggtcaggagttcaagaccagcctggccagcatggtgaaaccctgtctctactaaaaatacaaaagttagctgggcgcgcacctgtagtcccagctactcaggagactgaggcaaaagaatctctagaacctgggaggcagagactgcagtgagccaagattatgccactgcacttccagcctgggggacagagtgagacttcatctcaaaaaaaaaaaaaagatgactgggcacggtggctcacatctgtaatcccagcatttgggaggcccaggtgggcagatcacctgggttcaggagttcattcgagaccagcctggccaacatggtgaaagtctctctctactaaaaaaaaaaaaaaatacaaaaattacccagatgtggtggcaggtgcctgtaatcccagctacttggcaggccgaggcaggagaatcacttaaacctgggaggcagagggtgcagtgagctgagatcactctgctgcactccagcctggacgacagagcgaaactccatctcagaaaaacaaattaaccaggcatggtgctgcgtgcctgtagtcccagctactgggaaggctgaggtgggaggattgcttgatcctgggaggttgaggctgcagtgagctgtgtttgtgccactgcactccagcctgggcgacagagtgagaccctatctgaaaaaaaaaaaatcggccaggcgcggtggctcacgtctgtaatcccagaactctgggagactgaggtgggtggatcacctgaggtcaggagttcgagaccagcctgaccaacagggtgaaaccccgtctctactaaaaatacaaaaattagctgggcatggtggcaggcacctatataatcccagctactcgggaggctgaggcaggagaatcgcttgaactcaggaggcagaggttgcagtgagccgaggtcatggcattgcactccagcctggtggcagagtgagactccgtctcaaaaaaaagaaagtctctttttacaacttttttgaggtataacttacatatcagaaaatcaccggttttaaatatacatttcaatgacttttagtaaatttcccaagttgtgcaaccatcatcacaatccagtttcagaacatttcatcagcccagtaagagccctcacacccattaacagtcactccccactcccacttcctcctggtggttgctcaacccaggtaaccatgaatctattctctgcctctggagatttgtcttttctggacaatctttcttcttaaactcagcagagtgagttctgttgtttagaactagaaaccctgcccaatagaatactaatatcctcttgttttgcaagggagttagagtctcgctctgtcgcccaggctggagtgcagtggtatgatctcgcctcacttcgacctctaccttccggattcaagcgattctcctacctcagcttcctgagtagctgggattacagacgtgcaccaacacacctggctaatttttgtacttttagtagagatggggtctcaccatgttggccaagctggtcttgaactcctgacttcaaatgggccacccgccttggcctcccaaagttctgggattacaggcatgagccactgcacccagccctaatatcctcttattacaaaagaagaaacaatgactcagaaagattaagtcacttacccaaggtcatgtagtcagtaagcaatagagctgagactgaacctcactccaaagtctatgctctcactaaagtattgcagtgtagagagtagaggggacagggtgagactggaggaagggagggcatttaggagactattgggatgtccagatctgagagctgttggcgacctggactggggaggtgatagaggcagaggagagaagtagatgaatttgagcatattaggaagtgaaacagtaggatttggcaactgaacgggtgagtggacaagaaggagaggatgagtcaaagagtgcaccatgcttctggcttgggcaactgatgggtactggaataacttgctgggataggaaatgcaggagaaacagccaatttggggtggaagatgaggtcaggactaaaggcattgagtttgaggtgtctatggaatgtacaaatggagatgttgaatggatggttggatatacgaatctgcagctgagatgtaggtttctatatcaccagcatatagacggcaaccagaaccctggaagaaggtgcaaccgaccagcaagagaagatgtagatgagaaagcaaaagggcctagaacacgccccaaaggagtgctaacctttaaggcgtgggagcgcagaagtccccaaaagattctgaggagtagccacggcgatccagtgaaagtcaggcacaagtggactcctgcaagctaagggaaggaggcgagggaagtggggcatggtcacagtcagtgtcaactgctgctgagagttccaggaaggtcaggtccatggtgtatctattggatttagtgacaacgacattgttgtttacttggcaagagaggctttagagaagggatgggggtgggagccagactagagtgggtagaggagtgagtgaatcaagatgcggaagtggatgtgatgactcgccctttctttcttctttctttcttttttttttttttgagatgcagtcttcctctgtcgcccaggctggagtgcgatggtgtgatctccactcaccacaacctctgcctcctgggttcaagtgattctcctgcctcagccttccaagtagctgggattacaggcatgtgccaccacacccgcctaattttttgtatttttagtagagacggggtttcaccatgttggccaggctggtctcaaactcctgacctcttgatccacctgcctcagcctcccaaagtgctgggattacaggcgtgagccaccgtacccggcctggtgactcactctttcaagggactcagctataaagaagagaggcatggagtggtggtaggatggattaagctggggaggggaggcatttttaagatgagaaatgatgtttaaatgcagatggaaatgggacaggagagaaacggaagttgatgggataaatgaaaattatcatcatcatcttcctcaccatcaccagcagcaaccacaaggaaagctcgttctgctctgggactgccctgttagacatttcttccttatactgagccacaatctatctccctgtaactttcgcctttggttagagttctgccttgtgtccctcttctactcttcaaatggctgcacgctgctactatgtctgtcctcttcttcaaactcacagcccccatcctacgggccctgtgctcccagcctggtgacccgaccctctactgtcccagccaagttcacatgaccatcctcttatttgtcaagcctctctttttttttttttttttttttttttttttgaggagtcttactctgtcccaggctggagggcatggcacaatctcagctcactgcaacctctgcctcctggtttcaagtgattctcctgcctcagcctcctgaatgctgggattacaggcatacatcgccatgcctggttaatttttgtatttttagtagagacggggtttcaccatgttggccaggctggtcttgaactcctgacctccagtgatccccctgcctcagcttcccaaagtgctgggattacagcgtgagccactgagccgggccaagcccctctgaagaggcagtgtgcacactcttgctttgctgatagaagcatgaaatggttcaagtttttgtgatttgggaaaatgaactcagctataaaatgtgcacacccagaagttgtcctatggacttaatgtcttaggggtgagaagaagcttgtgcagggattcctggcaacatgaatgcgggatggacagacagtgagcacagtgttgaggagcacagcctgagtgcatctccctgagatcaggaacaggacaaggatgcccgctttcaccgctgctgttcgacattgtactggaagttctagccagagcaattaggcaagaaaaagcaataaaaggcatccagattgtaaaggatgaagtaaaactatctttagtcacaggtggcacaatcccatatagggagaatcccaaagaattcacaagaaaactgttagagcaaataaactaattcagtcaagttgcaaggaacaagatcaaccacaaaaattaattgtgtgggttttttttacaccagcaatgaacatttgaaaaggaaattcgaaaaagtattccattcactgtagcatttaagaaagctgaggctgtgaagctacatggctgtgtttggagctggtgctgctatttaccatgtgaccttggacaagcttctcacttcattcatgacaccgtttattcagctattaagtgggggtaataatagtaccttccttatagagttggttttttgtttttgtttttgtttttggtgggggagagtaaggattgcaagagttaatatatgttagcaaaatggacttagaagagtggttggcacatggtaaggactatattagggttaccaaaaaatgtttataattgggaaaattgaacaaaggttccagtaaatatccatcccagaggctggttgacaaattatcacaatgtaccttttagcttgaaccatatggaactgcctatattctatagctatggcctacaaaatgcaaaatgggcagttttttttgttgttgtttgtttgtttgtttgtttgtcttgagacagtctcagtctgtcaccaggctgaagtgcagtggcacgatcttggctcactgcaacctctgcctcccaggttcaagcgattctcctgcctcagcctcccaagtagctgggattacaggtgtgcaccaccacgcccagctaatttttgtatttttagtagagatggggtttccaccatgttggccaggcgggtcttgaactcctggcctcaattaatctgcctgcctcggcctcccagagttctgggattacatgagtgagccaccgagcccagccaaaatgggccgtttcatatgttcaatttaaacactaagatactctttagccactgaaaatgactgtgtatcatagatctatctttatcacagatctatctttactgtcatagaaagaactaataacatattattgaacaaaaataacaagttacaaaacagcttgcagccacgtttgtaacatcagtatatctatttgtgtgtctaggtgtggacataaagagatatctagaagacactcccattgcctatgggaatgacttgggctgggatcttttttatttatttatttatttatttatttatttatttatttattttgagacagagtctcactctgtcacccaggctggagtgcaatggcatgatcttggctcactgcaacctccgcctcccaggttcaaacgattctcccacctcagcctcccaagtagctggaattataggcacccatcaccgcacctagctaatttttgcctttttagtagaaatggggtttcgccatgttgcccaggctggtctcaaactcttgatctcaaattatccacctgcctcagcctcccaaagtgctggaattacaggcgtgagtcaccgcacccagctgtgatcttaatttatattttttctttttaacccttgatttttaccctgtttgactgactttaggagtctgacccccaaaactgcaaaagaataaattagtgttgttgaaagccactaagtttgtggtaatttgttagagcaacaaccagaaactaatacaatcgggattaaacttgccctgggggtgctggctctcccccactttcttctcagagcatctcttgggtcctcgccccttgctgagcccccaccatggccgggtggaccagcgatggacctgatcggattctcctcttgggattttaaataagagatgcagaggctgcacgccaagcttctctgtgccgcactgcaggcacagtcctggcgctactgttctttaggggtccatgaagatgtttgttggcctggcttaggtgtgagctaagagatacaagggatacactttggaggctcagccctttgatgttacctttgcgctggaagcccaggggctgtaagacggagaggaactttgctgaaagggaggtcctccctgcagagcttgaagagcaatctaaccatgctggcatggggcccatcccacctgtgatgccagtgtaagtctgtgacagtcactcatattcagagcatgtggattgagactctgaagaacgactttatggtgggcaccttcatctccatctggtgggtccagagcaagcagcctcagggtcccatgggcccaacctcaccctccatccttatttccctgccactccagggctcctcctcagccagacttgcctgtgagtgccccttgatggctgtattagtctgttctcacgctgctaataaagacatacccaagaccaggtaatttataaaggaaagaggtttaatgggcccacagttccacatggctgggaaggcctcacaatcatggcagagggcgaaaggcatgtcttacatggtggcaggcaaaaagtgaatgacaaccaagcaaaagaagaaacctcttataaaaccatcagatcccatgagacttactcactatcacgagaacagtatgggggaaactgcccccatgattcaattatctcccaccaggtccctcccacaacacatggaaattatgggagctataattcaagatgaaatttggatggggacacagccaaaccatatcagtggccctggcttctctcccattagctctgttctacttcccaaaatctttccagctttgttcttttttagagactggagtctcactgtgttgcccaggcttgtcttgaactcctgggctcaagggatcctcctacctcggtctaacaagtagctgcgaatataggtgcacaccaccacacccccacaacttacccatcctccccggctcagtgaaatccctaggtccttcacactcccgttagctccaggtaccagcggctttgccttctacagaatgcataacattatagcctcttagagcaaaaaggtcatggggatggggaaggctgggagttctctcttcattcagggattaaacctaccacctggaggggtgacatggctcaccttagtcaccaagcaaggtcgggagagtatttctgggatggtcattagcactttctttccaaagggaggatactacaaactcactttcatgatcacagtatcccccccgacaggtaaagtgtgcaaactcgctttcattccctttttgtctttgacgcagctctgaagcattttaattcttaaaatttacatgttcatgatgacacagagacaggttttctgtttaggagagggcctgattccattaaggctgatcgatcatatgttgcacattctgggataaatatgagagatcagaattgagcttcccaaatggtgggtcacatgacccagtgttgttccaggagaacgttgcaacatccagcatgagaaagcgctgcatgcaccatgtatgtgttgggatgctgggctgaaatgtattaatgagcaagtgttatcatatttgtctatggaattctatttaatagctatgtctcgtatgtgctgattgggtctcaaatctgggtatcttaccccaacatctttcttgaaaatccttctttttaaataaatgttggccgtgtgcactggcttatgcctgtaatcccaacactttgggaggccaaggcgggtggatcacctgaggtcaggagttcaagaccagcctgaccaacatggagaaaccccatctttactaaaaatacaaaaattagctgggcacgatggtggatgcctgtaatcccagctacttgggaggctgaggcaggagaatcacttgaacctgggaggcggaggttgcagtaagctgagatcgcgccattgcactccagccttggcaacagagtgagactccgtctcaaataagtaataaataaatgttatagaaatactaaagtgtattgtgcataatataacacccacgtaccaccatccaacttaagaaataaagcattactaatccagttttgctccctgcaaactcatccttcatcccattctctttccttttgctttataaacatcctgcagccaggcacagtggctgcacctgcagcctgagctacttgggaggctgagatgggaggatcacttgagcccaggagtttgtggctgtcgtgtgctgattgcacctgtgaaatagccactgtgttccagcatgggcaacatagcaagactccatctctaaatgaaatccttttttttttttttctttttgagacagagtctcactctatcacccaggctggagtgcagtggcgccatctcggctcactgcaacctccgtctccagggttcctgcctcagcctccggagtagctgggactacaggcacatgccaccacaactggctaatttttgtatttttagtagagacggggtttggccaggttggtttcgaacccaggacctcagatgatccacctgcctcggcctcccaaagattacaggcatgagccaccatgcccagcctaaaagaaatcctgaatttgacatttttaattcccttgtttgttttaatatttctacagcacatatatgtctacatatataaaaaatataattttttattggggtgaaattcacataacgtaaaattaaccactgtaaacatgaacaattcagtggcatttaggacattcatagtactgtgcaaccaccacctctatctagctccagaacattttcatcaccccaaaaggacactccatgccccccaggagtcactccccatttcttcccactctgtcccctgcaacgaccaatctactctctgtctctgtggattcacctattctggatatttcatataaatggaatcatacaatatgtggccttttgtgactggtctctttgacttagctgggtgtggtggcacgagctacccacctacttgggaggctgaggcaggagaatcgcttgaactccagccataaattatattgttttcaaggttcatcaatattactcgcccaggctggagtgcagtaatgtgaccttggccccctgcaacctccacctccccggttcaaaggattctcctgcctcaccctcccgagtagttgggattacaggcgcacaccaccacacccggctaattttttgtatttttagtagagagagggtttcaccatgttggtcatgctggtcctgaactcctaatctcaagtgatccacccaccttggcctcccaaaatgctgagattacaggtgtgagacactatgtcaggcctagtcaattcattttcactgctgcaaagcatctcattttaaaaaattattttattattatttttttgagacagggtctcactctgttgcccaggctggagtacaggggtgcaatcacagcttactatagccttgacctcccgggcccaagcaatcctcccactgtggcctccagagtagctgggactacaggcatgtgccaccacacacagctaatttttgttctttgttttttgttttgttttgttttgttttttgagatggagctttgttcttgttgcccaggctggagtgcagtggcgcgatctcagctcaccacaacctccatctcccaggttcaagcgattctcctgcctcagcctcccgaataggtgggattacaggctcacgccaccgtacccagttaatttttatttttagtagagatgaggtttcaccatattggccaggatggcctcaaactcctgacctcaggtgatccatccgccttggcatcccaaagttctgggattacaggcgtgagccactgtgcctggctcaaagcatctcattgtatgaatccaacaatttatttatccattcgttgtttgagtacatgtaggttatttcctgctttccctcttacaagcaatgctgcagaaacattcttgtccatagctcctccggcacatgtacaagagcttctctagggcacaaatgtaagagttttattgctgggccatggggaatgctcttcttcaaatgtacttgctattgtcaaatctgagctatcttttcaggagcctactactggttctcagccctggctatgcattagaatcacttgggaactttaaaaaaatatgtgggtatctggataactcccccgacccgtggaatcctagtctccagggatgggactggggacttgaaagctccctgggtgattacacagccaaggtggagaacagctgggactgagtcttggcccactctgtctcagcttcccaaggtcagctcatagagggcagccatcatcttagacttgctaatatcactcagcagctgagcagatagaagggactaaataaataaagtctgaatgagtaaataaagcatttaaaacaaaccctttagggctgggtgtggtggctcacacctgtaatcccagcactttgggaggccaaggtgggtggatcccttgaggttgggcattcaagaccagcctgaccaacatggcgaaaccttgtctctactaaaaatacaaaaattagcaaagtgtggtggtacgcgcctgtaatcccagctactcggaaggctgaggcaggagaatcacttgaacccggcaggcagaagttgcagtgagctgagatggagtcactgcactccagcccgggctacagagcaagactccatctcaaaaaaacataataaaacaaaccctttaggctgggtgcggtggcgcatgccggtaatcctggtaactatctcctactgttgtgacgattaaaggagatggtgcatgcagagtacttggcacatatgaagtgctcaataaagagtaactcctgcagcctggtgtggtggcccacacctgtaaccacaacatgttgggaggctcaacatgttggcaggaggattgcttgaggccaagggtttgagaccagcctgggcaacataaagagacccccgtctctataaaaaataataaaaactagctgagcatggtgatacatgcctgtagttccagctactcaggaggctgaggtgggaggatcaacttgagctcgggagttggaggctgcagtgagctacgatcacgccactgccctccagcctgggcaacagagcaaggccctttctctggaataaaaaaaaaagagaggctgggcgcagtggctcacacctgtaatcccagctacttgggaggctgaggcaggagaatcacttgaacctgggaggtggaagttgcagtgagccaagatcgcaccattgcactccagtctgggcaacaagagcaaaactctgtttcaaaaaaaaaaaaagagagagagagagagtagctgccattttcaatgttattgataaagcaggtgggtgtttctgaaaatgcaccagatgcagccttagactggaaggtgctgatgtgttactgagcctccagacaaagctggcgaacccaccggggcgagactttatgacttgagaagctgtcctatctatgagggtccatgttagggaatattaaagaataggattgggggcagtagctttcctgtagcaagtgctagctatgtgccagatactgggcaaaggagtctgcagacgtctctcatttcatcctcacaatccatgaggcaggtatgactattcttcccattatccagagagggaaaacaagtcacacggaagcaagtcacgcagcagagctaggattggaacagaagtgcctgcatcctccaacgcctgcatcccaacccgctgtgctatgcctcccgttgatgctttcccatgtctgccatttagctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggtgagcacctcgtagcattctcccaggctcgtcgctggtcaccgtcgccagggcctagctcccttcccctaggatctacagcctcactccagaaaaaacgctggtcctattttaaaagctctgtgaacatcccaactgagaaaacctaaaaattgcaaaactgggtgagatccaggagatgattctttgctttatcaagtcctacagggtttctcaaaatagcctcatgtcctggtgcattgaaaacaggatttgattcactcgcgcttgatttacccgcagctttttagacgcacagccaccaagccagcaaggtctgccgagattcagaaggacagagaactttctaccaaagagcaccagcccttctagattgtgtagcatttcatcaacaaaaatgactccaggagaccattcttgggtacatttttccacaaagaaaggatgtaaatgacaaaaagaagaaaggcatcggtcactgagagaaggcgtgtgacttctagatttgcaagcagggaaaatgaaagcagaattgccaaaaaagagaaattaaagtagggttgaggagtccaaaaaacagataagggggcgagagggacaaaggggcacgtttgcggcttggggagctaaaatgctttgcaaagacccatgaagcccaagctgctgtttgtttctaacagtgggtcattaaaatcctgtgattgctcaggtggtgggatgccctagtgccctttcattaaagtctgggaaaatctgaacagtgttgtgatgaaggctgctcccctaccctcgcctccccaggtctcctgagtttcaatttaatgagatttttactgcgtaaaaaaaaaacaaaaacaaaaacaaaaacatgaaaaggctgcttttgagactgcattggtaaatgactcttcaacccattcaaacgctccttcactctccctcagctcagcagggctgctcgtccagctttgatattaagcccttggcatattccaagttgcccacagatcctgatttctagaagcttagaaaagtggagaggttcgcccagcaagctggattattataattaagtagttctcttttcaaaggccttgcattttcttagcctctccttctccacaggggaactctttcttcgtgatgacaaactttctcaaaacagaaggccaagagcagcggttgtgtcccgaggtaaggaggggacctggagtggtgggtcaggtcttaagagttcctgggggaggtgcaagtcggaagaagcagaaatgcggaccctggggtgtatttgagcccacagatatctactgagcacctgcctcttttgtggggtagggctgggctgagtggaggaagggagagaacacatggcagtgtctctccatggccaccagatctttgtctgcctgcctcggtctctggttctagcactagggacccgtgcagacggcaaccctgctctttctatctctggctctcttcgcagcttatgacaatggtgattcttggcatttgcacaacatttcacattttacttgaggctcacaatgactttaggagaaaaatggcattttacaaaccagaacacagattcagagatgttgtgacttcccccagggtcacacagcttgctgcaggcagagccagggttaggacctgagtgtcctcactcacagcttctcctaccatggttcacagtgaactgtctgcagggctggtcttggaaaaccctggcacacagctctcttgctcattcatccacttcttagagtctcagcctctccatcacgtgcatgtgcccccatgactccctgccaccaccccagacaatctttcccaacttggctttgctctctccaaagagccgcctctttctggaagagcttcttccctatcaaatcatatttgttttattctgggctaggcatggtggctcacacctataatctcagcactttgggaggccaaggcaggaggatcactggagcccaggagttcaagaccagcctgggcaacatagtgagaccttgtctctaaaaacaaaacaaaacaaaaactgtatttgtcctattctttacctcaccatcctgctctctcctcttaaaccagcttttcttctaagtttatctataccagcgtgttactgctaggcattacctgtaactcccaacctcccagcctcccctctcaggtaacgtaactgtgctgtaccagggaccatttccaacactgaccgttgcagcagcgctggtgatacccagccagatcctccactgatgagcaggaccagccctgccggtggagttttgctcacgggcccactctggcaacaaggtctagcttcctgagtgtccaggacctctgggcaaaagtgctgtctttgagtacagtctttgccatcatttgtacccaaattcagaaccaagataacattcccttggtgtctatcttgataacactccgtctaaaaggagagctttctacatttgttttgtcctcatcaccccttaactgtccctgctgctcagatgaaatctctgacagccaggccagccaagccctcccttctgtctcccttcccagcagtgttccgtctccaatccagtttgggggcctgtttcccttttgtcccatcctttggtcatctctacaccacactctacctccatgtacacataaagacacttttggacttattgagacttggaagaaaaagagttaggatagcccagagattaagagcctgggctcagaagctagaccgctaaaggttcaaaacttaaacttcttaactctgtgacctcaggcaggtgactcttcacctctctgtgccaagttgtgtgcatctgtaaaatggggctgagaacaaaacctagctgttcggattattgaaacaaatgagtgaatacctgtgacacgcttaaaacaaggcatggtacattataagcactcaatgaatgtcagttgttatgattcaaatgacatgttactcctcagataggatgtcactcagagtgactggaacccaacaggttccatcgaagcacttccagcccagagagcacatgtgactctttgggattttaacttatgctccaggctggtttgggctggtctaattgggcatttgcctcctctctgcccatcaacacccctctatctcgggttgtctcggtaaatatgaccaagttccagttacacaccaacatgaatagatatttgctccatttatctgtggctgcaaaacaaactaccctgatcatggtgggcttaacacaagcattttattaactctcacagttcagtggttgactgagttcagctggttggttcttctgctggtctcactagggatctctcaaggagctgcagtcagatggcagctggggttggcatcccttggagcctcaattggcacccagggatagctagacatctcttcctctctgggaacccctaagagttaccctctcttcaaggtctgtccgcattgtctctccagcagggtagtcaaactttctaatagtggctcaggttcctcaaaacaaaacaaaaaaatagaagcttccaggccttcttaaggcttaggcctggaactggcaacagcattccttctgctgcttctattggctttgcagtcacagcacaggctcagcttcagaaagtaggggaaacactccacctctcaatggagaaagtgaccaagaatttgtggccatctttaatccatgcaacaatcacaaaagagaagattaaaacaaaactaatgtgctgttttttaaaaaaaaaattagaattccttttggagagcaaaataaaactgatttctcttctttcctgagattcatctccagttgataatgaaaatgtaactttccatgagccacaatgaatgatcacacattcattccttccatgactatcaagacctactatttgccaggcacttgggctgcaaagatatgaccttggctctgtattcaaagggttcataatctaatctggggagtcacaaggggaggagaccaacggcatgccatgtgacaaggcagcctgggaaataaagagatcatgagagagtttgaaaactacaagaaacattcattgagcatgtactatgtgctaaaccctttcttttcataactcacttaatcttcacaacaaccaggcaagacaatttgttggctgggcatgatggctcacgcctataatcccagcactttgggaggtcgaggcaggcagatcatgaggtcaggagttcaagaccagcctggccaagatggggaaacaccgtctctactaaaaatacaaaaattagccaggcatggtggtgcgtgcctgtaatcccagctactcaggaggctgaggcaggagaattgcctgaactcaggaggtggaggttacagtgagccaagatcacaccattgcactctagcctggtcgacagagcaagactctgtctccaaaaaaaaaaaaaaaaaaaaaaagacaaatctgttcaccctgcttttacagatgaacagtgagctggccaaggtctctcagctagaaaatggtgcagctactgctgaaccagatatacctgggtccaagacctaggtccttgacctgaatcactgtagaagccacaaattgcacagatgacaaagagcagaggccattttcacacctatgtcatgttctggcttccccaagactggccatgaagcctgctccctagaaaacaggaagagaaatatgcataaaccagggcagctcatttctctcttccgtgttctgtccttcagccctgagacccagctggtctcattttcttgggccaggcgagtgtcctggccaatgtctctcagttccatgtgtcctgctgagtctccgcacctgtttgccctgctcagtcctttcagccacagggccacttggaccaagccacctgtcccccatcccagccagcatccctgaaagtgatccctagcttcccagacctctgcttttcccatttttatttatttgtattgggatataattcacataccataaaccccaccattttaaagtgtacatacggttcagtggtttttagtataatcacagagttgtgcaaccatcaccaccgtctaattccagaatattttcttccttctttctttctttttttttcctttctttctttctttttctttctttcttccttccttcctttctttctttttttaggtggagttttgctcttgtcacccaggctggagtgcagtgacgcaatctcagctcactgcaacctccacctcccaggttcaagtgattctcctgcctcagcccccctagtagctgggattacaggcgcacaccaccacatctgataatttttgtatttttagtagagacggggtttcaccatgttgagcaggctggtctcagactcctgacctcaggtgatctgcccgccttggcctcccaaagtgctgggattacaggcgtgataagccacggcgcccagcccccagaacattttcatcacctacaaaggaaaccccaaatccagtagcagtcactccccattctccccttcccctgtccctggccacagtctactttctgtctctatagatgcctattctggacatttcctataaatagaattgtatatggtgtggccttttgtgtctgtcttctttcactcagcatcatgttctccaggtccatccatgttgtagcctgtgtcattgcttcatccttcttatggctaaataagattctgtgtatgaatgtaccacattttatttgtccattcatccgtcagtggccacttgcgtggtttccacttttttggcgattctgagtagtgctgctataagcattcgtgtgcacattctggtggatatcgaatcacttctccacgtcttagtaacacacgtcacttactccccactctgtcatccttctatctgcagtatcccacccgcaggacgctctgttcctctgaccgaggttgtaaaaagggatggatggacccgcagagcaaaggtaccttctgtttcttttcccgagaccctaggggtggatggtctggcatcttggtgacatttgtgatgcccaggtcaggtcttcagcctctgctctcagctgccctcttccaccatcaccaagccataggcgagtctgcccatgcttcggctctgtccccagcagaccagctgctgactgtaaacatgactccagttttccagtgagagaagaagctcctaaaaacctagcaggttcaggattctaatcggtagaaaattcacatggcctatagcatcatctgagtattctaaactttccccctgaatttcctcaaaggttgaggaccatgaacttttacccccagggaacctggcagcaatacccatattaacctgcagaattttttttgttttttattttattttattttttaaacattttttgcactgttttattttgattttgattttgattttatttatatctaagtgcagtgctattgcgatacctgcagaatttctttatctcacattttaacttaaaaaggcacagggcagcgagcgcagaggctggtgcctgtaatcccagcactttgggagggtgaggcagatggatgcttgaggtcaggggttcgagaacagcctggaaaacatggtgaaaccccgtctctactaaaaatacaaaaatcagccagacatggtggcacacgcttataatcccagctacttgggaggctgagacgtgagaatcacttgaacctggaaggcagaggttgcagtgagccaagatcatgccactgcactccagcatgggtgacagagcgagacccctttaaaaaaaaaaaaaaaggcacagggcaattttaaaaatactgcaaatagtaaaaaaaaaaaaatcagtggttataatgcaaacacacacaaaaaggcatatgcccattactgcattctactccatactgtatgtgtatttgagttagtataaaagttattttaacattgctcactatttaattaattctcccttggaaactgattaatcatcctggcactccaggaagatgtgccatgctgatttcatggctttgcacatcctgggcaggctgtgtaccccttgagggacttgtgcccctttgagaggccatgttctagtccatttatactaagtgagagcatacacctgttccgctcccctcatgggcaccttttcttataaagaaacaaaagagccagcagaatccacagtctttctgtgttctctctgatctttattatgttttgcttgtttgccttgccttgtgttcgttgtggttaggatgggcttgatggaagctgaagctgcgtgggttggaaagcctggtcaaagcctagtctctcgcccgggttgagttaatgatgtccctcctggagaacgtcctctccgcagttctttcacatctgtggttctacgatgctttgacccctataggaattcagaccggaaggtgtgtagtgtatgaagggaaccagaagacctgtgaagtctctgcctggtgccccatcgaggcagtggaagaggccccccggtgagtcgcatggggagacagacacagtggccctcagcggcgaccagatgaggccttgccgaggctgcttgggccttcccctctcagcacagccctgcaaagtcctgggtcctaccggcttggggacccctgcgctctggatgcactgcttggcacaaactagtatctctgggagggccatggtggttggtaaactgttgtaacactcctgtaccaactggtaaatagctactaccctgagcatccttgggtgtccctggccccttccttcccccagatcttccagggtacccccagaccccctcctgtagtgccacagcaggatcccttctgacttgtcagtgtccatactgagtgatcaaggataggaaggaaggagggagatggaagggaaggacgaagcgaggaaagagaaggggaaggggaggaaaaagcaaaaggggtgagggtaaaagagggggggaaggaagttttctcagattaaatgcttacaatgacatacagatttggtggtcccttgtattgatgcttcgcttcaatacacaaagtcacaatgttaaatctcagaagccacaagggctgatgtatttcagcagagaatagttagaaagacctggattcaattcctagctctaacaccattttgctgtgtgtccttgggaaaatggcttaacctctctgagtttcagtgtcctcacctgtaaaagcagaataataatttcaccaacttcatagggctgttgtaaggattaaatgagatgatacttgtacagttattgtaaggtaagccccatgcatgcctggcttacacacacacacacacacacacacacacacgcacacacacacacacacacaatctacccctagaagtgtggtggttctagaccagcactgtccaattgaacttgatgcagtgatggaaatttctgtatctgtgctgtccaatagggcagctactaggtacatgtggctattgagtacatgaaatgcgactactgaatttttgaaagagatgatagatgatagatagaaagatagatagatagataaatagataatagatagatagacaggtagatagatagatagatagatagatagatagatagatagatagatagatagagttttgctatgttgcccaggctggttttgaactcctgggctcaagcgatcctcctgccttggcctcccaaagtgctggggttacaggtttgagccattgctcccagcctgaatttttaattaaatttaaatttaaatagccacacatgtctagtggctaccatattggacagcgcagttctagaccgatgtgattcaggatcattccctcagcatcgtggggcaaagagaaaactgccccaagctggcctgtagaaggctcaggcgaaggtttcccaatgccgggatggggggtgcgctcagcagcatcaccccttatgattctcaatcgctaatagctccactcaggttcatttctcggtcaggggcatttctttgtcacagaaggaatcacccagctctgggagatacagcagcctccactcaggtagtccttgttcaagacaagcggcccttgactgactgcagtttcagttccagctctgctatcaactcactcattaaataaactgcatctccagtgtgcctgcctctgggctggattttgacgtgacctgggcaagcaactccctgaacttcagtttctcatatattatatgaattagctaagatggttcgtttaatcattcattcaacacatccatcaccacgtagtaggtgttagatatttatttcatacgtaactacgcataagagactttgctaagttttaggtaaaatacaagtcccagatacggagcaagtctcaaccactgtacatacctgaatgtgtaattacatcactgtgagaggtgccacagtaaatgccactgggtcttgtgttagtccattctcacacaaagaactacctagccaggtgcggtggctcacgcctgtaatcccaacactttggcaggctgaggcaggcggatcacttgaggtcaggagttcgataccagcctggcaaacatggtgaaaccccatctctactaaaaaatgcataaattagccaggtgtggtggcacacgcctgtaatcccggctactcgggaggctgaggcaggagagtcgcttgaacccgggaggtggaggttgcagtgacccaagatcgcgccactgcactccagcctgggtgacagagtgagactccatctcagaaaaaaataaaaataaaaataaagaactacctgagaccaaatactttacgaaaaaaaagaggtttaattgactcacagctccacaggcttaacaggaagcctcaggagacttacaatcatggcagaaggcgaaggggaagcaaacacatcttaccatgatggagcaggaggcgggtttcgggggatgtgccgcacacttttaaatgatcagatctcgtgagaactcactcactatcacaagaacagcaaggaggaagtccgcccccatgattcagtcacctcccaccaggcccctcctctggcacatggggattacaattcaagatgagatttgggtggggacacagagccaaaccatatcagatctcaagaagggagaaattcttcttggaggagctggaggggctttgtggagagtttcagaatgctttgcccactaggtttgctgtatccatttctcttcatgtatcccaaagaccaagccaagaaaccagaagcctctggtcccactggcccatgggctccctcggttccccccgtcactaatggccattttgcatgtctctctcccaggcctgctctcttgaacagtgccgaaaacttcactgtgctcatcaagaacaatatcgacttccccggccacaactacaccacgtaagtgcccaggctgcctggctgtcttagttatctactgctgagtaataaattatcccaaacctcagaagcctgaaacaacaaacgcctattgtctcccacggtttctgtgggtcaggaatctgggaatgactttgctgcgtggttctggctcaaggtctgtcaggttgtagccaagctgtcaaccagggctgcagtcatttctaggcttgactggggctggagaacacttttccaagctctcacacagttgctcgtgggagagctcagttcctcaccacgtgaacctcgccctagaccacttgagtatccttggtatatggtggctggcttctcccagagcaagtgacccaagagagacagagcaagcaaccaagagtataaccaagatggaagccacagtctttggggggagaccccaacacttctgccatatgccattggtcacacagatcaaccctggtccagtgtgagaggccactgcccaggggtcccaggaggcagtgatcatttggggctttcatggaacctctccaccacactggctcactcctgggaaagagacagatctgttttcaatcgagatgtttgtttgtttgtttgcttttaattatgcacaggagaaacatcctgccaggtttaaacatcacttgtaccttccacaagactcagaatccacagtgtcccattttccgactaggagacatcttccgagaaacaggcgataatttttcagatgtggcaattcaggttggtggtgctttgtacactgggatgtggggctgtgtgtctagggatggaggatgtcaaacagccaagaggccgggccactgggtcttcataatgtggctcacatttactgagcatttagtaaatccacccgctacgctaaggactttacctaccatacctcgtcaaatcccaaaacaatccttatgagtgagagctacttggtgtattcctttcctgtggctgctgtagcaagttatcaaagcttagtggcttcaaagaacacatatttgcttatgttgccagagatcagaagttggagatgattttccctgagccagggcagtgctccctccgggactttaagggagaatccagttcctcagcttttccaccttctggagctgcattccttgcatttcttcaaagccagcagcataacatcttgcctcagtggccactttcactccctatcctgtgtccaatctccctttgcctctgtcttacaaagagagagagcatttacaagagggggcatttaaggaccaactggataatccaggataatctcccatctcaagatccttcatttaggctgggcacggtggctcatgcctgtaatcccagcactttgggaggctgaggtgggtggatcacctgaggtcaggagttcaacaccagcctggccaacatggtgaaagcccatctttactaaaaatacaaaaaaaaaaaaaaaatagccgggcatgattgcaggctcctgtaatcccagctactcgggaggctgagacaggagaatcgcttgaacctgggaggcagaggttgcagtgagccgagatcgcaccactgcactccagcctaggtgacaagagcgaaactccatctcaaaaaaaaaaaaaaaaatccttcatgtattcgcatctgcaaagagctttccctaggggagtactaggaggtaaagcagaaaagatatttgatagagtgccctgaattccagtctaataagtttggacttgatctttaatgggggcgtggggggcattaaaggtgtttgggtacaggagtggtctgttgaaagttgtattttaggacaatgagtttaacggtgatgtgtcccagacgggggtagggagagtgaggagatgcgattgtggctgccacaataacacttgtgcgagttaggtggggctgtacatatggttcttcaatcagcatttttcctctaaaaaccttaagcaatcctggctatgcagggagatgtctggcggttgcgtaactcacacccagcagccatagagactgtcccttgttgatccttcagggcggaataatgggcattgagatctactgggactgcaacctagaccgttggttccatcactgccgtcccaaatacagtttccgtcgccttgacgacaagaccaccaacgtgtccttgtaccctggctacaacttcaggtaactccaaggcccaggtcaaactcacccagtggctgaatcgcattcccaggaactggtgagactaattttggtttccaaggcaacaagatgaatgaaaaaagactttctctaagaactaggtgataactgaattttttccataattttttaaaattctcaaaagagatgcacactctttattttttacttatttttttttttttgaaatggagtctcactctgtcacccaggctgaagtgcagtggcgccatctcagtcactgcaaacttccgcctcccaggttcaagcgactctcctgcctcagcctcccaagtagctgagattataggcggatgcacactgtttataaaacaaaactattgggaaacagaaaagcatagagggggatcaaaatcacccataattcccctaccctgaaataatcaataacaaccctcgggggaattttcctcatctgtaccaattatttcatacagctcctatgagataatagcatatatatatatatcttgtggtattctgcggggtttttcataccacagccactcaaaattctttgtaaccatcacattaatgatc

SEQ ID NO: 980 - DNA, 348 bp, Homo sapiens
ctcgatgtcaaaattcaatgagcggcaaaatctgacctaaactgagtcatggctatttataatcttaactcctcccccttactgtgaatactcacatttcactggagagctgtgtgaatgtgcctgattacagggtgcagtcctagaccccacctggggattacataatacacctcttatacattgtactatcttcctaaaatctgaaaaattctgaactctgaaacacatacagccccaaccattccagagaaagcactgtggacctatgtaacatgccctggtccaagaagaaactcacttgccatttgaagaaacaaagcatacagcacaggaaaagatatcctg

SEQ ID NO: 981 - DNA, 585 bp, Homo sapiens
agccatcaaggtgatgaggaagaagtcacggggattttcttcttctaagtccaagcacagtggcaatatttcaagtattgcaaagaaaaacacacgtgtgtgtatttttgtctgttatgtggcgtgtgaccctggaaccccccgcatgggtccatggccccaccactgcctcccgcagactggggactcgttcaagtatctactgattcaggcagggctaaccgagggctgggcagaccaagggaggcccaggcggggtttgcagggcatgcccgcctggaatccggaaggcaggcctctctgcagacgccctccgtggccttgggcaaggcagaggcagggagggacagggctgtcatcaggcctaccctgccgaggagctgacatcgaaactgactgtcaaagctggacggggagcttttgcacatgttacttttttctttgcatgaagtattcccctcatctgcttccaggcccaggtagggagggtgctgggcacacacctgtcctgctgctgccacagggaggggcggcaggggacagccaccaacacaggtgtgcaaagcagccttacccgcccgccac

SEQ ID NO: 982 - DNA, 457 bp, Homo sapiens
cccgggatggcccgtcaggccccatctgtgagccctggagcctgatgcctgcaggcacctccccatatgggttttccagcccactccagtgtgatctgcaccctggcagggccccaagggccaaggccgcattgcccttcgggctggagatgctttgccggctagcctgaggccttgtctagacagggttgagctgtttgtcgttggaaattgaggctcggccagaggcgggtgcccctacagtgccacgatcaggctgaggctcaccacaccaggaagagagatgaacccgcgtctgcctgccgccccgccatgctccctctccccccactggcgtcacagtgcccccacccgcgttgctgcctgtggtgtgcgtgccctgggaggggaacacagcccctgagggcggggaccttgctgggggcccctcagcgtctttctgtgcctctgaattgcc

SEQ ID NO: 983 - DNA, 528 bp, Homo sapiens
atttttctacaaagcttcacctccttaaacaattgcacattagaaaatatctctgaatccacctatgatctatgggctgtacccttccactcctactccactttgagatatcccacctttttaggttaaaccaatatgtagcctcatgtactgatttatgactttgcctgtaacctctgccacgctgcctttaaaaacccttacctgtgtaagccatctgggagttcaggtcttaagcatgacctccctgatcctccttgcttggtgccctgcaacaaatgccccactttctctccctgcaatcccgatgtcagtgtgtggctttgctgctctgggtgggcagacccaagttcagcaagtaaccattctaaggagggtgtttacaccttcttcatgatcccttgtcactgtttcattctaaatcctgattccaacccaattatctgttccttctcatcatctcccctctctttatttcactggtgtggacacagctctctctcctacctgtccccaaagcaccactac

SEQ ID NO: 984 - DNA, 830 bp, Homo sapiens
  misc_feature (1)...(830): n = A,T,C or G
tgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtntaaggagtcaaaagagaaacagcttcaagcagaacgtanaaggaaagcggcgttatttttacagaccctcaaaaatcctctgccggaagcagaaactgggaaaattgaggagagttctttcagtgtcgaggaagatccagaattcttggtatagtagtagtagtagtagtagtcgacccggaatttcggaccg

SEQ ID NO: 985 - DNA, 255 bp, Homo sapiens
gtggggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgacgatggtgatggtgatggttgtgacaatggtgatagtgattatggcggtgatggcgatggtgaggatgatggtgatggtggcaatggcgag

SEQ ID NO: 986 - DNA, 160 bp, Homo sapiens
gtgtgtgtgtgtaatcagcctttagactcttgcacttctatacctccaccgatctggtctacagattccaagaacactgcaccatccacacaaacgtccacagcatcgcccttgcggctggagccggccagtcctgaagcccacaggagccgcccaggag

SEQ ID NO: 987 - DNA, 278 bp, Homo sapiens
gcttgtttcatttgatttggcacgaagtaaagtaagagtaaatatgccatggaagacataatcaagtttttcctccatctctcatatttccccacttctaccagaccacacagtacatcagcaaccatcctttagattccaatttttaaatggctgctcagacgacaccaatagagttctttctccttaaaatatggtggcagtgaatgctaacaggtatcaattcctttgatcaggaacaaagaactccttcaggaaactcactttcctggtccttg

SEQ ID NO: 988 - DNA, 358 bp, Homo sapiens
gtgaaatcccaaatgttctgtgtgcaccccgagcccatcagtgctcaaaaggtcttgggttttggggatttccgactttgaatgtggggtcagggtagcctcagctgcatgtgcatatcaaaaggtgggggctcatgaaatgcgtcatgggctggcggggctccaggccctgccccaggacccagcacggccaccccactgccagagggaggtgggctgcagcatggagaggcaagttcagagcagcccccctgccccgcctacggttcacctcttcaccagagataggaccggcagaagaggcttatgacggagagtttggacttcaaaaccgcggtgagccctgccaacgtgagag

SEQ ID NO: 989 - DNA, 379 bp, Homo sapiens
  misc_feature (1)...(379): n = A,T,C or G
gtggggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgatgatggtgatggcgatgnctgtccacctgtgatagagatcataagggagagtggagatagtgcagatgctggtggtggtggttatggtagcgctgagtgcaattttgtcagtaagtacttgtacacactctttgagaaaggcgacacttgctctggcagctgtactcttctaggccttacaattgcttgctttatgactttgtggaaatgattct

SEQ ID NO: 990 - DNA, 384 bp, Homo sapiens
tgagatttatggcaaagtcttaagtatataacgatgaaataatagtaacaataatagctatctcttattcaccacttgtgaggtgtggtgtcaagcactgtgatgagcgatttattggcattgtttatttcctttacctgacaaccttatgaggtagaatcttactatctccattttatagattaaaaaaaccagaggccagaaaagccagcaactgggggggctgtagttgggagccttttgtgcaagtctgcagggaagccttgtacacccactttgagaaaggcgacacatgccagggcagctgagctcttctaggccttacattgcttgctttaggtttttgtggaaatgattctattttgaacacttcctcacatcgag

SEQ ID NO: 991 - DNA, 293 bp, Homo sapiens
gaagtaattttctgatctagcatgtggattcttgagtcatcttaactaagagattgggagcagcctgtgtggctgacaggccctattgctcatgacttgtgtatgtgtacacgtgtgggatgtgtgtatgcatgtgtgtatatgtatgcagtgtgtatgtgtggagtgtgtgcatgtgtgtacatgtatgcatgtgtagagggtgtgtgtgtatatgtatgggaagtatgtatgtatgtatttgtgtgcctgcatgtgtggacatgtgtatgcatatccagggttaacactgg

SEQ ID NO: 992 - DNA, 255 bp, Homo sapiens
ctcgccattgccaccatcaccatcatcctcaccatcgccatcaccgccataatcactatcaccattgtcgcaaccatcaccatcaccatcgtcaccatcctcacaccaccaccaccaacaccatcctcattaccaccaccatgatcatcagtatcgccgtcctcacgtcaccatcctcaacagcactaccatcagttatcttcaccaccatcactgtcgttaccatcaggtcatcgtcctcaccctcatccccac

SEQ ID NO: 993 - DNA, 159 bp, Homo sapiens
ggatggttaggtggatgagcagatggttaggtggatgggtaggtaggtaggtggatgagcagatggttaggtggatgggtaggtaggtaggtgaatgagcaggtggtggctaggtgggtgggtggatgggtaggcggctgcgcgccacgggcaggccgc

SEQ ID NO: 994 - DNA, 562 bp, Homo sapiens
cggagtacaatgaggcacagactctgtttcgggagcggagcaaaggccgcatccagcgccagctggagataactgggagaaccaccacagacgacgagctagaagagatgctggagagcgggaagccatccatcttcacttccgacgttatatcagattcacaaattactagacaagctctcaatgaaatcgagtcacgtcacaaggacatcatgaagctggagaccagcatccgagagttgcatgagatgttcatggacatagctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgttttgcttgtgatccttggaattatcctagcaacaacattgtcatagcaaccatatcccaagagccatttatccttgagactcagactacatctgcaaccaaatcagcatcctgtcatttcgtgaatgaatcttag

SEQ ID NO: 995 - DNA, 255 bp, Homo sapiens
ctcgccattgccaccatcaccatcatcctcaccatcgccatcaccgccataatcactatcaccattgtcacaaccatcaccatcaccatcgtcaccatcctcacaccaccaccaccaacaccatcctcattaccaccaccatgatcatcagtatcgccgtcctcacgtcaccatcctcaacagcactaccatcagttatcttcaccaccatcactgtcgttaccatcaggtcatcgtcctcaccctcatccccac

SEQ ID NO: 996 - DNA, 524 bp, Homo sapiens
ctcgttcaagtatctactgattcaggcagggctaaccgagggctgggcagaccaagggaggcccaggcggggtttgcagggcatgcccgcctggaatccggaaggcaggcctctctgcagacgccctccgtggccttgggcaaggcagaggcagggagggacagggctgtcatcaggcctaccctgccgaggagctgacatcgaaactgactgtcaaagctggacggggagcttttgcacatgttacctttttctttgcatgaagtattcccctcatctgcttccaggcccaggtagggagggtgctgggcacacacctgtcctgctgctgccacagggaggggcggcaggggacagccaccaacacaggtgtgcaaagcagcctcacccgcccgccacacgcccctgtgccatctgcctctaacctggcccagtcctcgccctcccaaaaccaattcttaaacacctacaagttttctcctttaaagaaaaaatgagctgcataaaaataagacacgttttag

SEQ ID NO: 997 - DNA, 554 bp, Homo sapiens
ctgggtttttctggaatgcttatgaatctgacttgagacccttgaccctcagaaccccacggttctcaccctgtggtctcggcttctctctgcctaccctacatgaagacagcgagggggaagattctgggtacggagtggacagggcaagggatggaacacaaggccatagcgttaagagtacagaaaatatgaacaaagaccctagggcgcaagaaacagaggcagcgacacagtaatgaggaggataaagaagggccacggctgttcacacagtgaaagcacggctgcttcccactgaggcctggggtttctagaaatctaccacttgttctcacttttctagtgttagcagtagggcctccagagtcttccaaggactctgcgcctgctttggcaacagttaggagaaaaataaattctcagccaaaattaaagagaaagctagactaaaagcccaggaggaagggcaggaggccgtgtggccaggcaggaaagcctaggacagccccttgctgtcccttgactgataccaggtgccttctaactcttag

SEQ ID NO: 998 - DNA, 294 bp, Homo sapiens
ggcagaggcaaggagagacagatacagagaggcacagagagagagagtcagggagagagacagagatagagacagagagacagagacagggagggagacagagagagacaaggacagggagagagacagatggagagacagagatatagagacagagacaggcagagacaaggaaagacagacagggagagagactgagagacaagagacagggagagggacagagatacagagaaacaaggagagagaaagatagagactgagttggagagacagacagagatacagacagag

SEQ ID NO: 999 - DNA, 237 bp, Homo sapiens
tttctgttttgctttccgtgtatggtaggcaccagtacaggcactgcatgcgacagaagttgggggaatgaaagaggaaagggataaaggattcaaggatggacagctggacaggctggaggcccctgccatgggcactcaccccgcgggacagacagaaggacggatggacggctggacaggctgggggccccttccatggagcactcaccccgtgcgacagacagaaggacggac

SEQ ID NO: 1000 - DNA, 255 bp, Homo sapiens
ctcgccattgccaccatcaccatcatcctcaccatcgccatcaccgccataatcactatcaccattgtcacaaccatcaccatcaccatcgtcaccatcctcacaccaccaccaccaacaccatcctcattaccaccaccatgatcgtcagtatcgccgtcctcacgtcaccatcctcaacagcactaccatcagttatcttcaccaccatcattgtcgttaccatcaggtcatcgtcctcaccctcatccccac

SEQ ID NO: 1001 - DNA, 636 bp, Homo sapiens
gaaaggatcctaccagtaagaaaggcaaacagcggatttcaaactctaacacaaaatgatcacaggctggcagagacacagaagcaggcaacaatctatctggagtctaatcagagtcatcataactctcaccactatcttgctcctttctacagcacttacttcgtcttcttcgccatcctcagtggctttgctcttggaggcctgggatgacatgtcatcctcactctcatctgctgtgctctcctgggaattttgggacttaatctcttcaccctgcaagtcccggttttttagattgcccagccagaaagcctctctacaattgttgagagtgagcatagctttgacactgcaaactaaaagttccagggtctttttgagcagaggcacatgttgggtgagtctcgtgtcctggtgaatcttggaacgcccacacaggtgatgaagcagccttgtgtccaactggaaggtttccagtaagctcagaacatcttcccggtgttttctaaaactgaagtctaggagcggcatacattgcttcagaaatgcttccacaatgagacgcccatacttgaaacatacatgcagaacaggatgactatcaaataccctttatcaagttgacgaagaatc

SEQ ID NO: 1002 - DNA, 788 bp, Homo sapiens
cttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcagaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaactttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaaagctgaataaagttctacttactgtattaactggcaacagttggatttc

SEQ ID NO: 1003 - DNA, 651 bp, Homo sapiens
ggtacttgggagaacgtgatcttgttcgagatctttttttgtgcttcttctttttcttttctttctcttcttctctcggtggatctttgcttttgctcgaaggcctatcgggtggtttaacttctaaagtaggcagaggccagcctccagtcagtagagggcagggcgtagtgctggattcctcgacactgaaaggactctcctcaattttcccagcttctgcttccggcagaggatttttgagggtctgtaaaaataacgccgctttctttttacgttctgcttgaagctgtttctcttttgactccttagacgcctgggccagcttttcccgggcagcagctgcgaggcgatcttccggcttttgctttgcttgctttgcttctagctcctcctgggtaagttgaggcttcttctcctcaacaactacacagggtggggcaactgctgggttagtgtttgcagcactactagaactttcttggccttctttgctttcttcatcatcatcactgtcatcatctagcttaacacgatttttttccaggggaagcagatcattttctttggccttgattgcaaagcttattggagcaaaggaagctttcaccagcttcccgttcgggacggtcttactggacgatgaggatc

SEQ ID NO: 1004 - DNA, 348 bp, Homo sapiens
gctgtacggtgtgcgggagtctgtgtctcccacggcgcagcccgaggagcctcccctgctgccggagcccccagacaaccggaccagcgccccgtaagccctgggcccacggtcaccacccgctggggtctgtctgtcctcatccctgtcccacgcaacatttgccccaaatcgtggctcagagtcctgggaaacgcacagctgtgtggccgactgagcccccagtgacattttgtcttttcttaaaccccatctaacaccggccctcccctgccaggggtcctgcacagaaatgagaacttcagacaaggtttcctctccccctcgtccctgtcagctactgccatg

SEQ ID NO: 1005 - DNA, 394 bp, Homo sapiens
gcgagggggcccggaggccaaagcagatgctgcaccagaggctggtcagaacccgggagggcctgcgggggtggggtcctcatgagcaagtgcggggtgctggaggtcagcagctgcctggcctgggagacagggacacccatccccttcctgacacctgaggcggcccagctgggcaagaccaggcctgcaggaccagagcctcctgtcacgtggcacaggggtccaggtggtcaacgctgctctctggaggatcactggttagagcctgcccagctcccctgaggtctggagacagtcaaagcccccccaaacaccccctcccttttgggcgagtggcgtgccttggactccagaagactcgagtggggctgccttgagaccaggtcctgag

SEQ ID NO: 1006 - DNA, 439 bp, Homo sapiens
ctatcatcaccatcatcgccatcaccatcatcaccatcatcaccatcaccatcaccaccatcactatcatcaccatcaccatcatcaccatcatcaccatcactatcatcaccaccactaccatcaccactaccatcaccatcatcatcaccattatcatcactatcaccatcaccatcatcatcaccattatcatcactatcaccatcaccatcatcaccatcactatcaccatcatcgccatcaccatcatcaccatcatcgccatcaccaccatcaccatcaccaccatcaccaccaccaccatcaccaccaccatcatcaccattatcatcatcactatcatcaccatcactatcatcaccatcatcgccatcactatcatcaccatcatcaccatcatcaccatcaccatcaccaccatcactatcatcatcac

SEQ ID NO: 1007 - DNA, 593 bp, Homo sapiens
  misc_feature (1)...(593): n = A,T,C or G
ggtggatatggtggcattggggatggctatcatgcatttggtaatgatggaagcacttttggaggtggtggacgctacaatgattttgagaattacaacaatcactcttcaaattttgcacccatgaagggaggaaattttgtaggcagaagccctggcccctatggccgtggaggccaatactttgcaaatccaccacaccaacgcgcctatggccattccagcaacaggacgatcccgactcatcggtagcagtattcctgttccaccctctaattccgtaccgttacctccaggcgtaccatcttcccctcttctagccttcttccaacctcgctgaatcctggtctctacttctcctctctacaatcctatccgttcacaattacccccaacttacctacccgaaactctcccccttcatttcttcttctccgtacaccnntatctaacttcactcccctcgccttcgaactaattgccctctatttattagcaaattctcccccgccatctcccttaccgcattcgtcctcccatctaccagaccccctcttcttctttctaccccccccatcccccctacttttccc

SEQ ID NO: 1008 - DNA, 255 bp, Homo sapiens
ctcgccattgccaccatcaccatcatcctcaccatcgccatcaccgccataatcactatcaccattgtcacaaccatcaccatcaccatcgtcaccatccacacaccaccaccaccaacaccatcctcattaccaccaccatgatcatcagtatcgccgtcctcacgtcaccatcctcaacagcactaccatcagttatcttcaccaccatcactgacgttaccatcaggtcatcgtcctcaccctcatccccac

SEQ ID NO: 1009 - DNA, 327 bp, Homo sapiens
tcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaagtaaaatgggag

SEQ ID NO: 1010 - DNA, 300 bp, Homo sapiens
ggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaataggagccttccccttgagctccttttcactcctgaagggagctggagactggaaccaactgagaactttctctgtctgtctctctctgtgtctctgtctctatctctctctctttctctctttctctctctccctctctcc

SEQ ID NO: 1011 - DNA, 303 bp, Homo sapiens
gggggtgggagcctccgggtcccctgcaggtcctgacccaccagatgggcccatgtgccccctgtagcttgggggccctggaggtggacaccagcacctcctgactaccagggggagggcctggactgaaacccacaccttcaccattcgccactgggccactctgcaggaactgcagcaccccacagatccttcatgcccagcacgccactcactctcacaccctctcgcacacatgcacacacagcacgcacacaccaggctcacgcgctccgcacaggtggcacgccaggggcaagcgtg

SEQ ID NO: 1012 - DNA, 303 bp, Homo sapiens
  misc_feature (1)...(303): n = A,T,C or G
gtggggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgacnatggtgatggtgatggttgtgacaatggtgatagtgattatggcggtgatggtgatggtgaggatgatggtgatggtggcaatggtgaggaggattcataattctcatatttttgttttacgtgtccttctccggat

SEQ ID NO: 1013 - DNA, 166 bp, Homo sapiens
cccgttgttaagaaacacatgactgtacacaaatgtgctcctgagaatgtgagaaaataaggaaagcggagaggtcaatctacataaagccgaccgcagctaccagagtgcaggctagagaaaaggtgttcctcatgaagaaatgacctaatcctttccaggtaac

SEQ ID NO: 1014 - DNA, 472 bp, Homo sapiens
cttcctgtggaaacctggactctggctgggtcagagtggactcctagttgctcctcttcttttgtttctgtttaagcttgttccaaatcctttccagggccgcttttcccatgaagaaggtgatggcaaaattgcgcttgtaccaatctctgttatacatgtgcttctgaaaattttacttaaaaattccttgtagaagtccgccatttcttctgcattcaatgttgctttctgacctgattcagttctcaggcccaggcctttagcttttagtcttgagtgaataaattcttctttttccttactaaaagtcaaattctggtttgcccagaactgtggattccattcttgtgtttctggtcttaattttctaagcttttgttccaatggagattcattttcaggtatgtaaaagtgaacaggtcgaaggtttgaatatttatctgggggtcttgccatgattggataggac

SEQ ID NO: 1015 - DNA, 403 bp, Homo sapiens
gtggtttccaaatgctatttataaacaagggatgagttcacttgcttagatatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaaattattttttaaactgccacattcactccgaagcccactcatctccttcagcatcccactgatgaagcacatgttccgcttagctagataataatgaggtggcacacacgctgcaccgctgacatcacaggacagctgcctataaaactagacttctgatgctgggctccagcttcattctca

SEQ ID NO: 1016 - DNA, 400 bp, Homo sapiens
cttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagacattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacacc

SEQ ID NO: 1017 - DNA, 386 bp, Homo sapiens
agtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccgggtgaggatgatgacctgtgagaatgaagctggagcccagcgtcagaagtctagttttataggcagctgtcctgtaatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttg

SEQ ID NO: 1018 - DNA, 646 bp, Homo sapiens
aagagtatctttgttttcactcatgtacttgtacctgtctggattattcattattacatgaagtatcatgtttctgaaaaaccatatggcatatttgaaaagaagtccagaatattccctggtgatacaattctggagactggagaagtaatcccaccaatgaaagaatttcctgatcaacatcattaaagattatgtaaaaagttaaaaggcttatgagcctaagtttgttccaatacaaagctcaaaactcaatcaaaaataaccaggcaaacaaagaaaaaaaaaaacacatgaatgaaaacccaacaaaaagagacaacactaacccatccacagaggcaccagctaataaagttacaagacacagacgttaaaacaattacattcaaagagataaaatgtaagatcataaattttgtcagagaataggacagtattaaaaggaaccaagtggaattctaggagttaaaaccaatccaaaaataattccatagatgaagaaagattccctgacctgaaagacaatcgctgaagagaaatcaaacgataagtcagggaaaacattttcaaaataaaatatatagagaaaaaatgatgaaaaatagagaacaaaagaggagagacagaaaggatacactgaaac

SEQ ID NO: 1019 - DNA, 327 bp, Homo sapiens
ctcccattttatttcatagtacattttcacagaaacatgatatatttacaaatatacaggtaagagactgctggtcagaaatcttaaaactcaaaatgtcatcaaaaattaatttacaaaagccaccaagggtccatggaggcggccaggtggatggtgtggccggcgtctgcgtgagcctgcccagaagcacacgcagcctcccggctctgcctccgctggccccgtctcaggaagcgctggtttgcaggtttttggaagctgcaagcatcgctctgactttggccatgagatcctgagtgattttgctctgcacggaagaaacga

SEQ ID NO: 1020 - DNA, 542 bp, Homo sapiens
ctctgatcttggctatttcctttctactgatggatttcggttcagtttgttcttgtttctctagttccttgaggtgtgaccttagattgtctgtttgcactctttcagatttttgttgtaggtgtttagggctgtgaactttcctcttagcaccacctttgctgtatcccagaggttcgataggttgtgtcattactgtcattcagttcgaagaatttttaaatttccatcttgatttcatttttgacccaatgctcattcaggagcaggttatttaattttcgtgtatttgcgtggttttgaaggctccttctggagttgatttccagttttatttcactgtggtctgagagagtgcttgatataatttcagtttttaaaatttattgaagctcattttatggcctatcatatggtctatcttggagaaagttccatgcactgttgaatagagtgtgtattcggcagttgttggatgaaatgttctgtatatatctgttaagtccatttgtttcaaggtatagtttaaatccattgtttct

SEQ ID NO: 1021 - DNA, 238 bp, Homo sapiens
ctagccttacaaaaaaaccctcccgggggggaaaaaaaaacaaaaaaacggtgtagtgtgaactgctgaagaacttaaatgttcaagacatctttaaagtctaggagtacctgaaaactgtgggtaaacatggaccatagtaatcgtatgagaaaaaaatagctcaagattcctaactgctacaagaatagtgttgatgggatcaaactcctaattatcctaatagacctaattcatt

SEQ ID NO: 1022 - DNA, 474 bp, Homo sapiens
caaacccggaaggaaaaataaaagaagagcctgaagatctgaacaaagaaatcaagaaaactgcgaataaaattcgagccaagttaaaggctattgaacaaagctttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagatccacaaacatagccatgtccatgaacatctcatgcaactctcggatgctggtctccagcttcatgatgtccttgtgacgtgactcgatttcattgagagcttgtctagtaatttg

SEQ ID NO: 1023 - DNA, 662 bp, Homo sapiens
tgcatgtgtacatgatggtgtgtgtgccacgtgtacatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatatgtacatgacagtgtgtgtgccatgtgtacatcacagtgtgtgagtgcacgtgtacatgacggtgtgtgtgcgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccatgcactgagtgagatttccgtaagtagt

SEQ ID NO: 1024 - DNA, 412 bp, Homo sapiens
cgcccccacctctcctgccaggccctgctgcacgtggtcactccgtttctcagcccttggacttgtctatttcagactgtaacatccctggcactcccccacgcgcagcacaatctctggctactctgaaatgtaaatgggtgacttatccaaagccacctaaatgagccagaatttacaacttcacttctatgtaagtcatttgtcttttctagagggaaggaatggacacagttcagggagcatcagagaagcttcagggtggatttatgctcagcatttaaaatctttaacccaaaccaagcccggtatacccaaaggacttcccgcttactgctctttagggctcagatatttcaaagacataaagcaaaccacacaggtcagcatttttctaatgttctggacacca

SEQ ID NO: 1025 - DNA, 371 bp, Homo sapiens
cgctgtccagtatttttggcttttgtagctctctttttagacaaagcagcttcttcagtaatatcctcttcttctaagtatacactcagtcttacagggaattcagaacttactatgaaactatcccctgccaatttgatatcacattcgttatcttcaagatgtgttgcatcctcatcctctgctctgtaatattaaaatttatcatcgagatgacagaatcttcgatgacctaattagttgtatattccactctgaaatataactgaaactgcaatactagtcaaaggaaacacaaaatttgagaattttgtgttctggagaattctagatgaacggtgtgccaagcttggctcaactgtaataatccc

SEQ ID NO: 1026 - DNA, 551 bp, Homo sapiens
cttgacacaggaaaggtaatgtaaagatactgtattacagtcttacagggtcccattgcatatgcggtccattgttggcagaaacggcattatgtggtgctcaactgtattgaaacagacttttatttgacttctgtttaatgcctaaagatgtcttagggtaactcatagaaggccaaattaaccacccgaggtcgtctttacttttcttttccaaaattccaccctggaaaccaagtgatcagaaggcagaaggaatggcagaaggcgtttccaagaggaggggatggccaggcctgtcgtgagctaccagggtgtcgagtacagtcaggaaaggcagcacctggaggcccagcgacttgtgtggttggggtcaggtgcctaggccttcttggtgggcagagggggtcttgtagtgaagaaatgacgaagagttttgatggtaggaagggagagatgttacgttagattgtgagagaagaaaagttgagagccagctgagaggaggctgagtgaaaattccgtacgtagtagtagtagtagtagtagta

SEQ ID NO: 1027 - DNA, 458 bp, Homo sapiens
cctacggaattctcactagcctggaaggaaagggggtgggtttgaaggccagggccaaggggtcctcaggtccgcttctgggaagggacagccttgaggaaggagtcacggcaagccatagctaggccaccaatcagattaagaaattctgagaaatctagctgaccatcactgttggtgtccagtttcttcatcatgcggtcaaggacaccagggtccttctggttctttgtgaaggcagctagttctgtattcatgaagcttaggaactctgtcttggagagagtgtagttataaccatcctttccagcatacttctggaagacagcaatcagggactcgatgcaccgctcagtctctgtagggctggagatttttgccatgttggagctgagcgaggcgcgggaggctgtggctgggagcggcgctgagagctctgtgcgcgcggcgtgcgggtc

SEQ ID NO: 1028 - DNA, 244 bp, Homo sapiens
actctacactaacgaaagctggaataatgaaaacctcagagtggctctcagcatatatccaaaatattcacaccaggcaatgaatactctatgagaagtgttttattccaaatgatccgacagttggttagtttgcacacaggaaggacagattcagatgtacaggcatgagtacaagtttgcttagggagaacaccacagcacaatggaagttcttgatggtggattgtggttgaaaaatgcc

SEQ ID NO: 1029 - DNA, 376 bp, Homo sapiens
caaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctggaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttg

SEQ ID NO: 1030 - DNA, 303 bp, Homo sapiens
gccaggaggggcagctcagcttccttggctaaattagaaagttctgtttggtggtccacaacgccttcatttgcttcctcctcttcaattgtttcctcttcatcgtccacttcgtcatcagtcaaagatatgctagcttttctttttcttccagacattcctgaatccagagaactttcctgtaatgcgtcaaatcctttaggtctcaattctttccctctcctggaaactttctgtaaatttaaggccctcttccttttttcttctaattctactcgtagttttatttccacaacctgttca

SEQ ID NO: 1031 - DNA, 220 bp, Homo sapiens
cggaaccaccatctcatgtatggttgagctttgacagaagcatcactatgcattgcatgactacatatgtagactcaaggaataaaattaaacaaggctgacttttaaatggcccttgatttttggaacagttcagaatatccagctaagtatttcatttggaaagagactggggcagataggggtttctctccaccccatatcccaaaccctcttagat

SEQ ID NO: 1032 - DNA, 469 bp, Homo sapiens
aaaagagaaacccgtggcactatgtaaataaagtaagcatactttgttgttagtaaatagatgaggcatgcctgggaaatgctcccttggcataaatagcaatcaattataattagcaaacaggtgtaccaataaaaagaatttacatgatagggtaacaaggaccagggaagtgagtttcctgaaggagttctttgttcctgatcaaagaaattgatacctgttagcattcactgccaccatattttaaggagaaagaactctattggtgtcgcctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaatcaagttgctgagtgagaaattcgtaggtaggagtagga

SEQ ID NO: 1033 - DNA, 156 bp, Homo sapiens
tggtggtactggaaaacgaccttcgtgaaacgtcatttgactggtgaacttgagaagaagtatgtagccaccttgggtgttgaggttcatcccctagtgttccacaccaacagaggacctattaagttcaatgtatgggacacagccggccaggag

SEQ ID NO: 1034 - DNA, 529 bp, Homo sapiens
cctacggaattctgactcagcaacaaattactagacaagctctcaatgaaatcgagtcacctcacaaggacatcatgaagctggagaccagcatccgagagttgcatgagatgttcatggacatggctatgtttgtggatctgatataatgtccggagtgaacatggatggctttccgctctccagcatcttttttaactcgacgtctgtggtggttctaccagttatctccagctggcgctagatgcggcctttgctcctctcccaaaacagagtctgtgcctcattgtactacgccatggcttccacaaacttccgagacagcaccgaatgctgggttcttcgtatccgaagatacactgaagtccggttcccactctcatcctgatcaaaactttgttcaatagcctttaacttggctcgaattttattcgcagttttcttgatttctttgttcagatcttcaagctcttattttatttttccttacgggtttggctgactgagaatttcgtacgtagtagtacta

SEQ ID NO: 1035 - DNA, 637 bp, Homo sapiens
tgcatgtgtacatgatggtgtgtgtgccacgtgtacatgacaatatgattgtgtacatgatggtgtgtgtgccatgtgtacatgacagtatgattctgtacatgatggtgtgtgtgccatgtgtacatgactgtgagtgcatgtgtatatgacagtgtgtgaatgcacatgtacatgaaggtgtgtcgggtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgttacggtgtctttgcatgcatgtatatgtgatcacgttgggccatgc

SEQ ID NO: 1036 - DNA, 637 bp, Homo sapiens
caacatagaaagaaatgttatgaatgccacagactatgtagaacacgctaaagaagaaacaaaaaaagctatcaaatatcagagcaaggcaagaaggaaaaagtggataattattgctgtgtcagtggttctggttgccataatcgctctaattattggcttgtcagttggcaaatgatggtgtggataacgtcagtgtgcatgcctctctgccagggtgggaaaattgatgttcattattatttgtgtaatcgttttgcttgtgatccttggaattatcctagcaacaacattgtcatagcaaccatatcccaagagccgtttatccttgagactcagaccacatctgcaaccaaatcagcatcctgtcatttcgtgaatgaatctcagacgctgtaacccggcatcgagtgctgtccttgtaatgtatgagttcacggaagaagcacaaccgaacgtcttgttcagcgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaagaag

SEQ ID NO: 1037 - DNA, 467 bp, Homo sapiens
ctcccattttatttcataatacattttcacagaaacatgatatatttacaaatatacaggtaagagactgctggtcagaaatcttaaaacccaaaatgtcatcaaaaattaatttacaaaagccaccaagggtccatggaggcggccaggtggatggtgtggccggcgtctgcgtgagcctgcccagaagcccacgcagcttcccggctctgcctccgctggccccgtctcaggaagcgctggtttgcaggtttttggaagctgcaagcatcgctctgactttggccatgagatcctgagtgattttgctctgcacggaagaaacgattgctgaagagatctgggcttctttttcctgagagactcccctggagcgctcctggctggagccccgactctccacaggggagacgctggctgagtgcgccgagtgggccgcgggggccacgggccggggcgctgcctgc

SEQ ID NO: 1038 - DNA, 202 bp, Homo sapiens
aggagatgagtgggcttcggagtgaatgtggcagtttagctagataataatgaggtggcacacacgctgcaccgctgacaccacaggacagctgcctataaaactagacttctgacgctgggctccagcttcattctcacaggtcatcatcctcatccgggagagcagttgtctgagcaacctctaagtcgtgctcatactg

SEQ ID NO: 1039 - DNA, 467 bp, Homo sapiens
taaaagcatctgggatgaattcattagtgatgaggcagatgaaaagacttataatgacgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccaggtccttttaccttttgtgagtttaggtttgatgtgctttggggctttgatcggactttgtgcttgcatttgccgaagcttatatcccaccattgccacgggcattctccatctccttgcaggtctgtgtacactgggctcagtaaggtgttatgttgctggaattgaactactccaccagaaactag

SEQ ID NO: 1040 - DNA, 399 bp, Homo sapiens
ctcagagtcgtgcagccacaacaaagcccaactgcaaaggctgttcgtcagaaagcgcgcataaatcttcaggcgcgggcgtgtagggatgatgcacagcccatggctacgacggctctcatcgttgggggaggttgcggggacttgatttttgggcttttctgtcatttccaagtttcccttgtcccccagacccagatacttgtcactgctttcagccaggaaagcctctcgccagctctctggagtccgagtgcctgtggccacattgctctgctgctgcctcccacctttgtgactgtgtggcaacagcctgctgctaaggttacggtatgagcgtcaccttcacggacagtcgcttccggcctgacctgtctgtctctcggagcgggccccccc

SEQ ID NO: 1041 - DNA, 569 bp, Homo sapiens
cgaaaacattggttgcaaagcccctcaaagccctcaagtgccttctgtgagtttaaatgtgctggtgccctccagaaaagcctcggcctcagctccttttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttggaaaatgtatgaactggtgagcggacatctgttaagagagtcacttctcagaatgttataggagtgcatgccggatgccccaaatgctgagtgagaatttccgtcgttgtagaagta

SEQ ID NO: 1042 - DNA, 303 bp, Homo sapiens
gccaggaggggcagctcagcttccttggctaaattagaaagttctgtttggtggtccacaacgccttcatttgcttcctcctcttcaattgtttcctcttcatcgtccacttcgtcatcagtcagagatatgctagcttttctttttcttccagacattcctgaatccagagaacttttctgtaatgcgtcaaatcctttaggtctcaattctttccctctcctggaaactttctgtaaatctaaggccttcttccttttttcttctaattctactcgtagttttatttccacaatctgttca

SEQ ID NO: 1043 - DNA, 603 bp, Homo sapiens
catggaaaaggatggcccccactcagccacgagagaggatggacgcccgctcacccacgggagaggatggacccacactcaaccacgggaaggatggatcctgctcagccatgggacaggatgtcccctcactccgccacaggaaaggatggcccctcactctgccacgggaaaggatggccctccagccacagaaaggatgaccctcactcagtcacaggaaaggatggatccccctattcagccacgggagaggatgcccccccaccgactcagccatgggaaaggaaggccctccattcagccacagaaaggatgacccccactcagccatggcaaaggatggacctccattcagccacagaaaggatgacccccactcagccacggcaaaggatggccctccattcagccacagaaaggatgacccccactcagccacgggaaaggatggccccccactcagccacgggaagggatggatcccactcagccaagggagtggatggcccccccactcagtcacgggaaaggatggatctcgctcagccacgggaaacagccagagggatgagtgcacatgggcccaaaccaagacgcaaa

SEQ ID NO: 1044 - DNA, 320 bp, Homo sapiens
atctgtgacctgtcagaataaaaatgtggtttgtacatatcaaatagatattttaagggtaatattttcttttatggcaaaagtaatcatgttttaatgtagaacttcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacctacagttttcaggtactcctagactttaaagatgtcttgaacatttaagttcttcagcagttcacactacac

SEQ ID NO: 1045 - DNA, 278 bp, Homo sapiens
gtatgcttacctagttctccatgcccatgcagcaatatggagagaaagggaattcctaacttccaagggaacacctatcaaacatcaagaagccattaggatattattattggctgtacagaaacctaaagaggtggcagtcttacactgccggggtcataaaaaaaaaaaaaaaaaaggaaagggaagtagaagggaactgccaagcagatgttgaagccaaaagagccacaagacaggaccctccattagaaatgcttatagaaggacccctagtg

SEQ ID NO: 1046 - DNA, 388 bp, Homo sapiens
cagaccttgaaggaaaggtgggacatcacgggaggcaggtccccctgtggacatgattccacagaggcatggagtccttcccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtgtgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaaga

SEQ ID NO: 1047 - DNA, 503 bp, Homo sapiens
tctgaacaaagaagtcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttctgacattatatcagattcacaaattactagacaagctctcaatgaaatcgagtcacgtcacaaggacatcattaagctggagaccagcatccgagagttgcatgaaatgttcatggacatggctatgtttgtggagactcagggtgaaatgatcaacaacatagaaagaaatgttatgaatgccacagactatgtag

SEQ ID NO: 1048 - DNA, 183 bp, Homo sapiens
gtgccttcaccgatatgttcaagatactgacgtattcctgctgttcccagaagcgaagtggagagcgcagagtaatgggtaagcacttagttctcatcttgggctgtttgaaaggactttatcgatctctttattaacatcctagcttcggtttgttgtgtgcttattgtgtgctgggcctgg

SEQ ID NO: 1049 - DNA, 669 bp, Homo sapiens
  misc_feature (1)...(669): n = A,T,C or G
cagcatagaaagaaatgttatgaatgccacagactatgtagaacacgctaaagaagaaacaaaaaaagctatcaaatatcagagcaaggcaagaaggaaaaagtggataattattgctgtgtcagtggttctggttgccataatcgctctaattattggcttgtcagttggcaaatgatggtgtggataacgtcagtgtgcatgcctctctgccagggtgggaaaattgatgttcattattatttgtgtaattgttttgcttgtgatccttggaattatcctagcaacaacattgtcatagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaaggttaattaggaaggctgagtgagaatnccgtaggtagtagtagta

SEQ ID NO: 1050 - DNA, 325 bp, Homo sapiens
tgttgtgatttgttcctgccccaccctaaccgatcaattgactttgtgacaatacaccctccctgcccttgcgataatgtactttgtgatatttccccacccttgtgaatgcactttgtatgatacaccctccccacccttgagaaggtactttgtagtatccttccctgcccttaaggtactttgtaatattctcctcgcccttgagaatgtactttgtaagatccatcccctgcccacaaaaaattgttcctactccaccgcctatcccaaacctctaagaactaattataatcccaccaccctttgctgactctcttttcag

SEQ ID NO: 1051 - DNA, 245 bp, Homo sapiens
gactctacactaacgaaagctggaataatgaaaacctcagagtggctctcagcatatatccaaaatattcacaccaggcaatgaatactctatgagaagtgttttattccaaatgatccgacagttggttagtttacacacaggaaggacagattcagatgtacaggcatgagtacaagtttgctcagggagaacaccacagcacaatggaggttcttgatggtggattgtggttgaaaaatgcc

SEQ ID NO: 1052 - DNA, 286 bp, Homo sapiens
ctggaagcaaatgtacccttaaggatgagtagattcagcaaacagggcacgtacaatcactgggatagcattcagccttaaaaataaggaaatcttgaaaagtactacaataaggacaaatcttcaaaacattctgttaagtaaaataagacagtcaaaaaggaaagctgtataattacactcatgtaaaatatttagtcaaactcaaaggaaccaagtgtcgtagtctcagcagtgcaccaagatgtaacagtctctcgtagtctgagataacatccagagttct

SEQ ID NO: 1053 - DNA, 632 bp, Homo sapiens
ctaagagtttgccagcagtctcccccgtcagtgcacagtcacgccagcagcaaacactgcccgcgatttcaggggagcctctgcttcacggctgcccttatggggctggcaggagggcttggggagtgcctcccatgggtcctgctggggaaatgtggtggacacactacactgaagccccgtctccgcatcagcaccagtattgctctcacacgtgaggcagaaattcttttgccacggtctgtatcaatgtccgctctttaattaaagagaaaagggaagagggagttaagagaacacactccaagagtacatggctcctttctcaggggtgtgagcaagaatagggccttacatgggggacatcacgtgggtgtcatacaagtctccctgccagagagggggcgctcaaaacagcgcctcacaccagaggccttcagtacacactgtctcctgagtgccaaggagagtgctcccttgtgtgtccgacaccagacgccttcaatagacactggctcctgtgccaaggagagtgctcccatgcgtgcccgacaccagacgccttcaatagacactgtcttctgtcccaaggagagtgctcacatgcgtgtccgacacgctgagagagaatc

SEQ ID NO: 1054 - DNA, 205 bp, Homo sapiens
cctacgggattctcactcagcccaggcccagcacacaataagcacacaacaaaccgaagctaggatgttaataaagagatcgataaagtcctttcaaacagcccaagatgagaactaagtgcttacccattactctggcgctctccacttcgcttctgggaacagcaggaatacgtcagtatcttgagcatatcggtgaaggcac

SEQ ID NO: 1055 - DNA, 722 bp, Homo sapiens
cactattgtactggagcttatcggatttcacctgtagatgtaagtagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccatactagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattaaccagtgttattgtgaaagaatctctgatagaagaagatgtgttaaactgtcaaaaaacaatatacaacttagttgatatggaaaggaaaaatgatcctctacctatttccacagttggtacaagaggaaagggcccttaaagagatgaacaataccgaatcatgtggaatgaattagaaacccttgtcagagcccatatcaacaactcagagaaaccatcaagagtcttggaatgtctgatggcatgcaagagcaaacccccagaagaggaaga

SEQ ID NO: 1056 - DNA, 557 bp, Homo sapiens
cagaggtactgctccttatggagcagggatgccccataggcagtcagcccagagtagcagctcagaggcagttctgcacacatatttatacccacttgtaactatatacaaattaaggaggaggttatttagaaatttctagaaaaggggtggtaactttcaggtcattgccatggaaaggggcagtaatttccagctgttaccatgagaacggcaaactcacttggcaccagtgggtgtgtcctatggaggggtgcttttgcctgtttcagctagtctgtaatctggtccagagttcaagccctgcctcaggagtcaggtcccacctcctatctcagtctggtcacagccctaactaggcagatgatcccaatgtcagcccaaagcccagcagtcaggccctcctgtgatctgcctggggcacccaggaaggggatggggcatgctgggatgggccatgatgtgttgggccagaagtcaggccctctagggtgaagtcctaaccccagtagctgggaatgggaccttatatggagatagtggctttgcagaggatc

SEQ ID NO: 1057 - DNA, 591 bp, Homo sapiens
cgatgactggggcaacagcgtgccggctgcgtctgctgccacaataggctgtgcacagtactgtggtgcccacgagccaagtgatgctggggaggatggcgcgcctgaagacgcatgcgaggtgggagcacgggcacgctcaggcgggaagaaggaggcatcgtccagtaagaccgcgccggacgggaagctggtgaaagcaaagcaaaatctggaagatcgactcgcacctgctgccctggataagctggcccaggcgtctaaagagtcaaaagagaaacaacttcaagcagaacgtaaaaggaaagcggagttatttttacagaccctcaaaaatcctctgccggaagcagaagctgggaaaattgaggagaggcctttcagtgtcgaggaatccagcactacgccctgccctctactgactggaggcaggcctctgcctactttagaagttaaaccacccgataggccttcgagcaaaagcaaagatccaccgagagaagaagagagagaaaagaaagagataacgcacataaaaagatctcgaacaagatcacggtctcccaagtaccattcgtcatccaagcccag

SEQ ID NO: 1058 - DNA, 613 bp, Homo sapiens
gcgtctcctgagcctccacgcagtgccaaggccactgcgggcaggggggaagggcagtgggctccatgctggatctggcagcctctgagaagctgcaggccatttaagggattactgattagcataaatgattatagcatacagagctgagactctgtgctaatacagcgcaaagaccgcgtggagggaggttcccttctgtgcaggccgcagagggcttggaggagagaaggctcctcctgagatgggtgaactcagacagcagatgggtgagacaggcccaccaggcacagggaacgacaccagcaatgacagcagctgtctgctgggcttggaaggagagccagaggtgcatggaaagccgggcgggaaagacctgctagacatctgccgacaggcccagagtgtaaattctcctgcagggaaccttgagtcccagaaggtccttgaataggtaagtaacaccacctgatctgtgtgtttgacaataagtctgtaaactgtggggagaatggagcagacagaacacgcggaggctgctggtccaggtgagaagtcacttgggaaggagagggacaccgggaagggcggaggaaaccaagcatgggacaca

SEQ ID NO: 1059 - DNA, 555 bp, Homo sapiens
  misc_feature (1)...(555): n = A,T,C or G
ggcagctgcctggcctgggagccagggacacccatccccttcctgacacctgaggcggcccagctgggcaagaccaggcctgcaggaccagagcctcctgtcacgtggcgcaggggtccaggtggtcaacgctgctctctggaggaccactggttagagcctgcccagctcccctgaggtctggagacagtcaaagcccccccaaacaccccctcccttttgggcgagtggcgtgccttggactccagaagactcgagtggggctgccttgagaccaggtcctgagggggtggcaacacctgaccacaggtgggggccgtggaaggggcagggatgggcccaggggtagccttgtagtgtgaggtgtgcccgaccacatgtaggtcaacagccagacgggacgctgcangggactgtggggaagccgggagaaggcgctgcccatcctgtggggtccccctcgcctggagaccctgcaggcaacccttcagtgcatgcccacgggggtggtggaggcagagtcctgagaggtgggggtgggagcctccgggtccc

SEQ ID NO: 1060 - DNA, 636 bp, Homo sapiens
atggcacaacatgatcacatatacatgcatgcaaagacaccgttacgtacacacatgtgcacagccacatacatttatgtacacacgtgcactcacatgcagtcatgcatgcacatgcagttatacgtacgcatgtacacataacaatacactttcacatacacatgtgcactcacacacaccatcatatacacatggcacacacaccttcatgtacacgtatactcacacacactgtcatgtacatcatgtacacgtgcactcacacgtcatgtacacatggcatgaggtcatgtacacgtgcactcacaccatcatgtacaatgcactcacacacacaccgtcatgtacacgtgcactcacacactgtgatgtacacatggcacacacactgtcatgtacacatagcacacaccatgtacacatgcactcacaccatcatgtacacgacacacctttatgtacatgtgcattcacacactgtcatatacacaatgcactcacagtcatgtacacatgggacacacaccatcatgtacagaatcatattgtcatgtacacatggcacacacaccatcatgtacacaatcatattgtcatgtacaccgtggacacacaccatcatgtccacaagca

SEQ ID NO: 1061 - DNA, 290 bp, Homo sapiens
cggtttttctccataaataagacaaagaaaccctggggatctggagaaggatctgaggccattaaactgcaaatcccaaccgaaaacgaagaagcaaaagtttcttttttggttcttttaaacgtctaaagagcataaaattaagaaaaatacaaatccattacaaacacttctcatctgtggggggaaaaggtacaaacgcgatttttttttcccaacagccgaatcccaaactcggaaaacaaaagatcaccctcagaaaagccgacacccaagtccccgcctccgca

SEQ ID NO: 1062 - DNA, 697 bp, Homo sapiens
ttaacatcaaaaaggggaaggagaggagaacagcagcataagcagctggcagaggcagggaaagaccagcagtaaggaaagagagaaagagaaagtcagagagagagagaggaagagacagagacaaagagggagtcagagagagaaagagacaaagtcaaagagagagaggaagagagacaaagagggagtcaaaaagagagagacaaagaagaagtcaaagagaaagaaagagagatggaagtagtaaagaaaaaagtgtaatctattcctttaaaagccagggtaaattaaaaacctataattgataattgaaggtcttccctgtaacactgtaacactccagtaccaccttgttgtcagtataaacaagggcgtagcccaaaagcactgagaccactgacaactcacagccttctgatcaaaaatccttaacccagcaggtttccttacaggggatctaaatcttaactaattatcatacaaaggtctgacctacgaggaactcccttcagaacaggaaaagacacaatgggtattcagtaagtgataagaaaactcttgcagttaggaaacttgcctaataattggtctgctcaaacaagtgagttctttgcactcagccaaaccttatagtacttacagaatcaggaaggagccatctataccaattctaagttactatggactgaacaag

SEQ ID NO: 1063 - DNA, 511 bp, Homo sapiens
ctgccctacaaaaaaaccctcccgggggggaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttg

SEQ ID NO: 1064 - DNA, 451 bp, Homo sapiens
tcgtttcttccgtgcagagcaaaatcactcagggagatcgttacgtgggaccggacgtcagcaggatcgtggttctacccgtgcaccgccaagtggacgtttatgccggcggcagctaggatcgtcggagagggcaacacagacttggccagcgtctggaacatcggggaatcctgagggacctaccacgccctgatatagtgatgtttttgtttggtgcgttggtgctggaagggctggggcacttccctggtagaagggagcaggcatcagtgcctggagcaaggaagactacgaagactacccacccagccctctaaccacacctggctccagtatttagagtgcatgtgtgctgttgactttaccagggggtctgtgcagagtgtgacaccactgtactcatttccgggggacactggccatcatgaatggcaactctggagacgag

SEQ ID NO: 1065 - DNA, 457 bp, Homo sapiens
cttgaacgagtccccagtctgcgggaggcagtggtggggccatggacccatgcggggagttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatattgctggaccctttgtctattttaaagcgaattttgtgtgatttcctgccctttgcgttatattgg

SEQ ID NO: 1066 - DNA, 543 bp, Homo sapiens
tctccttgtattcactcccgacatctgcaagctccttgtagaggccatccccctgggacgaagcaagggccagcatagtggtgatgctgcccttcaccttctccacgattccagtcttcagctgctgaaactggtgctgcatcctttcctgggccctttcaaacatgccctcagccacctgccggtccactcctcttctgatggcatctttcatccgctcacacgcttttttgcctgtgatctgagctgcctcttcgtaacagagcttcaggtcactctggacagaggcagtgagggactcgtagatcctcctcttccttctgaggatgtggtcctccaggcccccgaggatggcacttatctcctggatcaggaaattttttttgcagctatcatatttccagccacttcttatcccaatttctgtcattttctcctgcagggactgcttaaaagcatctatgtgaggcatcagagctgtaccagtgggcttccccgtcctaaaaatgcttccaaaaacagggtcgatctggtcatagacgg

SEQ ID NO: 1067 - DNA, 173 bp, Homo sapiens
cttcgaccactacctcaacccctactataagttcatccagaaagccatgaaagagggacgctacactgtcctggcagaaaacaaaagtgacgagaaaaaaaaatcaggagtcagctctgacaatggagatgatgatgatgaagaagatgggaattaccttcatccctctctct

SEQ ID NO: 1068 - DNA, 453 bp, Homo sapiens
atggtgatgatgttgatggtgatagtgatggtgaagatgatagtgatggtgatgatggtgataatgatggtggtgaggtgatcctgatgatgttggtgatagtgacagagcaactgctcatacttgaaggatgctcaggagtcacatgaggtggacttggaccagggaggcctgtccaccaccaagagaaggctgtttatactcaggcagaaccttgctgggatttttgtggctgcagttgagttcatcctgctctctttctctctatgatcttccacccatactcacatacctagtgttttgaggttgagtgagaaatctcgtatgttattattattttttgccccggtattttccgaccggttccttacagctgttccatctttccgtttattgagatcttttttcagctttgcctatatatggtcatttcctggtttcttgtgtgaaatt

SEQ ID NO: 1069 - DNA, 439 bp, Homo sapiens
  misc_feature (1)...(439): n = A,T,C or G
ccaatcttcccctcccctcccccagtatcaggaaactgtactaatctgcattgtctgtatggatttgcctattgcctattctggccattgcatataaatgtgatcttgccagatgtggtcttggctcacttttttgtttttttaaacttagctttagttttctcaaatgaggcaatgcaatcggattagtttactatcattcaaaaatggcagagtgtattgagcactgtctggacactgggttatcacatgattcaaatcatttgctttgctttcattccatgtttaatgttaattttactctagactntgcctgagcgtcaaacctatcagtcttagaaaaaatactcaaagattctgtctcctctaccaactgcaaagtggaagcagcactggactcataattagatataagcctttcattgaagtctgagttcta

SEQ ID NO: 1070 - DNA, 654 bp, Homo sapiens
  misc_feature (1)...(654): n = A,T,C or G
ctcagtttccccaattgtagaatgagagacttggtcttcaggcctcgtagtcaggtgtcagcctccagaagcagcacctggtcccggacaacctgcctggaagtgtggtgcactcaggtggtaccacgggcaaagactccctgcttgggctctgaagagctccctctgcctctgaggtggtgcccccttttcgtttattttttgttgtttttttttttaagagagggtcttgcactgttgcccaggctgaagtgtagtgtagccgctaactcctgggctggagtgatcctcttgactcagcttcccaagatgctgggtattacaggcaaaaactcatgagtgcctgagtctccttttttaagaaaatttaagcatgtagtaaaaatccagtctgaacaaacatgggaaaagtcagcctccctcctgccccccttcccgcccaggcaggccaggcagcagcagtaatgacactgactgagcggcgggcactctgttgtcctggggccgggctgagagcgctggccagggtcatctggttccaggcagtgtctccccttggccctgtgaccatcccctctgcacagcangctgcaccagcacttatgtccncacgtcactgccctgagcgcctatctgccacccctgggccgctgc

SEQ ID NO: 1071 - DNA, 411 bp, Homo sapiens
cgcccccacctctcctgccaggccctgctgcacgtggtcactccgcttctcagcccttggacttgtctatttcagactgtaacatccctggcactcccccacgcgcagcacaatctctggctactctgaaatgtaaatgggtgacttatccaaagccacctaaatgagccagaatttacaacttcacttctatgtaagtcatttgtcttttctagagggaaggaatggacacagttcagggagcatcagagaagcttcagggtggatttatgctcagcatttaaaatctttaacccaaaccaagcccggtatacccaaaggacttcccgcttactgctctttagggctcagatatttcaaagacataaagcaaaccacacaggtcagcatttttctaatgttctggacacc

SEQ ID NO: 1072 - DNA, 443 bp, Homo sapiens
ctacagtattaatattttactgtattgacagcaaggaagggtaggattctcagcaccctaccttgctgggaaagtttctggcataaaagtcaaactctctaccatcattctttgcacaaggatggacagttgcttacatcaagaggggcagaaagccacttaaatacttttcttcaaagatgagacattcctttttgaactgagcattagagaaaggagaaagaattagggaaagctcactcaaagaggtcctcaaacatgcgttgtcccattgctatatatgcttccttttcttctggtgtcatctgggccactagctctggccgttggctcacttcactgtaggagaacggacggccagccaccatgacaatggggtcatctgctacttcttcaaactcgtcatcttcctcttcatcctcttctcgtttatgcacagccac

SEQ ID NO: 1073 - DNA, 232 bp, Homo sapiens
cttgaacatgtcggtgaaggcactgccatcaggaggcttggtgatgaaaacgctctggccacagaggaagaccacaaaagcaaggcctacgcagacagtggggatcgcataaccagtgacaaagctgacgttctgctgaatataggcaatgccacctaacgacaggatcgctcccaggttaatgctccaataaaaccaattaaaaaatctcctagtggcttccggacctcga

SEQ ID NO: 1074 - DNA, 474 bp, Homo sapiens
caaattactagacaagctctcaatgaaatcgagtcacgtcacaaggacatcatgaagctggagaccagcatccgagagttgcatgagatgttcatggacatggctatgtttgtggatctgatataatgtcggaagtgaagatggatggcttcccgctctccagcatctcttctagctcgtcgtctgtggtggttctcccagttatctccagctggcgctggatgcggcctttgctccgctcccgagacagagtctgtgcctcattgtactccgccatggcttccacaaacttccgagacagcaccgaatgctgggttcttcgtatccgaagatccactgaagtccggttcccactctcatcctgatcaaaactttgttcaatagcctttaacttggctcgaattttattcgcagttttcctgatttctttgttcagatcttcaagctcttcttttattattccttccgggtttg

SEQ ID NO: 1075 - DNA, 630 bp, Homo sapiens
ggtcgatcccattttgagaagacatggcctgctcccatcctccctgaagaggatcgccgtgggcatgttctttgtcatgtgctcggcctttgctgcaggaattttggagagtaaaaggctgaaccttgttaaagagagaaccattaatcagaccatcggcaacgtcgtttaccatgctgtcgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggt

SEQ ID NO: 1076 - DNA, 402 bp, Homo sapiens
cgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttg

SEQ ID NO: 1077 - DNA, 236 bp, Homo sapiens
cacgtacagtaacaatacaaaaatgtgactggtcaaacagctcaagttcacatttaacactttcaattatttttaattacactatttctgttcaaaagaatgttttccttacatacaaccatgatcggtctttagtctcaatcgtaccaaaataaagctatatataagcactctgactaggtaaggtgtgaagtaccccgtgagttgctctgtggcttgagatgggacacatggtc

SEQ ID NO: 1078 - DNA, 541 bp, Homo sapiens
catttaatttatcttgtatattttccacatttaaaaatgaattaggtctattaggataattaggagtttgatcccatcaacactattcttgtagcagttaggaatcttgagctatttttttctcatacgactactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttggattgaaggtgtatgtgttgtttgtaaccttgtggagattgcaagtggtgctgacattctggatcttctatgtaaccagtgaaatttggaagtgacgtcacttacctgtctaacgtggtgtgggag

SEQ ID NO: 1079 - DNA, 273 bp, Homo sapiens
ctcagtggcagctggtggtggccatgttggaatgtgacagtgaccgtatgcttaaatgttatcaagggaaaccagcgttgcatactggtctgggaaatctcttttttaagtgctggtagttaatttttcccaagcccggtgcaggctaaatacagcgcaggtgctgatttggcctgggccagattggactgctgtggactccactgatgagaggcatatatacttccgaggcacctgcatttgctgagtggaattccgtacgtagtagtagta

SEQ ID NO: 1080 - DNA, 655 bp, Homo sapiens
tgcatgtgtacatgatggtgtgtgtgccacgtgtatatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcatcgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtcttttgcatgcatgtatatttgatcatgttgtgccatgcgctgagtgagaatttcc

SEQ ID NO: 1081 - DNA, 471 bp, Homo sapiens
acccggaaggaaaaataaaagaagagcttgaagatctgaacaaagaaatcaagaaaactgcgaataaaattcgagccaagttaaaggctattgtacaaagttttgatcaggatgagagtgggaaccggacttcagtggatcttcggatacgaagaacccagcattcggtgctgtctcggaagtttgtggaagccatggcggagtacaatgaggcactgactctgtttcgggagcggagcaaaggccgcatccagcgccagctggagatagctgggagaaccaccacagacgacgagctagaagagatgttggagagcgggaagccatccatcttcacttccgacattatatcagatccacaaacatagccatgtccatgaacatctcatgcaactctcggatgctggtctccagcttcatgatgtccttgtgacgtgactcgatttcattgagagcttgtctagtaatttg

SEQ ID NO: 1082 - DNA, 717 bp, Homo sapiens
ataactctggagaaccaggtgcatcagcgcattgcggagctgaggaaagcaggtctgtggtcccagaggcgtctgccaaagctgcaggaggccccacgccccaagtcccactgggactatctgctggaggagaagcagctccgtgaaaaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccgggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgccgatgactgtccaggcgacagggagagtcgcaaggacttggttctcatcgactcgcttttcatcatggatcaggtcaaagctgccgag

SEQ ID NO: 1083 - DNA, 344 bp, Homo sapiens
aatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgac

SEQ ID NO: 1084 - DNA, 632 bp, Homo sapiens
gcctgtgttacaatcagtgttgagtgttaatcagctcagtggagggtcagggtgacagcctttacaccctgccctcttggtacctgagttcttgtccggcgtccagcaagaatcaggtcacacgaacgaattaaagggtggtgaatatggaggactttattgagctgtggaagtggctctcagcagaaagggaagctgacaagggggtacagcaggaagataattttcccctggagtctggccatccctcagccaaactcctctccaacatccagctgcttcctctcctctctttgctcagatgctttctcttctgtgtgtgtcccctttgtctggagtctggggttcttgtgggcacaggatagggggcagagcatgccaaaaggcaacattcaggtgggaagacagggatagttgtcactttgggccacgggtccaggcttgagtgtgaagccctcaccagtatttccctgcctcctgcctgtatcacgtacattctctcttcattcctagtgtgtgttcgtaatccaggatgaagagaagggagaagtcttcattgaaccccttttttcatgcggtcatttacatagtagcaacagactgcaggatgatttcttagattccacaaattg

SEQ ID NO: 1085 - DNA, 251 bp, Homo sapiens
ctgggattatacatgtaaaccaccatgtgtgctctcaaatagatttttaaataattgagaattacctcccaaaaaatagtataagtaaacaaattttgcaatttactaactttaaaacttttttcattaaatgacatctcaacaactttattgagaagtaaatctcttaatatgtgaatgatatttggagcatacaattaattcagtggtttttggtgtatttgcacacacaatcaatttaaaacactttt

SEQ ID NO: 1086 - DNA, 299 bp, Homo sapiens
cacgggaggctgctggcctggctgtgccttctcattaggctggaggcggcagtcacaggcaggtggcaaggggtgcgcacgtgcacaacacgcaacgccacgtgcacaacacacaacgccacgtgcacaacacacaacgccaagtgcacaacacgcaacgccatgtgcacaacacaatgccacatgcacagcatgcaaacacacaaacacaggtcacacacacgcgggtgcacacacacacacacacgcacacacagaggcccagagaggaacccgtgacactgttctacaaggcaacg

SEQ ID NO: 1087 - DNA, 531 bp, Homo sapiens
cttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaacc

SEQ ID NO: 1088 - DNA, 278 bp, Homo sapiens
cttttcttctgatatttaaaaaattcatcgatctttcaagatgaaccaaggttttttaaaagaattataggaaacacttcattctttataaaactttctataatgccttatttgaatgttaaccttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccac

SEQ ID NO: 1089 - DNA, 369 bp, Homo sapiens
ctatgggaagcaggcgatactatttgtttaagaaactgggatgccaactaacacgtggagttccccaagactttgcaatctccatttgtgagtttctgtaaaaaagggaacccagctagaagattcacagagaccttgaatgacaagcgacatactcgaaatctgcagctctcctcccggagggcccagcgtgccaggagacacgctgcagtaaggcacttaccaagctcctttggatagagggaaagaagaaatcaatccaggcaacatgcaagtttcagtgaagtcagacattttatgggaatttaaagtcttgcctgttctcagtgcaccccagtcagttactgacatgtcagcctcagaaaccgc

SEQ ID NO: 1090 - DNA, 659 bp, Homo sapiens
cacatctgggcacacactgtgagctgctcagaggcactctggtgggcagctcccatcgcctcagtcagtgtctccgtccccttcactgccttccaggggactgggcaccttggcgcccgtgccacctgccgtgagagcggtggcactgaagttgtggatgggcaaggtgctcagccactgggccatggagcgttcgtcccgctcggtgccgatgatggtggggtagatgtgctcctccttgaaggctgcgacctttccttcctcctgcgcccagtccagcggctcatgcagcccatcgttgccaaagcgctggttgtacttctcgaagtgcaccctctccaggaccaggccgagtccgggcgccttgggcacgtccaccttctctgtgccccagctgcgctccagcacgctctcaggggcataacccttcacaatggccaccaccaggccgaccatcttccggatctgatgcatcatgaagctctggcccttcaccctgatcaccgcaaactccaggccctcccgcacaaagggttcctcgcagtacatctccaggatgtagcggcaggctctgggatcctgcggccccttctgcgaggtgaaattgtggaagttgtgcgtgcccttgtagcaagccaagagcctgttgacctgctgca

SEQ ID NO: 1091 - DNA, 463 bp, Homo sapiens
atactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatatgaaagctctggtcaagattgtccctgttttcttggctttgataccttactggacagtgtatttccaaatgcagacagcatatgttttacagagtcttcatttgaggattccagagatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcct

SEQ ID NO: 1092 - DNA, 400 bp, Homo sapiens
agcctcaacttacccaggaggagctagaagcgaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttc

SEQ ID NO: 1093 - DNA, 395 bp, Homo sapiens
tacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaagctaatgtagagatgcctgattccaaacaggtgtggagaatattgaacggctcagaagccgcgtcccttacttaacacaattccgaatctccctcatccatgatgcg

SEQ ID NO: 1094 - DNA, 289 bp, Homo sapiens
gtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctctcattcaggtattttgaattgaaggtgtatgtgttgttagtaaccttgtggagattgctagtggtgttgacattatggatcttctatgtaacagactgacatgaggaagtgactttgcttacctgtataacgtgg

SEQ ID NO: 1095 - DNA, 371 bp, Homo sapiens
cacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttaggcttgggctctggctttggaggagcaggtttagcagacaacctcgcggatcttctctgtggttcgtccttcacctttgctttatctcccttagcatcccctagagcctttctcttgggcatggtggcggcggcgacggcagcgggacgtaggtgctggacgcgggatgcagcggcgcgcgggctttggtcggtccgggggtcgttctcgcctc

SEQ ID NO: 1096 - DNA, 427 bp, Homo sapiens
ccctggcagagaggcatgcacactgacgttatccacaccatcatttgccaattgacaagccaataattagagcgattatggcaaccagaaccactgacacagcaataattatccactttttccttcttgccttgctctgatatttgatagctttttttgtttcttctttagcgtgttctacatagtctgtggcattcataacatttctttctatgttgttgatcatttcgccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggtagtgaagatggatggcttcccgctctccagcatctcttctagctcgtcgtc

SEQ ID NO: 1097 - DNA, 533 bp, Homo sapiens
tgtcatggacccagctttggcagcacagtatgagcacgacttagaggttgctcaaacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaagagatgagtgggcttcggagtgaatggggcagtttaaaaaaataacttcattgtttggacctgcatatatagctgttttggaaccgcagtgattccttgagtttcatatataagactggtgcagtcacatcacaatattcagtggtgaaaacttgtttggcgctgaccaggaattccggaatctaggagaaatagacgaccccggaattccgggacccggtcctgcaggcgaacaagcttttccctatagcgaggtcgaaattaaacctttggccgtactcatgggcaataggtggcttccctgtgg

SEQ ID NO: 1098 - DNA, 452 bp, Homo sapiens
ttcctgctgttcccagaagcgaagtggagagcgccagagtaatggtgaaggcattggagtctttcagcaatcttctaaacaaagtctgtttgattcatgtaagatgtctcatggtgggccatttacagaagggaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcct

SEQ ID NO: 1099 - DNA, 438 bp, Homo sapiens
atattacccttaaaatatctatttgatatgcacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagattccaaattaagtgataaaagcaaggcaattcaaatattaacatggcataaaacttccctactttagtggtttccaaatgctatttataaacaagggatgagttcacttgcttagatatctgaaatacaactttattctgattgctgaccagcaattctgattctactagtagta

SEQ ID NO: 1100 - DNA, 385 bp, Homo sapiens
tgtttgggatgatgaatgacatgatcggaaacatggaacacatgacggctggaggcaattgccagaccttctcatcttccactgtcatatcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatccttcaacgctcccgaaaccatcgcacgggggaccaggaggagcggcaggactatatcaacctggatgagggtgaggccgcagcgtttgatgacgagtggcggcgggagacctcccgattccggcagcagcg

SEQ ID NO: 1101 - DNA, 252 bp, Homo sapiens
tggagcaggccctgtgaaggaccaagaacaaagtaatagccacagttatgaaatttcattttattctgataaagactaatatatgcttgacaacctagtgataatccataagtttggtatttcacaacattttttagagagcacataagattaacattcaaataaggcattatagaaagttttataaagaatgaagtgtttcctatatttcttttaaaaaaccttggttcatcttgaaagatcgatgaattt

SEQ ID NO: 1102 - DNA, 359 bp, Homo sapiens
tacatgttgttaagtacctaatgttttgctgaacttttaaaagttaactcccaaaatgtatagggattcatgataattaaacctttttattgctcatttttttagtagaagaatatcacttatttttagacttgtaaaatgtatggactggtgagcggacatctgttaagagagtcactagtcagaatgttaaaggagtgcatgcaggatgccccaaatgtcgtgaaatcttgttactcctgtatgtagtagtgtaagcatgtgacttttaacaccatttggtttgaaactaatgtagagatgcctgattccaaacaggtgtggagaatattgaacggctcagaagccgcgtcccttac

SEQ ID NO: 1103 - DNA, 262 bp, Homo sapiens
gcggtcccagataagtgcagaagcaagagtgaaagacattgtttgattcagatgttcattttcctgttccagtatcttaatctgtctctctgaattttctctcagtgtttctattgttttttcaagctgagctttctccttcattagatccttgcttaaattctgacaattctggagactttgcttttcttgaacaatctcattttcaagaatctcaacctttttactgagcctttgattttctttttccattttcaggatt

SEQ ID NO: 1104 - DNA, 498 bp, Homo sapiens
aacaggatggaacatcagtggatggcaggaggttgggaattcttgctgttaaaaataattacaaattttgcactcttttgtttgaatgttagatgcttagtgtgaagttgatacgcaaggaaaatggtccatgtttacccacagttttcaggtactcctagactttaaagatgtcttgaacatttaagttcttcagcagttcacactacaccgattttttgttttttttcccccccgggagggtttttttgtagggcagcacagcagatcaggacatggatgaaatactaggaatatgcacagcggggcagtgtgggggcttctcagtaatggagaacagttggtgaaacttttttttttttttttaactaagcatttaatttatcttgcatattctccacatttaaaaatgaattaagtctattaggataattaggagtttgatcccatcaacactattattgatgctgaccaggaaattcggactctagaagtaaa

SEQ ID NO: 1105 - DNA, 360 bp, Homo sapiens
aagagcctgcaatctaaaaatgaagtaactgtcgaacttcggatgaaagtttcttttatgcctaaagaattcagttctgaaaaaaggttaggagaacattgagaggttgtcattgtagatattttttaaagctgtgtatttttcctgatttttgttagaattattcaactttttctttgcatttaatatatctcgaacatctttgtattaacagtgcatgtgtatctctctcttctagctgtagctactacctagtatcctgttgtatagatttattgtgaaacagccctccattaattgataatttgattatttgtgacttccaattatttctacttttccagtgctgtaatgaacatt

SEQ ID NO: 1106 - DNA, 339 bp, Homo sapiens
ggaaatcacacaaaattcgctttaaaatagacaaagggtccagcactatcaagagaacattcaaccaggggcagcagttgaggcgcccaggacctgcttggacacacgcacatgcggccgcgacggaagcaagaggaccaggacaccgggcaagatccccgcagtgccagcttcccaggactcaggattccagtcggccatgaagcaataaatacaaacatgccccacaaggtgagaataaagccatcaaggtgatgaggaagaagtcacggggattttcttcttctaagtccaagcacagtggcaatatttcaagtattgcaaagaaaaacacacgtg

SEQ ID NO: 1107 - DNA, 491 bp, Homo sapiens
ggactaatatatgcttgataacctagtgataatccataagtttggtatttcacaacattttttagaaagcacataagattaacattcaaataaggcattggaaagttttataaagaatgaagtgtttcctataattcttttaagaaaccttggttcatcttgaaagatcgatgaattttttaaatatcagaagaaaagggaaataaaattttccccccaaaacacataagaaccacttactggcacttgtattttaagtacctgggaaaaaaacggaacagatttttaaaggcaataacgacttgtaagacggcttgtttcatttgatttggcacgaagtaaagtaagagtaaatatgccatggaagacataatcaagtttttcctccatctctcatatttccccacttctaccggaccacacagtacatcagcaaccatcctttagattccaatttttaaatggctgctcagacgacaccaatagagttc

SEQ ID NO: 1108 - DNA, 448 bp, Homo sapiens
gagtaatcatgttttaatgtagaacctcaaacaggatggaacatcagtggatggcaggaggttgggaattcctgctgttaaagaaaatattacccttaaaatatctatttgatatgtacaagccacatttttattctgacaggtcacagattttgagcaagtgcttccctaggtgaccctacctagccaatatgaaggtggagcaaacactgctttagcttaactgcactaatatttacaccatgtaacccttctaaccaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatg

SEQ ID NO: 1109 - DNA, 345 bp, Homo sapiens
aagtgaatacttttatgcttctctggaaattgttaatgtaaacatgaaatatttgaagaaccggttaaaaagtctcaagtgaatctgtaaatacatttttaagtctgactttaaatcggtacatgaggcttagacatacacatcattggacaagtgacttaaatatctaaatacaaatcaaatagcattttcctaacttcaactataaaaacacaaatttcagtaggtactgcaaatctaagaagaataacttgtataataccataataagtgttgtcaaaggggaggactcatgtgacagaccttgaaggaaaggtgggacatcacgggaggcacgtccgcctg

SEQ ID NO: 1110 - DNA, 459 bp, Homo sapiens
gaaaatgagagatatgaggctattgtaagagccagaaatagcatgcaactcttagaagaagctaaccttcaaaaaagtcaggctctacttgaggagaagcaaaaagaagaagacatagagaaaatgaaagagacagtttctcggtttgtacaagatgctaccataagaaccaagaaagaagttgcaaacaccaaaaaacaatgcaatatacaaatttctcgattaacagaagaactttcagcccttcaaatggagcgtgctgaaaaacaaggccaaattgaacgagtcattaaggtgtctgcccatggaagagaggaagcatcagataggcgtttacagcagttacagtctagtataaaacaattagaaataagattatgtgtgacaatccaagaagccaaccaattaaaaaccgaaaatacacatctggaaaaacagaccagagagctacaagcaaag

SEQ ID NO: 1111 - DNA, 719 bp, Homo sapiens
aatgtatgaactggtgagcggacatctgttaagagagtcactagtcagaatgttaaaggagtgcatgcagggtgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgccggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgaagtacctactgaaatttgtgtttttatagttgaagttaggaaaatgctatttgatttgtatttagatatttaagtcacttgtccaatgatgtgtatgtctaagcctcatgtaccggattgaagtcagactta

SEQ ID NO: 1112 - DNA, 482 bp, Homo sapiens
cttcgccgacatgttcaagatactgacatattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcaaacaacatatgttttacagagtcttcatttgaggattccagaaatttcaaatattacaaccactcctcacacgctccctgcagactggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggccc

SEQ ID NO: 1113 - DNA, 132 bp, Homo sapiens
ctcaaacaggatggaacatcagtggatggcaggaggttgggaattcttgctgttaaaaataattacaaattttgcacttttttgtttgaatgttagatgcttagctgtgaagttgatacgcagggaaaatgg

SEQ ID NO: 1114 - DNA, 395 bp, Homo sapiens
cgcatcatggatgagggagattcggaattgtgttaagtaagggacgcggcttctgagccgttcaatattctccacacctgtttggaatcaggcatctctacattagtttcagaccaaatggtgttaaaagtcacatgcttacactactacatacaggagtaacaagagctcacgacatttggggcatcctgcatgcactcctttaacattctgactagtgactctcttaacagatgtccgctcaccagttcatacattttacaagtctaaaaataagtgatattcttctactaaaaaaatgagcaataaaaaggtttaattatcatgaatccctatacattttggaaattaacttttaaaagttcagcaaaacattaggtacttaacaacatgta

SEQ ID NO: 1115 - DNA, 305 bp, Homo sapiens
ataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaaggttttattgtgcctctaaggggtatatttgggggttgggtctttttgttaaactctggatagtaataagtttcaggtcagtataggcctgaatcatgtggtttcaggtatgtttttctttt

SEQ ID NO: 1116 - DNA, 732 bp, Homo sapiens
cacacaccttcatgtacacgtatactcacacacactgtcatgtacatcatgtacacgtgcactcacacgtcatgtacacatggcatgaggtcatgtacacgtgcactcacaccatcatgtacaatgcactcacacacacaccgtcatgtacacgtgcactcacacactgtgatgtacacatggcacacacactgtcatgtacacatagcacacaccatgtacacatgcactcacaccatcatgtacacgacacatcttcatgtacatgtgcattcacacactgtcatatacacatgcactcacagtcatgtacacatggcacacacaccatcatgtacagaatcatattgtcatgtacacatggcacacacaccatcatgtacacaatcatattgtcatgtacacgtggcacacacaccatcatgtgcacatgcactcacacaccccgtcatgtacacatgcactcacacaccatcatgtacacatggcacgaggtcatgtacatgtgcactcacaccattttacacgtgcactcacacacactatcatgtacatgtgcactcacacaccatcgtgtacacactgtcatgcacacgtgcactcacacaccatcatgtacacatggcacactgtcatgtacacatgcacacacaccatgtacacacagaacacactatcatgcacacgtggcacacacactgtcatgtacatgtaaacaacacaccatgtaca

SEQ ID NO: 1117 - DNA, 213 bp, Homo sapiens
aagaaaagaaaaagaaaaagcacaaaaaaaaagatctcgaacaagatcacgttctcccaagtaccattcgtcatccaagtccaggtctagatcgcactcaaaagtaaagatccaccgagagaagaagaggaagaaaagaaaaagaaaaagcacaaaaaaagatctcgaacaagatcacgttctcccaagtaccattcgtcatccaagtccagg

SEQ ID NO: 1118 - DNA, 169 bp, Homo sapiens
aagagggacgctacactgtcctggcagaaaacaaaagtgacgagaaaaaaaaaatcaggagtcagctctgacaatgaagatgatgatgacgaagaagatgggaattactttcatccctctctctttgcctccaagaagtgtaaccgccttcaagggcttcatcagctct

SEQ ID NO: 1119 - DNA, 389 bp, Homo sapiens
taggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggggagcccgctcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcgg

SEQ ID NO: 1120 - DNA, 308 bp, Homo sapiens
catgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagtt

SEQ ID NO: 1121 - DNA, 320 bp, Homo sapiens
agaaaactttggtaaactggactatagtaatcgtatgagaaaaaaatagctcaagattcctaactgctacaagaatagtgttgatgggatcaaactcctaattatcctaatagacctaattcatttttaaatgtggaaaatatgcaagataaattaaatgcttagttaaaaaaaaaaaagtttcaccaactgttctccattactgagaagcccccacactgccccactgtgcatattcctagtatttcacccatgtcctgctctgctgtgctgccctacaaaaaaaccctcccgggggggaaaaaaaaacaaaaaaacgg

SEQ ID NO: 1122 - DNA, 277 bp, Homo sapiens
gtgaactcatcccttgtttataaatagcatttggaaaccactaaagtagggaagttctatgccatgttaatatttgaattgccttgctttatcacttaatttgaaatctattgggttaatttctccctatgtttatttttgtacatttgagccatgtcacataaactgatgatgacaggtcagcagtattctatttggttagaagggttacatggtgtaaatattagtgcagttaagctaaagcagcgtttgctccacctacctagccaatatgaag

SEQ ID NO: 1123 - DNA, 412 bp, Homo sapiens
aatgaattaggtctattaggataattaggagtttgatcccatcaacactattcttgtagcagttaggaatcttgagctatttttttctcatacgattactatagtccagtttaccaaagttttctttagatgtctgataatcttgagatgattgctcaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttg

SEQ ID NO: 1124 - DNA, 289 bp, Homo sapiens
agaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgca

SEQ ID NO: 1125 - DNA, 858 bp, Homo sapiens
cacacaccttcatgtacacgtatactcacacacactgtcatgtacatcatgtacacgtgcactcacacgtcatgtacacatggcatgaggtcatgtacacgtgcactcacaccatcatgtacaatgcactcacacacacaccgtcatgtacacgtgcactcacacactgtgatgtacacatggcacacacactgtcatgtacacatagcacacaccatgtacacatgcactcacaccatcatgtacacgacacaccttcatgtacatgtgcattcacacactgtcatatacacatgcactcacagtcatgtacacatggcacacacaccatcatgtacagaatcatattgtcatgtacacatggcacacacaccatcatgtacacaatcatattgtcatgtacacgtggcgcacgcaccatcatgtacacatgcactcacacaccccgtcatgtacacatgcactcacacaccatcacgtacacatggcacgaggtcatgtacatgtgcactcacaccattttacacgtgcactcacacacactatcatgtacatgtgcactcacacaccatcgtgtacacactgtcatgcacacgtgcactcacacaccatcatgtacacatggcacactgtcatgtacacatgcacacacaccatgtacacacagaacacactatcatgcacacgtggcacacacactgtcatgtacatgtaaacaacacaccatgtacaaacatccacgcatcatgtacacgtgcactcacacaatcatggacacacgcgtgctcacacaccatcatggacacatgtgcattcacacacaccatcatgggcacacgtgcccttacacaccatgga

SEQ ID NO: 1126 - DNA, 293 bp, Homo sapiens
gaggatcgagcaggggagggtcctgggccggagccactcacaggcgcgagggacgaggtagaagaggtgggcagaggccgtgggcagggcggggcagggtccacagggagccttgtcgatgctaccatctgtggcagggaggaaagctgagaggcctgcacctgcacctttccaggtgtgggaacgtggagggccagctgtgcaggctgcgagggagggatggggagttggctgctgggcggtgcagggatgggaacattgggctgctgagtcttcaccgggatttggagctg

SEQ ID NO: 1127 - DNA, 469 bp, Homo sapiens
caaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggggagcagttgtctgagcaacctctaagtcgtgctcatactgtgctgccaaagctgggtccatgacaacttctggtggggcgagagcaggcatggcaacaaattccaagttagggtctccaatgagcttcctagcaagccagaggaagggct

SEQ ID NO: 1128 - DNA, 595 bp, Homo sapiens
tttatcttgcatattttccacatttaaaaatgaattaggtctattaggataattaggagtttgatcccatcaacactattcttgtagcagttaggaaccttgagctatttttttctcatacgattactatagtccagtttaccaaagttttctttagatgtctgataaacttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgc

SEQ ID NO: 1129 - DNA, 504 bp, Homo sapiens
gaatccgattcctggtcagcccaacctcctgccatccactgatgttccatcctgcttgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcagatattaacatggcataaaactttcctactttagtggtttccaaatgctatttataaacaagggatgagttcacttgcttagatatttgaaatacaactttattctga

SEQ ID NO: 1130 - DNA, 156 bp, Homo sapiens
gcttaatatggagggcacagtgggtgtgctgctttctcttttccatccctctgtcaacttcattctctttagggggcaaacaagactcagatctaaacagagtttatggtttgttttgcattttgtacttattaatatttatgccgactttgaagg

SEQ ID NO: 1131 - DNA, 404 bp, Homo sapiens
tcagaataaagttgtatttcaaatatctaagcaagtgaactcatcccttgtttataaatagcatttggaaaccactaaagtagggaagttttatgccatgttagtatttgaattgccttgcttttatcacttaatttgaaatctattgggttaatttctccctatgtttatttttgtacatttgagccatgtcacacaaactgatgatgacaggtcagcagaattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatac

SEQ ID NO: 1132 - DNA, 716 bp, Homo sapiens
cgtgtgtccatgatggtgtgagtgcgcgtgtccatggtgtgtgagtgcacgtgtgtccatgatggtgtgtgtgagtgcacatgtgtccatgatggtgtgtgagcacacgtgtgtccatgatggtgtgagtgcacgtgtacatgatgcgtggatgtttgtacatggtgtgttgtttacatgtacatgacagtgtgtgtgccacgtgtgcatgatagtgtgctctgtgtgtacatggtgtgtgtgcatgtgtacatgacagtgtgccgtgtgtacatgatggtgtgagtgcacgtgtgcatgacagtgtgtacacaatggtgtgtgagtgcacatgtacatgatagagtgtgtgagtgcacatgtaaaatggtgtgagtgcacatgtacatgacctcttgccatgtgtacatgatagggtgtgagtgcatgtgtacatgacagggtgtgtgagagcatgtgtacatgatagggtgtgtgccacatgtgcatgacactatgattgtgtacatgatggtgtgtgtgcgatgtgtgcatgacaatatgattctgtgcatgatagtgtgtgtgccatgtgtacatgactgtgagagcatgtgtatatgacagagtgtgaatgcacatgtgcatgaaagtgtgtctcgtacatgatagcgtgagtgcctgtgtccatggtgtgtgctatgtgtacataaaacagtgttgtgccatgtgtacat

SEQ ID NO: 1133 - DNA, 482 bp, Homo sapiens
aggccgagcacatgacaaagaacatgcccacggcgatcctcttcagggaggatgggagcaggccatgtcttctcaaaatgggatcgaccagtttgtccttcagagggatgagcaggaggatgagcacagcatcaaacatggtcagccaggctgcagggagcgtgtgaggagtggttgtaatatttgaaatttctggagtcctcaaatgaagactctgtaaaacatatgttgtctacatttggaaatacactgtccagtaaggtatcaaagccaagaaaacagggacaatcttgaccagagctttcacatcttccactttctcttctgtaaatggcccaccatgagacatcttacatgaatcaaacagactttgtttagaagattgctgaaagactccaacgccttcaccattactctggcgctctccacttcgcttctgggaacggcaggaatacgtcagtgtcttgaacatgtcggtgaag

SEQ ID NO: 1134 - DNA, 412 bp, Homo sapiens
aatgaattaggtctattaggataattaggagtttgatcccatcaacactattcttgtagcagttaggaatcttgagctatttttttctcatacgattactatagtccagcttaccaaagttttctttagatgtctgataatcttgagatgattgcttaccttaaaaggtatagaaagaatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttg

SEQ ID NO: 1135 - DNA, 279 bp, Homo sapiens
tattattgccactgtagtgatggacaccagttttagccaacatagcatagtactctatttcagatttcctcaaagctgggcagttgttagcgagaatgaccaatttcgctttgccttgtctgatcaccttcagagtctgcttgtaccccaggacgtacttcccacttttcataacgagttggagcctagagttgatcgactccagcgactttttcgtcttctttgcggccaccatcttcctgccttaggagcgggacggcccccaaccaacagcagccg

SEQ ID NO: 1136 - DNA, 469 bp, Homo sapiens
agcccttcctctggcttgctaggaagctcattggagaccctaacttggaatttgttgccacgcctgctctcgccccaccagaagttgtcatggacccagctttggcagcacagtatgagcacgacttagaggttgctcagacgactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcactgtttggacctgcatatttagctgttttggaacgcagttgattccttgagtttcatatataagactgctgcagtcacatcacaatattcagtggtgaaatcttgtttg

SEQ ID NO: 1137 - DNA, 394 bp, Homo sapiens
gaaatcacacaaaattcgttttaaaataaacaaagggtccagcactatcaaaagaacattcaaccaggggcagcagttgaggcgcccagaacctgcttgaacacacgcacatgcggccgcaacggagcgcaagaggaccagacacaccgcgcaagatccccggggtgccattttcacaactctcgagttcacactggcctgtaacgctatatacacacacgccccacacagtgagaataataccatcaaggtgatgaggaagaagtcacggggattttcttcttctaagtccaagcacagtggcaatatttcaagtattgcaaagaaaaacacacgtgtgtgtatttttgtctgttatgtggcgtgtgaccctggaaccccccgcatgggtcca

SEQ ID NO: 1138 - DNA, 370 bp, Homo sapiens
atattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacctagggagaaattaacccaatagatttcaaattaagtgataaaagcaaggcaattcaaatattaacatggcataaaacttccctactttagtggtttccaaatgctatttataaacaagggatgagttcac

SEQ ID NO: 1139 - DNA, 411 bp, Homo sapiens
caaggttacaaacaacacatacaccttcaattcaaaatacctgaatgaaaggtttcatcccaattatggggaaaaaacttcccatctcacaggctggttagaaactggttctgaatacagcgtaacgtacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattatcctaatagacctaattcat

SEQ ID NO: 1140 - DNA, 308 bp, Homo sapiens
catgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcggtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagtt

SEQ ID NO: 1141 - DNA, 428 bp, Homo sapiens
gtattctatctggttagaagggttacatggtgtaaatattagtgcagttaagctaaagcagtgtttgctccaccttcatattggctaggtagggtcacctagggaagcacttgctcaaaatctgtgaccagtcagaataaaaatgtggtttgtacatatcaaatagatattttaagggtaatattttcatttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccacgtttacccacagttttcaggtactcctagactttaaagatgtcttgaacatttaagttcttcagcaat

SEQ ID NO: 1142 - DNA, 394 bp, Homo sapiens
gaaatcacgcaaaattcgctttaaaatagacaaagggtccagcactatcaagagaacattcaaccaggggcagcagttgaggcgcccaggacctgcttggacacacgcacatgcggccgcgacggaagcaagaggaccaggacaccgggcaagatccccgcagtgccagcttcccaggactcaggattccagtcggccatgaagcaataaatacaaacatgccccacaacgtgagaataaagccatcaaggtgatgaggaagaagtcacggggattttcttcttctaagtccaagcacagtggcaatacttcaagtattgcaaagaaaaacacacgtgtgtgtatctttgtctgttatgtggcgtgtgaccctggaaccccccgcaagggtcca

SEQ ID NO: 1143 - DNA, 262 bp, Homo sapiens
aaaaagtgcaaaatttgtaattattttgtttgaatgttagatgcttagtgtgaagttgatacgcaaggaaaatggtccatgtttacccacagttttcaggtactccttgactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtg

SEQ ID NO: 1144 - DNA, 156 bp, Homo sapiens
gcttaatatggagggcacagtgggtgtgctgctttctcttttccatccctctgtcaacttcattctcttttgggggcaaacaagactcagatctaaacagggtttatggtttgttttgcattttgtacttattaacatttatgccgactttgaagg

SEQ ID NO: 1145 - DNA, 190 bp, Homo sapiens
catgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttac

SEQ ID NO: 1146 - DNA, 412 bp, Homo sapiens
caaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttaccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattatcctaatagacctaattcatt

SEQ ID NO: 1147 - DNA, 319 bp, Homo sapiens
ttcttgggatatggttgctatgacaatgttgttgctaggattattccaaggatcacaagcaaaacaattacacaaataataatgaacatcaattttcccaccctggcagagaggcatgcacactgacgttatccacaccatcatttgccaactgacaagccaataattagagcgattatggcaaccagaaccactgacacagcaataattatccacttttcccttcttgccttgctctgatatttgatagctttttttgtttcttctttagcgtgttctacatagtctgtggcattcataacatttctttctatgttgt

SEQ ID NO: 1148 - DNA, 409 bp, Homo sapiens
caaggttacaaacaacacatataccttcaattcaaaatacctgaatgaagggtttcatcccaattatggggaaaaaacttcccatctcacaggctggttagaaaccggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaatagctcaaggttcctaactgctacaagaatagtgttgatgggatcaaactcctaattatcctaatagacctaattca

SEQ ID NO: 1149 - DNA, 448 bp, Homo sapiens
aagtaatcatgttttaatgtagaatctcaaacaggatggaacatcagtggatggcaggaggttgggaattcttgctgttaaagaaaatattaccttttaaaatatctatttgatatgtacaaaccacatttttattctgacaggtcacagattttgagcaagtgcttccctaggcgaccctacctagccaatatggaggtggagcaaacactgctttagcttaactgcactaatatttacaccatgtaacccttctaaccaaatagaatactgctgacctgtcatcatcagttcgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaaggga

SEQ ID NO: 1150 - DNA, 119 bp, Homo sapiens
tcaactgcgttccaaaacagctaaatatgcaggtccaaacaatgaagttattttttaaactgccacattcactccgaagcccactcatctccttcggcatcccacagatgaagcacatg

SEQ ID NO: 1151 - DNA, 411 bp, Homo sapiens
atgaattaggtctattaggataattaggagtttgatcccatcaacactattcttgtagcagttaggaatcttgagctatttttttctcatacgattactatagtccagtttaccaaagttttctttagatgtctgataatcctgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttg

SEQ ID NO: 1152 - DNA, 412 bp, Homo sapiens
caaggttacaaacaacacatacaccttcaattcaaaatacctgaatgaaaggtttcatcccaattatggggaaaaaacttcccatctcacaggctggttagaaacgggttctgaatacagcgtaacatacacagcaattcagatcttaagaaactcaactgttgccagttaatacagtaagtagaactttattcagcttcacccttatttcgtttttccatatatttaagtgatcctttctataccttttaaggtaagcaatcatctcaagattatcagacatctaaagaaaactttggtaaactggactatagtaatcgtatgagaagaaaatagctcaagattcctaactgctacaagaatagtgttgatgggatcaaactcctaattatcctaatagacctaattcatc

SEQ ID NO: 1153 - DNA, 670 bp, Homo sapiens
ggttggttatgatgggatggtaggcatctgtgggcatcacggggcttgctatgtacgtcatgaagaggcttggcagcgttgaagacaataaagcatgctttccaatggcagcagtgaagtacatggcgatctcatccggagtcagagcccgctcccagatgatgaactcatcgaaagcaccgttatcataacacttggcctggtcctgctcagaccctatcacgaggttgacgttggactctccatagtcacgagacacttttccactcggatcagaggtgctcagggtcccgttgacgtagactttcaggccctccttggatttccatgtaaataggacatgagtccaataggggcctggggggctgaaggaggcctcccatgtcatggaattgtcccgcgtgtacagctccacagagcctctgccaccgctggagcagactttgaacccattggagatgacctgtcccccatacgcagaagggattggtctagactgttctccttgtgtcttccagaaaaaagaaaacgtgaccccttcagggccacactgctctggcttgctgatgcaggagctgttgtacctgccgtaatagagaagcgtgactcccttttcctctttcaggtaaatgcccttgttgaccttcccttccacaatatctccagttgt

SEQ ID NO: 1154 - DNA, 202 bp, Homo sapiens
aggagtgcatgcaggatgccccaaatgtcgtgaactcttgttactcctgtatgtagtagtgtaagcatgtgacttttaacactatttggtttgaaactaatgtagagatgcctgattccaaacaggtgtggagaatattgaacggctcagatgccgcgtcccttacttaacacaattccgaatctccctcatccatgatgcg

SEQ ID NO: 1155 - DNA, 338 bp, Homo sapiens
cacatttcatctgctgcttcaaaaagtacttactttttaaaccaccaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatccggg

SEQ ID NO: 1156 - DNA, 238 bp, Homo sapiens
aaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccactccacctgggagggctgcacaggcgcaccgtctgcgttgtgtgggg

SEQ ID NO: 1157 - DNA, 183 bp, Homo sapiens
ggagtggttgtaatatttgaaatttctggaatcctcaaatgaagactctgtaaaacatatgttgtctgcatttggaaatacactgtccagtaaggtatcaaagccaagaaaacagggacaatcttgaccagagctttcacatcttccactttctcttctgtaaatggcccaccatgagacatc

SEQ ID NO: 1158 - DNA, 423 bp, Homo sapiens
agaacttaaatgttcaagacatctttaaagtctaggagtacctgaaaactgtgggtaaacatggaccattttccttgcgtatcaacttcacactaagcatctaacactcaaacaaaaaagtgcaaaatttgtaattatttttaacagcaagaattcccaacctcctgccatccactgatgttccatcctgtttgaggttctacattaaaacatgattgcttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgc

SEQ ID NO: 1159 - DNA, 446 bp, Homo sapiens
tcccttgtttataaatagcatttggaaaccactaaagtagggaagttttatgccatgttaatatttgaattgccttgcttttatcacttaacttgaaatctattgggttaatttctccctatgtttatttttgtacatttgagccatgtcacacaaactgatgatgacaggtctgcagtattctatttggttagaagggttacatggtgtaaatattagtgcagttaagctaaagcagtgtttgctccaccttcatattggctaggtagggtcacctagggaagcacttgctcaaaatctgtgtcctgtcagaataaaaatgtggtttgtacatatcaaatagatattttaagggtaatattttctttaacagcaagaattcccaacctcctgccatccactgatgttccatcctgtttgaggttctacattaaaacatgattact

SEQ ID NO: 1160 - DNA, 413 bp, Homo sapiens
ggattccccctcaggagaggttccagttaccaggagacactggaacctcaggtctataaaaactggaggggcagtgaaggcctattattcacagcacataagattctaggagacagatttgggcagggaagaggtgggggagagggttcattgcctcccttaaatatgctacaattttttttcccccaagggcctcggaagacactccatcatcaccaccatcaccatcacaaccatcaccatcacctcaacaccaacaccatcatcaccaccatcattgttgtcatcatcaccactgtcaccattgctaccatcaccatcacctcactaccaacaccatcatcaccaccatcaccatcacaaccatcaccatcacctcaacaccgacgccatcatcaccaccatcattgttg

SEQ ID NO: 1161 - DNA, 308 bp, Homo sapiens
aacttccctactttagtggtttccaaatgctatttataaacaagggatgagttcacttgcttagatatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatg

SEQ ID NO: 1162 - DNA, 238 bp, Homo sapiens; identical to SEQ ID NO: 1156

SEQ ID NO: 1163 - DNA, 237 bp, Homo sapiens
gcctgctctcgccccaccagaagttgtcatggacccagctttggcagcacagtatgagcacgacttagaggttgctcagacaactgctctcccggatgagaatgatgacctgtgagaatgaagctggagcccagcgtcagaagtctagttttataggcagctgtcctgtgatgtcagcggtgcagcgtgtgtgccacctcattattgtctagctaagcggaacatgtgcttcatctg

SEQ ID NO: 1164 - DNA, 700 bp, Homo sapiens
cttttttttttttttttttttttttttttttttttttttttttttttttttttttttttcccaggcaaaggaaaaccaatttttttggcaacaattattttttcaataaaggacttgtaaattctctcccacagcacgttaaacaggtaagggacgtcccttccaaatttcaactgttacataaaaaacccaaaaggtcaaccccacttgcaatctccacagggttacaaacaacacataccccttcaattaaaaatacctgaaggaaaggtttcatcccaattagggggaaaaaacttcccatttaacaggctggttaaaaacgggttctgaatacagggtaacatacacagcatttcagattttaaaaaactcaactgtggccagttaatacagtaagtagaactttattcagcttcacccttatttcatttttccatatattaaagggaccctttctataccttttaagggaagcaatcttctcaagattatcagacttttaaagaaaacttgggaaaacgggactatagtaatcgtatgaaaaaaaaatagctcaagattcctaactgctacaagaataggggggatgggaccaaactccaaattatcctaaaagacctaattcatttttaaaggtggaaaatttgcaagaaaaattaaaggcttagttaaaaaaaaaaaaaaagtttgctgcccc

SEQ ID NO: 1165 - DNA, 322 bp, Homo sapiens
gtgtctatccttttccttacttttactgtgatcatgctcattactctttgattctaactgtttagacttctctttacttctactcctttcctgatcttttcctttagaatcagactgcttttctttttctttaacattttcatgatcccttcctttactccttgacctcatcctcttttcttcatttctattatgttttgagtctctttctttactctttgatttctctttgctcttactcctacctttagatttggcccttttcttcactttgtttttatacttgtcatctttttctgaatttcttctgatatctctctct

SEQ ID NO: 1166 - DNA, 411 bp, Homo sapiens
gtgaattaggtctattaggataattaggagtttgatcccatcaacactattcttgtagcagttaggaatcttgagctatctttttctcatacgattactatagtccagtttaccaaagtcttctttagatgtctgataatcttgagatgattgcttaccttaaaaggtatagaaaggatcacttaaatataaggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttg

SEQ ID NO: 1167 - DNA, 389 bp, Homo sapiens
taggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattcccttcccagtgcctatcggacagtgcggcggtcgaggtcctgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcgg

SEQ ID NO: 1168 - DNA, 354 bp, Homo sapiens
acccatggccgtgtccgcctgctactgagtaaggggcattcctgttacagaccaaggagaactggagaaagaaagagaaaatcagttcgtggttgcattgtggatgcgaatctgagcgttctcaacttggttattgtaaaaaaaggagagaaggatattcctggactgactgatactacagtgtctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcag

SEQ ID NO: 1169 - DNA, 706 bp, Homo sapiens
  misc_feature (1)...(706): n = A,T,C or G
gcacctgaccacaggtgggggccgtggaaggggcagggatgggcccaggggtagccttgtagtgtgaggtgtgcccgaccacatgtaggtcaacagccagacgggacgctgcaggggactgtggggaagccgggagaaggcgctgcccaccctgtggggtccccctcgcctggagaccctgcaggcaacccttcagtgcatgcccacgggggtggtggaggcagagtcctgagaggtgggggtgggagcctccgggtcccctgcaggtcctgacccaccagatgggcccatgtgccccctgtagcttggcggctctggaggtggacaccagcacctcctgactaccagggggagggcttggactgaaacccacaccttcaccattcgccactgggccactctgcaggaactgcagcaccccacagatccttcatgcccagcacgccactcactctcacaccctctcgcacacatgcacacacagcacgcacacaccaggctcacgcgctccgcacaggtggcacgccaggggcaagcgtgcacgtagactcagagatgcaaggacagtattggcaattcagaggcatagaaagacgctgaggggcccncagcaaggtccncgccctcaggggctgtgttcccctcccagggcacgcacaccacaggcagcaacgcgggtgggggcactgtgacgccagtggnggga

SEQ ID NO: 1170 - DNA, 720 bp, Homo sapiens
cgtgtgtccatgatggtgtgagtgcacgtgtccatggtgtgtgagtgcacgtgtgtccatgatggtgtgtgtgagtgcacatgtgtccatgatggtgtgtgagcacacgtgtgtccatgatggtgtgagtgcacgtgtacatgatgcgtggatgtttgtacatggtgtgttgtttgcatgtacatgacagtgtgtgtgccacgtgtgcatgatagtgtgttctgtgtgtacatggtgtgtgtgcatgtgtacatgacagtgtgccatgtgtacatgatggtgtgtgagtgcacgcgtgcatgacagtgtgtacacgatggtgtgtgagtgcacatgtacatgatagtgtgtgtgagtgcacgtgtaaaatggtgtgagtgcacatgtacatgacctcgtgccatgtgtacatgatggtgtgtgagtgcatgtgtacatgacggggtgtgtgagtgcatgtgtacatgatggtgtgtgtgccacgtgtacatgacaatacgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggcgtgagtgcatgtgtacatggtgtgtgctatgtgtacatgacaatgtgggtgccatgtgtacatcac

SEQ ID NO: 1171 - DNA, 154 bp, Homo sapiens
cttgtccaatgatgtgtatgtctaagcctcatgtaccgatttgaggtcagacttaaaaatgtatttacagattcacttgagactttttaatcggttcttcaaatatttcatgtttacattaaaaatttccagagaagcataaaagtattcactt

SEQ ID NO: 1172 - DNA, 476 bp, Homo sapiens
gtgaatcctctggctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggattttttttttttaaagataaaagcatggtcagatgctgcaaggattttacataaatgccatatttatggtttccttcctgagaacagtcttgctcttgccatgttctttgatttaggctggtagtaaacacattttatctgctgcttcaaaaagtacttaccttttaaaccatcaacattacttttctttcttaaggcaaggcatgcataagagtcatttgagaccatgtgttccatctcaagccacagagcaactcacggggtacttcacaccttacctagtcagag

SEQ ID NO: 1173 - DNA, 518 bp, Homo sapiens
aaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccg

SEQ ID NO: 1174 - DNA, 425 bp, Homo sapiens
cagggatgggcccaggggtagccttgcagtgtgaggtgtgcccgaccacatgtaggtcagcagccagacgggacgctgcaggggactgtggggaagccgggagaaggcgctgcccaccctgtggggtccccctcgcctggagaccctgcaggcaacccttcagtgcatgcccacgggggtggtggaggcagagtcctgagaggtgggggtgggagcctccgggtcccctgcaggtcctgacccaccagatgggcccatgtgccccctgtagcttgccggccctggaggtggacaccagcacctcctgactaccagggggagggcctggactgaaacccacaccttcaccattcgccactgggccactctgcaggaactgcagcaccccacagatccttcatgcccagcacgccactcactctcac

SEQ ID NO: 1175 - DNA, 414 bp, Homo sapiens
gtgattgttgtgcccgctgaagtatgagaaagattttctttgcattggatgatgtgacgtgctggaccaaaggcagcatgtggcttgtgacgtgagatggaccagggctcaaagacccccagtcagagacttcgggtgtgattgttaacctgcctgaggctaattgttcatttgctccaagggctttgatgaggagtgtgtgagatagggcatagaaaacattaaacctgaggactcctggtgcaggtgagcttttcctcccgcttcctcactccgcgtttcttgcttcagattccttcccaacacttctgtctcctctctttccatgtatacagctcaagagaacaggtggcattacccgcctccccgtctccgctcccagggatatgtaattctgtgtcatgcatctccagg

SEQ ID NO: 1176 - DNA, 395 bp, Homo sapiens
taattttggcccttgtaaatgtttttatgactaccctgaatgactaagtacattgttgttcctgttggagggtcttgggaaatagaaatctcttctgaagggatccatgagtcagagcttgactaaaacaaatcaagaattgacattaagaatgagataaaatggaattccatcttgtgcagagcgtaggttctagaggtagcatttaaaaccaaaatctcgtatagtcaacattctccttgaaaactccccacacgcacggcacgtctgatcgcatatgtacagccctgcacatcatatcctacgcacagtcaagattttcagcccctaagctcagtggaagaaagccaacctctgactgtctgactctccaagccattctgttttgaggtaca

SEQ ID NO: 1177 - DNA, 251 bp, Homo sapiens
cataccctcatcgacgtttggggtcctcggtctttatgttagccttgctcagagtgtgtgtgatgtgtccagtggaaaatcattgtgattttgttttcctaatgaccagtgacgttgagcaattgttcctgtgcttattggccatttggaattcttttccgtgaagtgtcattgtcccagaaacgggtcactatcctggtatgttcagcttcttcttgcctttatagaaccagtcttcttcttcttcttct

SEQ ID NO: 1178 - DNA, 432 bp, Homo sapiens
cttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggc

SEQ ID NO: 1179 - DNA, 603 bp, Homo sapiens
cacgtgtttggtgactcttactctctcctttacgagctgtcctttatgttttccgaacattccagttatactctgggttgtttttctgttctagtgatctctccaaaggagacctatgatccaggggtgacttggaattgtgaggagatttctgagaagggggtgagcgaggatctgaggctgcagggtgcaatgggggtagaggctgtttatattcccccagtttatctgtgtggaaagagcggtaatggtctgagggtccctggccatggtagcccatagcggggcggtgatcagacattcgtcggaaatcctgctggtggtaattttgaggcctaaattcatcggatctcctccgcttggagttatgatggtgcctgtcataataatctctgtgtccccggtggtctcggtcactgctgtactggtcataaggcctctttctggacatgttgggtcgatagcttccggaacggcgggcatccatatgtcgccggtccccataatggtggtccttgtaccagtgctgctcatactgatggtgcctatcgcttccccatggtggattgttgttgccaccaccatagttgaactttctttccc

SEQ ID NO: 1180 - DNA, 277 bp, Homo sapiens
gtaaataagagcttaaaaaatatttgtcagagttaatgaaattacaatctagcatatactaaatccaattttatagtaaattatttccatactagtttcagaaagaagatacgtgtgactacaactggttgcattaaaatggccattgaagatttggaattaataccattcactaaggtgaatggaaagaaggggtgagctcacacttttgctgctgttcagctgcagtttctgtcaggctgggttcccagggaagcacatcaggttacactgtgtt

SEQ ID NO: 1181 - DNA, 252 bp, Homo sapiens
ggacagtgatcccccaaaagccggaggtggaggaggaggaggaagatgtggactttgaggaagaagaggaggaagagggcaacgaagagggctgggttctagaaccccaggagggggtggtcggcagcatggagggccccgacgatagcgaggtcacctttgcattgcactcagcatctgtgttttgtgtgagcctggaccccaagaccaataccttggcagtgaccgggggtgaagatgacaaagccttcg

SEQ ID NO: 1182 - DNA, 516 bp, Homo sapiens
ctcgggagttcctcgtcactgactttatatatataaaaaaaagaatgcacatgcgggccacgttcacagatagacagattcacccgaaatgagaatgagggccttaaggctgccgaaaacaaatgggtggaaatagcaacgttgtttccgtcaattccaaatgtgcactggctgcgtgagacaagccaatctccaattcctatgcttttttcattaaaaagaaaaaactatctcgagaggaaaaagttctggtcaaataggagttcagtgtttgttatctggtaacagtttttttatcttcctacaattacttggggaaggagtgtcttcggggaggaaaaactgacacactgacaaggctcccgaaattggacagaatggttaaggatatagctcttccttttgggcttttctaccagtaggcttctagcacctgaattttcacacactgcaccacagactttctccaaacgcctctccgaccctacagcttctgcacccagctgcgtccgccag

SEQ ID NO: 1183 - DNA, 311 bp, Homo sapiens
gacagtttctgattactgattcagtgttctttcttgttattggtttgttgaacttttctatttttttcatgattcagtcttggtatgtttctaggaagttatccatttcttctaggttattcaatttgttagtgtataattgtttatagtagtccttaatgattctttgcatttctgtggtattaaatctgatttctcctctttcatttataattttattgatttgagtcttttttcttcctttttattagtctagctattggcctatctaccttacttattttttcaaaaaaccaactcctagattagcc

SEQ ID NO: 1184 - DNA, 440 bp, Homo sapiens
tcccaagactcttataccctaagagtagttctgagctccatctggagaccaggacctaagtcccaatccccaaaccagcctgaacccctaatccacgaccagcctggattgccacccctgatactggccactgagttcccctgatactggccactgaagtcgtgtcttagaactctagttatttcagcaccctcctgcctcatcccagagcagagaggcaggcctgcaggatctctgcaccactcctcagggttctaacagaactctcaacgctcctattcccaggtcacccccgaggttccatactggccaccatccccgagagaggaaccatcggtgttcccctgatcactggcatggccgcttctgaggccctgcccccttacccttcacccccaacagggacagatgttcctggcaggacctctcctcaaagcccc

SEQ ID NO: 1185 - DNA, 607 bp, Homo sapiens
ctgaggttcatctatgcaatgcaagagctgaagacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagcttccatcgcctcagtcagtgtctccgtccccttcactgccttccaggggactgggcaccttggcgcccgtgccacctgccgtgagagcggtggcactgaagttgtggatgggcaaggtgctcagccactgggccatggagcgttcgtctcgctcggtgccgatgatggtggggtagatgtgctcctccttgaaggctgcgacctttccttcctcctgcgcccagtccagcggctcatgcagcccatcgttgccgaagcgctggttgtacttctcgaagtgcaccctctccaggaccaggccgagtccgggcgccttgggcacgtccaccttctctgtgccccagctgcgctccagcacgctctcaggggcataacccttcacaatggccaccaccaggccgaccatcttccc

SEQ ID NO: 1186 - DNA, 275 bp, Homo sapiens
ctgtctttagttccagaattttttatcactctaaacagaatctctatgctcattaagcaataactcccccttcctccctcccctattccctagtaacctctattctactttttgttgattttttttaaaaaaatcaatctcatatttcatgttaataagccaagtttaagcaacactttaagatgaactaaggttgtgtaaattaattgccagccttggtaattaagatgcgataactctttatccatccctcacatgacaacctcacgcgagta

SEQ ID NO: 1187 - DNA, 472 bp, Homo sapiens
cagcttcccacactgtcaagcaggagcgatttgtgtcccatggctttgagggggctcaagtcagcatcaggtgctacagtcggtctcacagtctcacgccttccatgctcagacaccttcccctacaacgtgcccagcaaggtacttttcaccccatgttcagacgcgggcctgactgtgaaggtttcctgtgcccggctcccctgggctgctctccgcccctgagtgtgatatgggacctactggctgtcggcattctttggaacccttgtgtcttcgggggttgtaaactccaatacaagaagttccacgtgtgatgtaagctgagtgtaaggcagaaagtgccacgtagcttttatgtcttccaaccgcaacacctgctggttctgtatttatagaacactccaaggccttcccaggcagcttggcaaagctgtccaccccgctgtgttaggggggcttacagcgtgag

SEQ ID NO: 1188 - DNA, 170 bp, Homo sapiens
tgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtg

SEQ ID NO: 1189 - DNA, 557 bp, Homo sapiens
ccccacaccagaacagctgggcaaagtaaaaaattaccttcctgtgttcttgccaccagaaacaagtgttagccggtctggtgttatttccttcctgccttttctgaggcagtgttcctctcctcaactacttcaggggaacttcctccatttatagttatgattggcctggaactgcattgttgaggaaggcagatgcgaagataacaaaagagcgcctgactatctctttatcgaatcctgaggtgagcgtctttgtaacttggctatggaacctgtgcacttcttagcatcacagattgcactatgacacagcctgaacatcgtgaattctggattcactgcatgggtcactgacacacccaacacaccagggccgacagctgggcaatgtatcaaaggaagagatgagctggtctctgaatgtgtcttaaacatgttcaggttttagcatcctcaaactgacacaagcagatacctctgcatactttaatacaaagagttagcatacactgaatacccaaccgagtcccgggcactatggaggcactttacac

SEQ ID NO: 1190 - DNA, 403 bp, Homo sapiens
tgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtca

SEQ ID NO: 1191 - DNA, 516 bp, Homo sapiens
gaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttgtttttagacttgtaaaatgtatgagctggtgagcggacatctgttaagagagtcactagtcagaatgttaaaggagtgcatgcaggatgccccaaatgtcgtgaactcttgttactcctgtatgtagtagtgtaagcatgtgacttttaa

SEQ ID NO: 1192 - DNA, 689 bp, Homo sapiens
  misc_feature (1)...(689): n = A,T,C or G
ctcctgtgtccctgcctccctgggctcccgagataggcaccactgtatcctccagctccttccttccttcccccaggaacacggaggccaccgagggggctgggcctatcaggaggacacaggctacagcctggcacccacccctcccatctccaccccacacggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagctttctgtggactgttccccccactgtggtaggacaggactggccaacttagtcctcaagctcccaacctgctgtccctcaagccccgcttctaccagcctgtggagttcaggaggcgagacatcctgncctcctttgagaactgatgggatctaccccctgtccacgcgggacagtttctcagaactggttcatagaccacctgtgtcaccaacagccagatacctaatccctgagcctcctttgggaaggtctggggccgagggtctgggaantttttttttttttttttgggacagagtctcattctgtcactcaagctan

SEQ ID NO: 1193 - DNA, 357 bp, Homo sapiens
gtcgtagttgcctttgctcttaaacagctgctggaagtggggtttgcagtagaactccccgtgcagcgcggcgtagctgcccaggctgagcttagtgtgacagtgcttgcagcagaagcaagagttgtggaaaatgagcttgtcggccaccagccgctccatggggtgcacggtcttctggcaggcggcgcaggtctccttcacctgggcccgcaggctgaaggacttggagcgctgcaccgtgctgctgccgccgcctttggcgtcatgagagggggtggcctgggcggctcctgcagcctggaacatggctcgttggaggtggaagcctcgggtggagaagcggcacccgctggg

SEQ ID NO: 1194 - DNA, 508 bp, Homo sapiens
ctgaggttcatctatgcaatgcaagagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtccccttcactgccttccaggggactgggcaccttggcgcccgtgccacctgccgtgagagcggtggcactgaagttgtggatgggcaaggtgctcagccactgggccatggagcgttcgtcccgctcggtgccgatgatggtggggtagatgtgctcctccttgaaggctgcgacctttccttcctcctgcgcccagtccagcggctcatgcagcccatcgttgccaaagcgctggttgtacttctcgaagtgcacgatgatccagaattctcggtagtagtagta

SEQ ID NO: 1195 - DNA, 340 bp, Homo sapiens
gtaaggtggagtgggtttggggctaggtttaggtgggagtgtgttccacagtggcttgtctagtttcaatccatttcccgcccttccttcgttgagtgatccctgcaaactacattctccggaccccttgccaactggattttggctacatgtagccagcaggaggccctggtgggcagttgacagtgggaaggaaaaaagaagcctgggtgttttttggcctctgcttctgatggtgtcacaggcagtggctcccgttcctctgtggctgcagcccccacagggaaactctcagtgtagacccagctcttatccagtgaattcacccctggggtcatca

SEQ ID NO: 1196 - DNA, 539 bp, Homo sapiens
ggctcattcaagagagccccaccctgagcaagctggccgccattactgtcccccagcccttctactatttggtgcaacagaccatccactggctcttcatgggttactccatgactgccttctgcctcttcacgtgggacaaacggcttaaggcaagtgaaggcctgcttgtgagactggagggactcactgcaacctcaaaggttgcaaaggacactccaggcctgtctaccttagtggcctctctctccacaggtgtataaatccgtctatttccttggccacatcttcttcctgagcctactattcatattgccttatattcacaaagcaatggtgccaaggaaagagaagttaaagaagatggaataatccatttccctggtaagttaatacagctaaactaaaactaccaccaggttacagaatagagcaacagactggaaaaaaacaatagtattagaaatctggggtgaattccaaggattagcctggctactaagggacacagtatgggcaatgactactgtgacttattg

SEQ ID NO: 1197 - DNA, 342 bp, Homo sapiens
ctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacgac

SEQ ID NO: 1198 - DNA, 644 bp, Homo sapiens
  misc_feature (1)...(644): n = A,T,C or G
gccagctgttgcccagctcttgctgggcccgtttgtaggccctcctgcaggtcggctacctgcgtttgggaggcaactagcctggaaggccactgtcagtgctcaaggtgatagccacatattcctgaacccggtgtcgtcctgttgtagctgggatactgtctcaggccagcagcatgacggcatcatcagcactggtgaggatcgtgagcggggtgagggctccaagggtgctgtgctcaggagctgttctctccaggcacgtgcctgctgtgccgcatgtatctgcagcagggcgggcgggtggaatccatccctcgtggtgggtctgcattcaggaacctgaacgtggtggtggtcactgatccggaaactgttaagggaagtcctgtgttgagaatgcaggcgcctgcccagagtttggaggtatttagcaggtggggccaggaagtgtccctctccatgagtgttgcaggcaggcattctctccttaaacacggngtctgctgatctcacaggagtctcttcttgtcccaaccccttaatgtgtccaggagaggagataggacatgaacacatcccatcaaaatcaggggttaggacccatccatcctcatccctccactgtgtgcgctgctgggatc

SEQ ID NO: 1199 - DNA, 796 bp, Homo sapiens
ccagaacccccccatacgtatcacggttgtgcgtggggtactcttacactcacgggggtgccgggcccctggaacctgcaactcacgcaggatgctcttttaacttactctattatgtttcctgttttatacggtgctgtatcgttggctctgtctttaagatcattcaccttttcctccatgtgtggtctgtgaaccccatccattgtagccttgatttctaaaagtttggtttgcatatttttaaatggtctatgtttctacttagctctttcaacacagggaacgcagtcaggatgactgtcagtgtctgtctggcgattctaacacttgtgttagttctgaccaggatttcgcagtggatttttcctccccttacgggtgggttttcctgcttccccgaatgtaatctttgaatcgatggcagacattgttaacatcacctttgttgggtgtggatgtttgtgtttatgtggaaacattcctgcacctttttctggcgtgcggttcagttacatggaaaaggtttggcctcaggtcttattttaaagtggccatcagggccgaatgttctgcccattttgtccacactaattatccctctttggggagcaagacccttgtgagatgccaccgccaccctcgggaggcctccaggctgggggacgggcactgtgggctgctggtgtaaggccggacgctctctgacaggtgtggcccctggcctccagcggcttcctcccaagctgggttggggctcttctgaacgctcccctccatgcccttgcctgggaac

SEQ ID NO: 1200 - DNA, 316 bp, Homo sapiens
  misc_feature (1)...(316): n = A,T,C or G
ccatttcacatgtcatcctcccagctcacagacctagaaagtgggtggtgaagtttgcctccgtttgagtgatgcagcaggccctttgagggaatctgtggccccttgaccccactgctgccgcctctccacaaagatccagggggcaagctgtgggaaacagccctctgacaaccctcctaccccactgagcaccagcctggtcagcccccgtatgggcaccgagatcatcagctcctgcccagcctgcacctccctcaatctcacaatcgccctatgggaagatgctnnnnttttttttttttttttttttttg

SEQ ID NO: 1201 - DNA, 685 bp, Homo sapiens
  misc_feature (1)...(685): n = A,T,C or G
ctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaggtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactntaaagatgtcttgaacatttaagttcttcagcagttcacactacaccgtttttttgtttttttttcccccctgggagggtttttttgtagggcagcac

SEQ ID NO: 1202 - DNA, 556 bp, Homo sapiens
ccccacaccagaacagctgggcaaagtaaaaaattaccttcctgtgttcttgccaccagaaacaagtgttagccggtctggtgttatttccttcctgccttttctgaggcagtgttcctctcctcaactacttcaggggaacttcctccatttatagttatgattggcctggaactgcattgttgaggaaggcagatgcgaagataacaaaagagcgcctgactatctctttatcgaatcctgaggtgagcgtctttgtaacttggctatggaacctgtgcaccttttagcatcacagattgcactatgacacagcctgaacatcgtgaattctggattcactgcatgggtcactgacacacccaacacaccagggccgacagctggacaatgtatcaaaggaagagatgagctggtatctgaatgtgtcttaaacatgttcaggttttagcatcctcaaactgacacaagcagatacctctgcatactttaatacaaagagttagcatacactgaatacccaaccgagtcccggacactacggaggcactttaca

SEQ ID NO: 1203 - DNA, 415 bp, Homo sapiens
ctcaggacctggtctcaaggcagccccactcgagtcttctggagtccaaggcacgccgctcgcccaaaagggagggggtgtttgggggggctttgactgtctccagacctcaggggagctgggcaggctctaaccagtgatcctccagagagcagcgttgaccacctggacccctgcgccacgtgacaggaggctctggtcctgcaggcctggtcttgcccagctgggccgcctcaggtgtcaggaaggggatgggtgtccctgtctcccaggccaggcagctgctgacctccagcaccccgcacttgctcatgaggaccccacccccgcaggccctcccgggttctgaccagcctctggtgcagcatctgctttggcctccgggccccctcgctccccaccgtccttgacagac

SEQ ID NO: 1204 - DNA, 445 bp, Homo sapiens
cttatgttgaccctcgggcagtgttgaggggcaatgaagtgacaaacagcagggagaaaatgaccagtctctgcaaatagacaactcagaatggtccccagctagccgccttctgctcctgaccctggtgtgtggatttaagtcatttctgaagattcaacctgatgagctgtcgaccacaaatgaagacagaacggatctgagagatgaatgatgtatctggggttagcatctggatgatccgagtaatggttttgggagaggcaaagcctagaattagccacccctgagggacagtgctttcctgcccccggcagagcggcctggggggagttgtgcaggaagcaggtgcaggcagccccgctggccgggtcactggggttctctgtgacgtcagggtcagagaggcccacacggagggctggagcctggtgctggtgcctga

SEQ ID NO: 1205 - DNA, 413 bp, Homo sapiens
tttatcattaaagtttggtaagcaatgaaaaaaaacacaagtgacactttggaaaagcaagcctgacaactcaggcgacacattcaatataaaccatggtgtgaaggcacagcacgcttgagcacagcacggagccatcagatccagacatgatctgattccgcggccctcccttcatcagttctcgttttcgagctctaattccaaaaggaaacgtcagggatagaaaaaggcctatttggtcattaatgtgtccattctggccagctcagaggtcatccctacagtcatgctccagggctatgaagaatccagttttaatggtctcaaacgatgggctttcttcacgtggagagactattccacagtttaatggttggtcatggttagcttttcagtccgggccccagaag

SEQ ID NO: 1206 - DNA, 282 bp, Homo sapiens
gtgaagtttctttttgggttgataaaagtgttttaaattgattgtgtgtggaaatacaccaaaaaccactgaattaattgtatgctccaaatatcattcacatattaagagatttacttctcaataaagttgttgagatgtcatttaatgaaagaagttttaaagttagtaaattgcaaaatttgtttacttacactattttttgggaggtagttctcaatcatttaaaaatctatttgagagcacacatggtggtttacatgtataatcccagtgctttgg

SEQ ID NO: 1207 - DNA, 411 bp, Homo sapiens
ggccagtcccctggccatgtgcgcaggggcagaagtggtgcacaggtactaccgaccggacctgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagtgtggagaactcaaaacggagcttttgggactgaaagaaagaaaacacaaacctcaagtttctcaacaggaggaacctaaataactatgccaagaattctgtgaataatataagtcttaaatatgtatttcctaatttattgcatcaaactacttgtccttaagcacttagtctaatgctaactgcaagaggaggcgctcag

SEQ ID NO: 1208 - DNA, 274 bp, Homo sapiens
gtggcattttcagcttgatatggtaacatgatcgtgaccttcagacagcataaatatatgtgccatctcatgtgcaattccttatagacccagcttggttcttctccaatgtctccttttggagttgtacctgattttatttccagttttcatccgaatccactggggaatgggacgatttagcttttgtttcttggccaggaatcgcttaatcctgaaagtcttgtgagaagacatggcgagcagcggagtcaagaacacaccacgatggcgg

SEQ ID NO: 1209 - DNA, 636 bp, Homo sapiens
gtccaacacccactacagtgatcttattgtttggaactgttggtatggcgtgtgctatcagcattctgggaaagtctctggctgatgaacttgctcttgtggatgttttggaagataagcttaaaggagaaatgatggatctgcagcatgggagcttatttcttcagacacctaagattgtggcagataaagattattctgtgaccgccaatcctaagattgtagtggtaactgcaggagtccgtcagcaagaaggggagagtcggctcaatctggtgcagaaatgttaatgtcttcaaattcattattcctcagatcgtcaagtacagtcctgattgcatcataattgcggtttccaacccagtggacattcttacgtatgttacctggaaactaagtggattacccaaacaccgcgtgattggaagtggatgtaatctggattctgctagatttcgctaccatatggctgaaaaactcggcattcatcccagcagctgccatggatggattttgggggaacatggcgactcaagtgtggctgtgtggagtggtgtgaatgtggcaggtgtttctctccaggaattgaatccagaaatgggaactgacaatgttagtgaaaattggaagggggag

SEQ ID NO: 1210 - DNA, 465 bp, Homo sapiens
gtggttgtaatattagaaatttctggaatcctcaaatgaagactctgtaaaacatatgttgtctgcatttggaaatacactgtccagtaaggtatcaaagccaagaaaacagggacaatcttgaccagagctttcacatcttccactttctcttctgtaaatggcccaccatgagacatccattactctggcgctctccacttcgcttctgggaacagcaggaatacgtcagtatcttgaacatgtcggtgaaggcactgccatcaggaggcttggtgatgaaaacgctctggccacagaggaagaccacaaaagcaaggccgacgcagacagtggggatcgcataaccagtgacaaagctgacgttctgctgaatataggcaatgccacctaacgacaggatcgctcccaggttaatgctccaataaaaccaattaaaaaatctcctaggggcttccggaccta

SEQ ID NO: 1211 - DNA, 301 bp, Homo sapiens
cgtaatcttccaaggaagttattgttgtcaaccctatttcatggctgaggaagcatgggcttagagaagtttaatagcttgctcaaggtcacaagactaatgcctggtagaatggggactcagaccccaggttcctgcttttacaaagctcaagcccttaggcaccttgcgtctctcgagggtgatctgatgccccagagttggagccatgcatttatgcatactgagcgaggtagggttcttgtcgagggggagacggttgaaggagacactggtggaaatgtgtgtggttcactcatac

SEQ ID NO: 1212 - DNA, 472 bp, Homo sapiens
tgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggc

SEQ ID NO: 1213 - DNA, 636 bp, Homo sapiens
  misc_feature (1)...(636): n = A,T,C or G
gaccacctcgatctcctccatagccacctcctcggtctcctccatggccgcctcctctgtccccaccatagccgccgcctctgtccccacatagccacccccacttctgtctccaccatagctgcccccacttctatctccgctgtagccaccaccgctgcttctgtctccaccatagccacccccacttctgtctccaccatagccgcctcggtctccacctctgcccccacgacctctgtagcccctctctccaccgtagcctctcccccggaaatctcctcctgagggacgagagtcctctggtctaggctcattgcactgattgcaggaattccttcgagcaaagttcatatttccgcatgacggatcagggcaaacccaatccccacttttggggtctccacctctcccttgaaagcctccacgacctctatatcctccacggcctcgccacccacctccacttccacctcctctcatgaattcaggtcttctagtggcaaaggacactntaatgatgttgccatggaattcttttccatcaaaccagtcaatggctgccttagctgaaggagggtcatcaaatgacactgttgccctcccctttggcttcctgtgtccttgtctgaataa

SEQ ID NO: 1214 - DNA, 497 bp, Homo sapiens
taaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatattcggaagccaaacgccaag

SEQ ID NO: 1215 - DNA, 657 bp, Homo sapiens
gttgaaggaaagttgctgccattaaacttctgataatgtttacagccagcagcgccagggtttttgtgaccatgttagacaaacaaccagaggggtttctggaaacggtttttataaagtctatctagattaagaatttagtaacgtcatatatttatatcaacagactatttacacgtttcgtttgctttcaaaaaaacaaaccaaaaaagaaattacacttctgcataataaggcaaaaaaacaaagttttgtacattattattttaatataatctgtaacttcggttccaagtaccaagggggggccagggctggcctgagtgggggcctcacagtgcgctggacaaagtgaccggtttttctccataaataagacaaagaaaccctggggatctggagaaggatctgaggccattaaactgcaaatcccaaccgaaaacgaagaagcgaaagcttcttttttggttcttttaaacgtctaaagagcataaaattaagaaaaatacaaatccattacaaacacttctcatctgtggggggaaaaggtacaaacgcgattttttttttcccaacagccgaatcccaaactcggaaaacaaaagatcacccttagaaaagccgacacccaagtccccgcctccgcaggctgtggtt

SEQ ID NO: 1216 - DNA, 435 bp, Homo sapiens
tcaccatcactatcatcaccaccatcatcaccatcagtgacaccaccgtcatcaccatcaccatcatcaccattgtcatcaccctcaccatcattaacatgaccaccaccaccaccattactatcatcaccatcattaacatggtcaccatcatcaccatcatcaccattaccatcatcactattatcaccatcatcatcaccatcatcaccattatcatcaccatcactatcatcaccaccattactgatgccaccatcattaccatcaccatcaccaccatcaccattgccatcaccattaccaccatcatcaccatcactatcatcaccaccatcagcaccatcaccatcaccaccatcatcatcaccatcactatcatcaccaccatcatcaccatcagtgacaccaccgtcatcaccatcaccatcatca

SEQ ID NO: 1217 - DNA, 372 bp, Homo sapiens
tcatcattactatcaccatcatcactattaccaccatcatcatcaccaccactatcaccaccatcatcaccatcactatcgccaccatcatcactatcaccatcatcaccatcactatcaccaccatcatcaccagcaccatcatcagtattaccaccatcatcatcaccatcactatcaccaccatcatcatcaccatcactatcatcactatcatcaccatcactatcaccaccatcatcaccatcactataaccaccatcatcactatcaccatcatcaccatcactatcaccaccatcatcaccatcactatcaccaccatcatcatcaccatcactatcaccaccatcatcaccttcactatcacca

SEQ ID NO: 1218 - DNA, 673 bp, Homo sapiens
  misc_feature (1)...(673): n = A,T,C or G
ccagcaccatgcccatgacactgggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggngcaacaagtagggccttg

SEQ ID NO: 1219 - DNA, 382 bp, Homo sapiens
cagttgttgtggttgagaaagatcatttcatggatgatttcttccatcaggtggaggagattagaaacactattgataaaataactcaatatgctgaagaagtaaagaaaaaccacagcaccattctttctgcaccaaacccggaaggaaaaatataagaagagcttgaagatctgaacaaagaaatcaagaaaactgcgaataaaattcgagccaagttaaaggctattgaacaaagttttgatcaggatgtgagtgggaaccggacttcagtggatcttcggatacgaagaacccagcattcggtgctgtctcggaagtttgtggaagccatggcggagtacaatggaggatccagaatcctcgagtagtagtagtagta

SEQ ID NO: 1220 - DNA, 459 bp, Homo sapiens
ctgtctctttgaagacacagtaagtcaatgtggttttgtactaagaggcactgaacgtgacctagaaaagctccagccctccaaagtgtctagctgatacctaaagggtgtgttcattcattgagctttgcagttaacagagaaagacatgggctgaagcagagtgcactcccgtcggatgtcacgaatagtggtgagattcagggtgttaaatctgttgtatgccatagtctttccaataagaattataacatttccaaacatcgactgcttttcagggtcaagtattcaatttaattacacttctgaatacagaactaggaggggactaaggcgatttcatgcttgaagttgactatttcctgcagtgtgactagggcgcgtgctgaagattgggagatggatctgagaagtgggcgagaggtcaagtcttgggacacattaaaattcttattggaa

SEQ ID NO: 1221 - DNA, 528 bp, Homo sapiens
  misc_feature (1)...(528): n = A,T,C or G
gtccaaaatacactgaggtgccattacgggaaggaagaggggtgcatgcggagggctggagctgacagccggctcacagatggggctgggggctgcaagaaatggaacatactttctactttttggctgtcaccccacaggcaagtttgaaacccaaagggcaaatggcttagctgatttatagagcctaatttggatccgttgcctcaaattgaattttgaattacaatttcacatcaattaactttgcacagagccttacagatggcagggaaggactctctaaagcaaaggccagtggctacgatggaggagctgatgtgccatcccggagcccaccgatgctcatagcaccactcagggctctgacccgggcgggttggaaggatgagagctaaggggtgtgacgtgagcaggaaagggacccgggctggttggaaggatgagagctaaggggtgtggcgtgagcaggaaagggacctgngctggtggtgggaccagagagctgagccctaggggctgggaagg

SEQ ID NO: 1222 - DNA, 253 bp, Homo sapiens
tcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcactcgcttcttcctccacttggctctcatggcgcagaggtttccaaaaaaatggcg

SEQ ID NO: 1223 - DNA, 563 bp, Homo sapiens
ctttccactttccaaattccagagctcctacctgccagccctgcaaggatgggatgtgggtgtgtgtgtcggtgtgtgtggtgtactgaggctgggtatgtgcacatatgtgcctatatgggtgctggatgcaggtacatgcactgggtgtgtactgagtgtgtgtctgtgctgggtgtgtgtgcacttgttgtgtgtgtctgtgctggctgtgtgtatactaagtgtgtgtgcctgtgctgggtgtgtgtgcactgagtgtgtgtggactgggtgtgtgcacactgggtgtgtctgtgttgggtgtgtgtgtactgagtgtgtgagcactgggtatgtgtgcactgggtgtgtctgtgctgggtatgtgtactgggtgtgtgagcactgggtgtgtgtgcactgggtgtttgtgtctgtgttggtgtatctgtgttgggtgtgtctgtgctgggtgtgtgtgcactaggtgtttgtgtgctgggtgtgtctgtgctgggagtgtgtggactgagtgtgtgtggactgagtgtgtggaatgagtgtgtgttcactgtgtttgt

SEQ ID NO: 1224 - DNA, 281 bp, Homo sapiens
caaaaaaaaactgcctgggctgtgatgatgaaggctgacttgataagggtcatccagggtaaacatcagggagggataccaatttttcatgctgatccaacgaggcattattagaagcaaggggatgaaaggaaaggaaactttaggctgaatgtcaggataattttcccaagagtgaaatcaattagcctctgaagacttgcttctgcgtggggcgaatgcctgtttccttctctcagatgtccctctgagtcgggtttgaagtagattgctgccgagaa

SEQ ID NO: 1225 - DNA, 241 bp, Homo sapiens
ccaagattcaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgac

SEQ ID NO: 1226 - DNA, 462 bp, Homo sapiens
ttccaataagaattttaatgtgtcccaagacttgacctctcgcccacttctcagatccatctcccaatcttcagcacgtgccctagtcacactgcaggaaatagtcaacctcaagcatgaaatcgccttagtcccctcctagttctgtattcagaagtgtaattaaattgaatacttgactctgaaaagcagtcgatgtttggaaatgttataattcttattggaaagactatggcatacaacagatttaacaccctgaatctcaccactattcgtggcatccgacgggagtgcactctgcttcagcccatgtctttctctgttaactgcagagctcaatgaatgaacacaccctttaggtatcagctagacactttggagggctggagcttttctaggtcacgtccagcgcctcttagtacaaaaccacattgacttacagtgtcttaaaagagacaggag

SEQ ID NO: 1227 - DNA, 389 bp, Homo sapiens
tcaaatcctttaggtctcaattctttccctctcctggaaactttctgtaaatttaaggccttcttccttttttcttctaattccactcgtagttttatttccacaacctgttcaatattcgaccaaaagcactctatctcccgggccgtggaggcggctatccgcctcagtctgctctgctcttccttcttccccctttcttcacggagctgcttctcctcgtgatggcgcaccacagttctaacgagcttcttcgcagcagccaccttccacctcctctcctgggcaaagtctgtggccatccactgcatctcctccagcagatagtcccagtgggacttggggcgtggggcctcctgcagctttggcagacgcctctgggaccacag

SEQ ID NO: 1228 - DNA, 246 bp, Homo sapiens
gacaggaattgctcactcagggagctcggctcttgagacaggagtcttgctgatgcccctggccgaataaaccccttccttctttaactcagtgtctgaggagttttctgcgcctcgtcctgctacatttcttggttccctgatggggaagcgaggtgaatggcggatggtcgaggcagctccttaggcggcttaagcctgccgtgtggaacatccctgcgggcgactctaactagcccgggcgac

SEQ ID NO: 1229 - DNA, 307 bp, Homo sapiens
gtggactctgttgcaggagggaaaaaaaggagacagagaagaaggacgaaagaaacggagaagaaaaagggaggagagagaaaagggaggaagaaaaaagaaaaggaaaaaaggaagaaaggaagagggggggaggaaaacaaaagaggctggttgtgtgaatgtaacaatatacagcaagtctttgatgtgtagcctgagtaaagactgcagagatgcagtaaaggagaaaaccccaacacgctgtagcaagacatgaaaacattcatgtggcaagacacactgtaaaacttcactctcttttggg

SEQ ID NO: 1230 - DNA, 273 bp, Homo sapiens
gagaccccggccctgatccaatgtcacagcttcccacttccagacttctgatcaagtgagaaatgaagtcccccttgtttacgccacctcactgtcagatgccgtcattcctcactgctctgtttcctcacccaagtcatctcttggtggacactcttcctcctgaattctttgaggtgtttctgctgctgcagctgccattgcagcagctttagccttctcagcttcatcgtatgtaggaagagaggtagcaacgctatagggaggtggcac

SEQ ID NO: 1231 - DNA, 499 bp, Homo sapiens
tgctgtgctcatcctcctgctcatccctctgaaggacaaactggtcgatcccattttgagaagacacggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctg

SEQ ID NO: 1232 - DNA, 275 bp, Homo sapiens
tactcgcgtgaggttgtcatgtgagggatggataaagagttatcgcatcttaattaccaaggctggcaattaatttacacgaccttagttcatcttaaagtgttgcttaaacttggcttattaacatgaaatatgagattgatttttttacaaaaaatcgacaaaaagtagaatagaggttactagggaataggggagggaggaagggggagttattgcttaatgagcatagagattctgtttagagtgataaaaaattctggaactaaagacag

SEQ ID NO: 1233 - DNA, 423 bp, Homo sapiens
gccaaaccttttccatgtaactgaaccgcacgccagaaaaaggtgcaggaatgtttccacataaacacaaacatccacacccaacaaaggtgatgttaacaatgtctgccatcgattcaaagattacattcggggaagcaggaaaacccacccgtaaggggaggaaaaatccactgcgaaatcctggtcagaactaacacaagtgttagaatcgccagacagacactgacagtcatcctgactgcattccctgtgttgaaagagctaagtagaaacatagaccatttaaaaatatgcaaaccaaacttctagaaatcaaggctacaatggatggggttcacagaccacacatggaggaaaaggtgaatgatcttaaagacagagccaacgatacagcaccgtataaaacaggaaacataatag

SEQ ID NO: 1234 - DNA, 611 bp, Homo sapiens
gtggggaccagggtgcctccactggcctctggcagagccggagctgctgacgccaggacccgtggcactgaacctggacacatggctgaatgccagggcccatggcactggactcagacggatggctgagtggggagggattggtagaggccagtgcccagctcttcccatctgaagacaggcagaggagccacggcaagctcgagctctggaggctggaacaggtgcaaggctgggtccatctctgttctccatggacctaagaggagatgtcgcggttcctgaatctgaaatggacataacaatattcctgctctgaggagctcccgggaagagcacataagccgaccgaagcccctgtgcctggcgccgaatgtgctctcaacccgcacccggctcctgacacgccctcaacccactcgctggcagggtcaagccacccccgaggctgcctcagcagagtccccaaacctgaagctggcagatttgaggctaaaaaactaaagacagagctccaggccggaggccaactgtccttccccaggaacgagaagaggtctgtggtccggatgagcagaacaagggccggaggccctttgcagggagtggac

SEQ ID NO: 1235 - DNA, 500 bp, Homo sapiens
ctgcactttaaaaactcgactaaagtcaatattcaatcagaacatttctcataacaatctgaatttctggcttctttttaaaaaactgggcactatgacaaagtgggcccacattcccacgtggatacaagaggcaggcgtcccttttagatgggacagtttgccacagcacttctcccttctcccactgctcttgcatccagttcacttcatccatttaactctcctttctagtccctgcaggcgttttgagtttacaaataccaccctacatgatgaggaccaaggaaggtttcagcaggaaaaaagccatatgattagctttgttttcaaaatgtcaggcagccagatggaaggcgggagaagtgaagagtggtaaggagaccagtgaaatccacaaacgcttattctattaaagattaaaacagggctaccatcactgcagtgggaagagggcaccttttaccaaaaactcccataacagatgacttgaaaaccac

SEQ ID NO: 1236 - DNA, 415 bp, Homo sapiens
gtctgtcaaggacggtggggagcgagggggcccggaggccaaagcagatgctgcaccagaggctggttagaacccgggagggcctgcgggggtggggtcctcatgagcaagtgcggggtgctggaggtcagcagctgcctggcctgggagacagggacacccatccccttcctgacacctgaggcggcccagctgggcaagaccaggcctgcaggaccagagcctcctgtcacgtggcgcaggggtccaggtggtcaacgctgctctctggaggatcactggttagagcttgcccagctcccctgaggtctggagacagtcaaagcccccccagacaccccctcccttttgggcgagtggcgtgccttggactccagaagactcgagtggggctgccttgagaccaggtcctgac

SEQ ID NO: 1237 - DNA, 255 bp, Homo sapiens
aaaaagaagaagaagaagaagactggttctataaaggcaagaagaagctgaacataccaggatagtgacccgtttctgggacaatgacacttcacggaaaagaattccaaatggccaataagcacaggaacaattgctcaacgtcactggtcattaggaaaacaaaatcacaatgattttccactggacacatcacacacactctgagcaaggctaacataaagaccgaggaccccaaacgtcgatgagggtatg

SEQ ID NO: 1238 - DNA, 443 bp, Homo sapiens
caaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcacaataaaaatgtggtttgtacatatcaaatagatattttaagggtaatattttcttttatggcaaaagtaatcatgttttaatgtagaacttcaaacaggatggaacatcggtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttc

SEQ ID NO: 1239 - DNA, 529 bp, Homo sapiens
ctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgccgtgtacaatccccaagccacggcaaaacatcaggagaacgcaccgatctcacattgtac

SEQ ID NO: 1240 - DNA, 428 bp, Homo sapiens
cccacccctgatcatctctgctctacccaagtcatctcatgtcccaccagagggatgcatatcactctcggacaccatagctgcatttcatggggcatcgtctctcccccagggacacgggaagccctgaggatgcattagggaagcttttcctacctcatctcgcagctctaagaacagcagtgagcagtactgggaacaatggtaatcagaggtatttgctgaaggcgtcaggggagaaagagccctcacatctacccatctgactctgccactgattcaacagacagatttcctaaatctacatcactgattaatatcttttaaatcgagaaaataaagctttagctcatctatttgcaaatgcagtgaggttccagtgggctgacatgagagttcgctgcacactgggctgcagttggtcagcc

SEQ ID NO: 1241 - DNA, 696 bp, Homo sapiens
gtcagctgagccgagtcctcgcaggatttttgttgtgatctcaggactctgacacgtctgttttgcttttgcctttcaaactggcaacgatggggagaggttggtcagaaggcaggagggaggagtctgaaccatgactgcttgaaaataagcctctattgtccacaccaaagccctaaggcaggtaatcaaattctctcccaaattccctgaaaaccagttcccctttccctgtcccagtcaacccagtcactcatgcacctccatcaggactggctggtgaacacgcctgggacagcatctgaacgcacagaaggatatgggatgaatgcagtggctctggggactcacgactaacattttctaggattccgctgaggctggttttatttgaactgcactgggcccacgtgatccagaactctgtttctgagtgtgcacccagagctgtgtgtcagagagcaggtgtctgatgaggcggggccctcaatcttcagtgcttccttccagcttcctgatgagctgttggtaggtgtctctttccacctgccatgaatgatacattctcacgtattcccttccgtcactacgatttccttttctaatgcaggaccactaaccagtctctttgccagatgaacaaactccttgttgcaatagtaggggtcccaggcaggagaaggtcccaaactggga

SEQ ID NO: 1242 - DNA, 663 bp, Homo sapiens
ctctgaaggaggtcttcaaggagtatttgattgaattgtttttcttgcaacactttcaagggaacatgatggatttcttagctttcaagaagaaacattatgccccgttacaagcatatcttaggcagaatgatttggacattgaagaagaggaggaggagaggaagaggaggaagaaaaatctgaggttatcaatgacgagcagcaagccctcgcagggagcctggtagcaggggccggaagcacagtagagacggacctgtttaagaggcggcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcatagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggggcaggc

SEQ ID NO: 1243 - DNA, 335 bp, Homo sapiens
gggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacttcaaacaggatggaacatcagtggatggcaggaggttgggaattcttgctgttaaaaataattacaaattttgcacttttttgtttgaatgttagatgcttagtgtgaagttgatacgcaaggaaaatg

SEQ ID NO: 1244 - DNA, 353 bp, Homo sapiens
gacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtag

SEQ ID NO: 1245 - DNA, 525 bp, Homo sapiens
gctgatgttccatcctgtttgaagttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatattcacaccatgtaacccttctaaccaaatagaatactgctgacctgtcatcatcagtttgtgtgacatggctcaaatgtacaaaaatgaacatagggagaaattaacccaatagatttcaaataaagtgataaaagcaaggcaattcaaatattcacatggcataaaacttccctactctagtggtttccaaatgctatttataaacaagggatgagttcacttgcttagatatttgaaacacaactttattctgattctaaacgaaaaggaatgggaatgacagtaacaaacaagatttcaccactgaatatc

SEQ ID NO: 1246 - DNA, 696 bp, Homo sapiens
cgggggggaaaaaaaaacaaaaaaacggtgtagtgtgaactgctgaagagcttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaagttctacattaaaacatgattacttttgccataaaagaaaatattacccttaaaatatctatttgatatgtacaaaccacatttttattctgacaggtcacagattttgagcaagtgcttccctaggtgaccctacctagtcaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagaaatttgaaatacaacttcattgtttggacctgcat

SEQ ID NO: 1247 - DNA, 345 bp, Homo sapiens
tgaaatcgagtcacgtcacaaggacatcatgaagctggagaccagcatccgagagttgcatgagatgttcatggacatggctatgtttgtggagactcagggtgaaatgatcaacaacatagaaagaaatgttgtgaatgccacagactatgtagaacacgctaaagaagaaacaaaaaaagctatcaaatatcagagtaaggcaagaaggaaattgatgttcattattatttgtgtaattgttttgcttgtgatccttggaattatcctagcaacaacattgtcatagcaaccatatcccacgagccatttatccttgagactcagaccacatctgcaaccaaa

SEQ ID NO: 1248 - DNA, 638 bp, Homo sapiens
ctgtgctgccctacaaaaaaaccctcccgggggggaaaaaaaaacaaaaaaacggtgtagtgtgaactgctgaagaactcaaatgttcaagacatctttaaagtctaggagtacctgaagactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaagttctacattaaaacatgattacttttgccataaaagaaaatattacccttaaaatatctatttgatatgtacaaaccacatttttgttctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaaatgataaaagcaaggcaattcaaatattaacatggcataaaacttccctacttta

SEQ ID NO: 1249 - DNA, 332 bp, Homo sapiens
agaaattgatacctgttagcattcactgccaccatattttaaggagaaagaactctattggtgtcgtctgagcagccatttaaaaattggaatctaaaggatggttgctgatgtactgtgtggtctggtagaagtggggaaatgtgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttgggggggttg

SEQ ID NO: 1250 - DNA, 345 bp, Homo sapiens
tttggttgcagatgtggtctgagtctcaaggataaatggctcttgggatatggttgctatgacaatgttgttgctaggataattccaaggatcacaagcaaaacaattacacaaataataatgaacatcaatttccttcttgccttactccgatatttgatagctttttttgtttcttctttagcgtgttctacatagtctgtggcattcataacatttctttctatgttgttgatcatttcaccctgagtctccacaaacatagccatgtccatgaacatctcatgcaactcccggatgctggtctccagcttcatgatgtccttgtgacgtgactcgatttca

SEQ ID NO: 1251 - DNA, 267 bp, Homo sapiens
ctgaggttcagtactctcggaactcgaggaaattattcctgagacatggagtaattcttacaaatttaaactattgtacagatccacatacatgttgttaagtacctaatgttttgctgaacttttaaaagttaatttccgaaatgtatagggattcatgataattaaacctttttattgctcatttttttagtagaagaatatcacttatttttagacttgtaaaatgtatgaactagtgactctcttaacagatgtccgctcacc

SEQ ID NO: 1252 - DNA, 465 bp, Homo sapiens
gtaaatattagtgcagttaagctaaagcagtgtttgctccaccttcatattggctaggtagggtcacctagggaagcacttgctcaaaatctgtgacctgtcagaataaaaatgtggcttgtacatatcaaatagatattttaagggtaatattttcttttatggcaaaagtaatcatgttttaatgtagaacttcaaacaggatggaacatcagtggatggcaggaggttgggaattcttgctgttaaaaataattacaagttttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcag

SEQ ID NO: 1253 - DNA, 282 bp, Homo sapiens
gtcatatgagtcctccccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaag

SEQ ID NO: 1254 - DNA, 705 bp, Homo sapiens
gttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacttcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttctgcagttcacactacaccgtttttttgttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaaatgaattaggtctattaggataattaagagtttgatcccatcaacactattcttgtagcagttaggaatcttgagaggatc

SEQ ID NO: 1255 - DNA, 288 bp, Homo sapiens
aatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttggatgttaatcttatgtgctttctaaaaaatgttgtgaaataccaaacttatggattatcactaggttatcaagcatatattagtctttatcagaataaaatgaaatttcatagctgtgg

SEQ ID NO: 1256 - DNA, 382 bp, Homo sapiens
caccacgttagacaggtaagtgacgtcacttccaaatttcaaccgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcacacatctaaagaaaac

SEQ ID NO: 1257 - DNA, 224 bp, Homo sapiens
gctggacgaagtgaccggtttttctccataaataagacaaagaaaccctggggatctggagaaggatctgaggccattaaactgcaaatcccaaccgaaacgaagaagcaaaagtttcttttttggttcttttaaacgtctaaagagcataaaattaagaaaaatacaaatccattacaaacacttctcatctgtggggggaaaaggtacaaacgcgatttttt

SEQ ID NO: 1258 - DNA, 691 bp, Homo sapiens
ttgaagttctacattaaaacatgattacttttgccataaaagaaaatattacccttaaaatatctatttgatatgtacaaaccacatttttattctgacaggtcgcagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaagtccaaacaatgaaggtaatttttaaactgccacattcacttcgaagcccactcatctccctcagcattccacagatgaagcacatgttccgcttaactagataataatga

SEQ ID NO: 1259 - DNA, 313 bp, Homo sapiens
tgcttcttcagagcaatacgccgccgtttgtgctgcaggacacgtggagtaacaagacgctgaatcttgggtgctttggtcctaggtttcttaccttctttatttaagggctttcttacaacatactggcggacatcatcttctttagagagattgaaaagtttgcggattctgctagctcttttggggcccaggcggcgaggcactgtagtatcagtcagtccaggaatatccttctctcctttttttacaataaccaagttgagagcgctcagatttgcatccacaatgcaaccacgaactgattttctcc

SEQ ID NO: 1260 - DNA, 468 bp, Homo sapiens
ctgcttcaaaaagtacttactatttaaaccatcaacattacttttctttcttaaggcaaggcatgcataagagtcatttgagaccatgtgtcccatctcaagccacagagcactcacggggtacttcacaccttacctagtcagagtgctcatatatagctttattttggtacgattgagacgaaagactgatcatggttgtatgtaaggaaaacattcttttgaacggaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcttttatctttaaaaaaaaaaaatcctcactttcttaaatataagtaacagtttattaattttt

SEQ ID NO: 1261 - DNA, 368 bp, Homo sapiens
tgtcatggacccagctttggcagcacaatatgagcacgacttagaggttgctcagacaactgctctcccggatgaggatgatgacctgtgaggatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttaggagtgaatgtggcagtttaaaaaataacttcattgtttggacctgcatatttagctgttttggaacgcagttgattccttgagtttcatatataagactgctgcagtcacatcacagtattcagc

SEQ ID NO: 1262 - DNA, 738 bp, Homo sapiens
agtagaagcaatatattttgcaacaattattctttcaataaaggacttgtaaattctctcccacaccacgttagacaggtaagtgatgtcacttccaaatttcaactgttacatagaagatccagaatgtcaacaccacttgcgatctccacaaggttacaaacaacacatacaccttcaattcaaaatacctgaatgaaaggtttcatcccaattatgaggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattatcctaatagacctaattcatttttaaatgtggaaaatatgcaagataaattaaatgcttagttaaaaaaaaaaaaagtttcaccaactgttctccattactgagaagcccccacactgccccactgtgcatattcctagtatttcatccatgtcctgctctgcttggagatccagatttctcgagtagtagtagta

SEQ ID NO: 1263 - DNA, 600 bp, Homo sapiens
tggtgaaactttttttttttttaactaagcatttaatttatcttgcatattttccacatttaaaaatgaattaggtctattaggataattaggagtttgatcccatcaacactattcttgtagcagttaggaatcttgagctattttttctcatacgattactatagtccagtttaccaaagttttctttagatgtctgataatcttgagatgattgcttaccttaaaaggtgtagaaaggatcacttagatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagtcgaaatttggaagtgacgtcacttacctgtctaacgtggtgtgggaggaggatcccaaattctcgagtagtagtagta

SEQ ID NO: 1264 - DNA, 285 bp, Homo sapiens
ttgtaaccttgtggagattgcaagtggtgttgacattctggatcttctatgtaacaaacaacacatacaccttcaattcaaaatacctgaatgaaaggtttcatcccaattatggggaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttc

SEQ ID NO: 1265 - DNA, 638 bp, Homo sapiens
gcagtgaatgctaacaggtatcaatttctttgatcaggaacaaagaactccttcaggaaactcactttcctggtccttgttaacctatcatgtaaattctttttattggtacacctgtttactaattataattgattgctatttatgccaagggagcatttcccaggcatgcctcatctatttactaacaacaaagtatgcttactttatttacatagtgccacgggtttctcttttttcttctcttttttattggcgggggagatggtactataacttgttatttatcagggcagatcacacatttggatcaaaaagaaaaaccagcaagtagatcctaaaacacatttcttaacctgagtcataactgaaaacatagactttaattacattttgttgaaaattcattcaactttggtgcttgtaaaagcacttatgtcaatttttgacacaaatcataaccctcagtacacaggtattttcaaaggaaacaagtcatcttaaagtaatatttttctatatgctaattgatacatctttatagcaaattgaaaattctgagtaaactgaaagtatgcttaacgacaaaataaatacagcatatatggttaacatatacatttcttaatgtagaggca

SEQ ID NO: 1266 - DNA, 724 bp, Homo sapiens
tgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaataaaaaaaattaataaactgttacttatatttaagaaagtgaggattttttttttttaaagatgaaagcatggtcagatgctgcaaggattttacataaatgccatatctatggtttccttcctgagaacagtcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcggagtgcttatatatagctttattttggtacgattgagactaaagactgatca

SEQ ID NO: 1267 - DNA, 208 bp, Homo sapiens
tctgaatgttaatcttatatgcttgataacctagtgataatccataagtttggtatttcacaacattttttagaaagcacataagattaacattcaaataaggcattatagaaagttttataaagaatgaagtgtttcctatatttcttttaaaaaaccttggttcatcttgaaagatcggtgaattttttaaatatcagaagaaaag

SEQ ID NO: 1268 - DNA, 336 bp, Homo sapiens
ataaatctgtaaatccagttgctttctttctggaattttatatagtgtctcaccatgttccacaatgctggaaatgtctttttttggcatcaatctatgcacaaatttctgattacgtattttctccaaatgacatgtaactttttttaacttttccagaaaaatatggaaactttatcaaccacttattaactgaacaaaaagttagattactaccaaatgctcttttaactttgctctaacagatgttttaaaggttcagacatcgctgatgtttttgaggataactgcatacaacacactagatgatttcaaacgatgcatcttagtatccga

SEQ ID NO: 1269 - DNA, 163 bp, Homo sapiens
gaaaacacgtgcaagtatgaaactttttgtaaggtcctctgagctggctgcactatggtcaagccacggtgacattcccccacccttgtgataatgtactttgtgatactccagtccttgtgaatgtactttgtaacattcctccccacccttgtgacaatac

SEQ ID NO: 1270 - DNA, 535 bp, Homo sapiens
gtaagggacgcggcttctgagccgttcaatattctccacacctgtttggaatcgggcatctctacattagtttcaaaccaaatggtgttaaaagtcacatgcttacactactacatacaggagtaacaagagttcacgacatttggggcatcctgcatgcactcctttaacattctgactagtgactctcttaacagatgtccgctcaccagttcatacatttcacaagtctaaaaataagtgatattcttctactaaaaaaatgagcaataaaaaggtttaattatcatgaatccctatacattttggaaattaacttttaaaagttcagcaaaacattaggtacttaacaacatgtatgtggatctgtacaatagtttaaatttgtaagaattactccatgtctcaggaataatttcctcgagtcccgagagtactgaacctcagtttcatcaccgtcttaaattcagacttcattcatgtaaactgggaaacttgaatctcctatttagtgaaaagagaccacggtctttac

SEQ ID NO: 1271 - DNA, 323 bp, Homo sapiens
atagatattttaagggtaatattttcttttatggcaaaagtaatcatgttttaatgtagaacttcaaacagaatggaacatcagtggatggcaggaggttgggaattcttgctgttaaaaataattacaaattttgcactttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgttttttttcccccccgggagggtttttttgtagggca

SEQ ID NO: 1272 - DNA, 196 bp, Homo sapiens
ctagcatgcaagttagtaaatgtaggaagaagcctatacattattcaatggtgtccactatcacacagggaaaggaagaaaatcttactgcctttctggagagactaagggaggcattgaggaagcataccactctgtcaccggactctattgaaggccaactaatcttaaaggataagtttatcactcagttagc

SEQ ID NO: 1273 - DNA, 483 bp, Homo sapiens
acagttggtgaaactttttttttttttaactaagcatttaatttatcttgcatattttccacatttaaaaatgaattagggctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtg

SEQ ID NO: 1274 - DNA, 256 bp, Homo sapiens
ttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgttttttttcccccccgg

SEQ ID NO: 1275 - DNA, 241 bp, Homo sapiens
ttcggctgttgggaaaaaaaaatcgcgtttgtaccttttccccccacagatgagaagtgtctgtaatggatttgtacttttcttaattttatgctctttagacgtttaaaagaaccaaaaaagaaacttttgcttcttcgttttcggttgggatttgcagtttaatggcctcagatccttctccagatccccagggtttcttgtcttatttatggagaaaaaccggtcactttgtccagcg

SEQ ID NO: 1276 - DNA, 408 bp, Homo sapiens
cgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaatctcctag

SEQ ID NO: 1277 - DNA, 562 bp, Homo sapiens
accggtcgcctactactactactcgataattttggatcctccttgtttgttactgtcattcccattccttttcgtttagaatcagaataatgttgtatttcaaatatctaagcaagtgaactcatcccttgtttataaatagcatttggaaaccactaatgtagggaagttttatgccatgttaatatttgaattgccttgcttctatcacttaatttgaaatccattgggttaatttctccctatgtttatttttgtacattagagccatgtcacacaaactgatgataacaggtcagcagtattctatttggttagaagggttacatggtgtaaatattagtgcagctaagctaaagcagtgtttgctccaccttcatattggctaagtagggtcacctagggaagcactttgctcaaaatctgagacctgtcacaataaaaatgtggtttgtacatatcaaatagatattttaagggtaatattttcttttaaggcaaaagtaatcctgtttgaagttctacattaaaacgaggatcccaatatttcgagatacagtag

SEQ ID NO: 1278 - DNA, 332 bp, Homo sapiens; identical to SEQ ID NO: 1249

SEQ ID NO: 1279 - DNA, 491 bp, Homo sapiens
cttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatccattgggttaatttctccctatgtttatttttgtacatttgagccatgtcacacaaactgatgataacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttaaggcaaaagtaatcctgtttgaagttctacattaaaac

SEQ ID NO: 1280 - DNA, 314 bp, Homo sapiens
cgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaaaaaggcaacaacattgtcatagcaaccatatcccaagagccatttatccttgagactcagaccaca

SEQ ID NO: 1281 - DNA, 506 bp, Homo sapiens
ctgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccgacctcctgccatccactgatgttccatcctgtttgaagttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggcacaaatgtacaaaaataaacatagggagaaattaacccaataga

SEQ ID NO: 1282 - DNA, 262 bp, Homo sapiens
caggcaaagtagaagcaatatattttgcaacaattattctttcaataaaggacttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaa

SEQ ID NO: 1283 - DNA, 535 bp, Homo sapiens
gtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccatagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtatcgttactgtacgtgtatctggggcttctccgtttgttaatactttttctgtatttgttgctgtatttttggcataactttattataaaaagcatctcaaatgcgaaatccaaaaaaaa

SEQ ID NO: 1284 - DNA, 193 bp, Homo sapiens
ttttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcc

SEQ ID NO: 1285 - DNA, 597 bp, Homo sapiens
ctctaacagatgttttaaaggttcagacatcgctgatgtttttgaggataactgcatacaacacactagatgatttcaaacgatgcatcttagtatccgaatcatttggcacatccttagtatccaaaataaaatcagtagaaataaaagtaatataattttcaaagaattcatacatactagaagtcttaggaaaaccagcttctaaatgcaaggactaggaggtttgcccatcttactattaatagttacacacatttctcctcatggagtaactgaagctttctggcttagttgtggaactttagtttgtaggaaagcatatacatagggccaaatcttgttggtttctgttccggagaatgtttccagcaccccttttttctggtaatattccaggactggctttgtttggtcttcataagcctttagtctcttgataaccgtctctggtttatcatcctcacgctgaatgagagactccccagtcaggtcatcaatgcccacagttttgggaaggttgaattcaatgttatagactcggccactggcgggatgaatccagcgagcagtaaggcgttgtttaatgacctcaaa

SEQ ID NO: 1286 - DNA, 403 bp, Homo sapiens
gcaaaatatattgcttctactttgcaacaattattctttcaataaaggacttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacctcccatctcacaggctggttagaaactggctctgaatacagcgtaacatacacagcaattcagatcttaagaaactcaactgttgccagttaatacagtaagtagaactttattcagcttcacccttatttcatttttccatatatttaagtgatcctttctatacctt

SEQ ID NO: 1287 - DNA, 349 bp, Homo sapiens
gtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgtacttgagctgtttgaccagtcacatttttgtattaacaaacggagaagccccagatacacg

SEQ ID NO: 1288 - DNA, 391 bp, Homo sapiens
gccctacaaaaaaaccctccccggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaagttctacattaaaacatgattacttttgccataaaagaaaatattacccttaaaatatctatttgatatgtacaaaccacatttttattctgacaggtcacagattttgagcaagtgcttccctaggtg

SEQ ID NO: 1289 - DNA, 518 bp, Homo sapiens
catagttgaaggaaagttgctgccattaaacttctgataatgtttacagccagcagcgcctgggtttttgtgaccatattaagaatttagtaacgtcatatatttatatcaacagactatttacacgtttcgtttgctttttaaaaaaacaaaccaaaaaagaaattacacttctgcataataaggcaaaaaaacaaagttttgtacattattattttaatataatctgtaacttcggttccaagtaccaagggggggccagggctggcctgagtgggggcctcacagtgcgctggacaaagtgaccggtttttctccataaataagacaaagaaaccctggggatctggagaaggatctgaggccattaaactgcaaatcccaaccgaaaacgaagaagcaaaagtttcttttttggttcttttaaacgtctaaagagcgtaaaattaagaaaaatacaaatccattacaaacacttctcatctgtggggggaaaaggtacaaacgcgatttttttc

SEQ ID NO: 1290 - DNA, 375 bp, Homo sapiens
cttgtggagattgcaagtggtgttgacattctggatcttctatgtaacagttgaaatttggaagtgacgtcacttacctgtctaacgtggtgtgggagagaatttacaagtcctttattgaaagaataattgttgcaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagcagaactttattcagcttcacccttatttcatttttccatatatttaagtgatcctttctatacctt

SEQ ID NO: 1291 - DNA, 357 bp, Homo sapiens
agcactgggattatacatgtaaaccaccatgtgtgctctcaaatagatttttaaatgattgagaattacctcccaaaaaatagtgtaagtaaacaaattttgcaatttactaactttaaaacttttttcattaaatgacatctcaacaactttattgagaagtaaatctcttaatatgtgaatgatatttggagcatacaattaattcagtggtttttggtgtatttccacacacaatcaatttaaaacacttttatcaacccaaaaagaaacttcacacccaccaccagtcattccccatttcctctcctagcccaaggcaactgcattctactttttactcctgtacattttccc

SEQ ID NO: 1292 - DNA, 650 bp, Homo sapiens
ttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagaggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttggggctatggtgaaggtatcacttgtcttgagg

SEQ ID NO: 1293 - DNA, 294 bp, Homo sapiens
ccctaggtgaccctacctagccaatatgaaggtggagcaaacactgcttcagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgatagaagcaaggcaattcaaatattaacatggcataaaacttccctactttagtggtttccaaatgctatttataaacaagggatgagttcacttgc

SEQ ID NO: 1294 - DNA, 368 bp, Homo sapiens; identical to SEQ ID NO: 1261

SEQ ID NO: 1295 - DNA, 391 bp, Homo sapiens
cacctagggaagcacttgctcaaaatctgtgacctgtcagaataaaaatgtggtttgtacatatcaaatagatattttaagggtaatattttcttttatggcaaaagtaatcatgttttaatgtaggacttcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttccccccggggagggtttttttgtagggc

SEQ ID NO: 1296 - DNA, 416 bp, Homo sapiens
gattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgccgtgaactcttgttactcctgtatgtagtagtgtaagcatgtgacttttaacaccatttggtttgaaactaatgtagagatgcctgattccaaacaggtgtggagatttggaattgtgttaagtaagggacgcggcttctgagccgttcaatattctcc

SEQ ID NO: 1297 - DNA, 478 bp, Homo sapiens
ccccatttcctctcctagcccaaggcaactgcattctactttttactcctgtacattttcccattttggatgtttcatataaatggaattatacactatgtgttctgtgactgacttctttcctgtaacacagtttttccaaggttccaccttggtctcccaaagcactgggattatacatgtaaaccaccatgtgtgctctcaaatagatttttaaatgattgagaattacctcccaaaaaatagtgtaagtaaacaaatttcgcaatttactaactttaaaacttttttcattaaatgacatctcaacaactttattgagaagtaaatctcttaatatgtgaatgatatttggagcatacaattaattcagtggtttttggtgtatttccacacacaatcaatttaaaacacttttatcaacccaaaaagaaacttcacacccaccaccagtcattccccatttcctctcctagcc

SEQ ID NO: 1298 - DNA, 408 bp, Homo sapiens
gggatggagcaggccctggaaggaccaagaacaaagtaatagccacagttatgaaatttcattttattctgataaagactaatatatgcttgataacctagtgataatccataagtttggtatttcacaacattttttagaaagcacataagattaacattcaaataaggcattatagaaagttttataaagaatgaagtgtttcctatatttcttttaaaaaaccttggttcatcttgaaagatcgatgaattttttaaatatcagaagaaaagggaaataaaattttccccccaaaacacataagaaccacttactggcacttgtattttaagtacctgggaaaaaaacggaacagatttttaaaggcaataacgacttgtaagacggcttgtttcatttgatttg

SEQ ID NO: 1299 - DNA, 564 bp, Homo sapiens
cttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattatcctaatagacctaattcatttttaaatgtggaaaatatgcaagataaattaaatgcttagttaaaaaaaaaaaaagtttcaccaactgttctccattactgagaagcccccacactgccccactgtgcatattcctagtatttcatccatgtcctgctctgctgtgctgccctacaaaaaaaccctcccgggggggaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattattttc

SEQ ID NO: 1300 - DNA, 417 bp, Homo sapiens
gggagattcggaattgtgttaagtaagggacgcggattctgagccgttcaatattctccacacctgttgggaatcaggcatctttacattagtttcaaaccaaatggtgttaaaagtcacatgcttacactactacatacaggagtaacaagagttcacgacattgggggcatcctgcatgcactcctttaacattctgactagtgactctcttaacagatgtccgttcaccagttcatacattttacaagtctaaaaataagggatattcttttactaaaaaaatgaccaataaaaaggtttaatggacatgaatccctatacatttgggaaattaacttttaaaagttcagcaaaacattaggtccttaacaacatgtatgtggatctgtacaatagtttaaatttgtaagaatg

SEQ ID NO: 1301 - DNA, 390 bp, Homo sapiens
gccctacaaaaaaaccctccccggggggaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaagttctacattaaaacatgattacttttgccataaaagaaaatattacccttaaaatatctatttgatatgtacaaaccacatttttattctgacaggtcacagattttgagcaagtgcttccctaggtg

SEQ ID NO: 1302 - DNA, 441 bp, Homo sapiens
gtgaatgctaacaggtatcaatttctttgatcaggaacaaagaactccttcaggaaactcacttccctggtccttgttaacctatcatgtaaattctttttattggtacacctgtttactaattataattgattgctatttatgccaagggagcatttcccaggcatgcctcatttatttactaacaacaaagtatgcttactttatttacatagtgccacgggtttctcttttttcttctcttttttattggcgggggagatggtactataacttgttatttatcagggcagatcacacatttggatcaaaaagaaaaaccagcaagtagatcctaaaacacattccttaacctgagtcataactgaaaacatagactttaattacattttgttgaaaattcattcaactttggtgcttgtaaaagcacttatgtcaatt

SEQ ID NO: 1303 - DNA, 420 bp, Homo sapiens
cgagaatcctggatcctcctttagtagtggtctttccatttacaaaacatagtaattctcgatcgctgaaaatgtcaaatcctggaaaatgtagtattcctacacgtgatgttaacatcgttctcaacagttagccgaagattcattcgatgagtccgatttttctgaaagagatgattctgatgattcagatgattctgatgttagttctgtttagaaataactccaagaatagtttttatattttattttcacattgaaaatcagtaagatttgcttcagcctccaagagtgtgtttacgtaaaattaaatgagcgctggcagtgagctgcactttttttttctaaatgggaaaagtgttaaactctgcttcttacaataaagctttgtaattttctccaaaaaggtcttgcatattt

SEQ ID NO: 1304 - DNA, 619 bp, Homo sapiens
ttgtaagacggcttgtttcatttgatttggcacgaagtaaagtaagagtaaatatgccatggaagacataatcaagtttttcctccatctctcatatttccccacttctaccagaccacacagtacatcagcagccatcctttagattccaatttttaaatggctgctcagacgacaccaatagagttctttctccttaaaatatggtggcagtgaatgctaacaggtatcaatttctttgatcaggaacaaagaactccttcaggaaactcactttcctggcccttgttaacctatcatgtaaattctttttattggtacacctgtttactaattataattgattgctatttatgccaagggagcatttcccaggcatgcctcatctatttactaacaacaaagtatgcttactttatttacatagtgccacgggtttctcttttttcttctcttttttattggcgggggagatggtactataacttgttatttatcagggcagaccacacatttggatcaaaaagaaaaaccagcaagtagatcctaaaacacatttcttaacctgagtcataactgaaaacatatgaagatccagaattcttgagtagtaatagta

SEQ ID NO: 1305 - DNA, 806 bp, Homo sapiens
gccctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccacatatgctgtatttattttgtcgttaagcatactttcagtttactcagaattttcaatttgctataaagatgtatcaattagcatatagaaaaatatactttaagagaggatcca

SEQ ID NO: 1306 - DNA, 459 bp, Homo sapiens
agttacagttcatgtctcacgttcacaaagctcttcccaccggctaccgctaagtctaagaaacagcctggggttacagagtgtgaaatgcagtatacattcgtaattccttatccagaatgctgaaatccacaacattgtgaaaactgggttttccttaagctcgacgtcaaaattcaatgagcggcaaaatctgacctaaactgagtcatggctatttataatcttaactcctcccccttactgtgaatgctcacatttcactggagagctgtgtgaatgtgcctgattacagggtgcagtcctagaccccacctggggattacataatacacctcttatacattgtactatcttcctaaaatctgaaaaattctgaactctgaaacacatacagccccaaccattccagagaaagcactgtggacctatgtaacatgccctggtccaagaagaaac

SEQ ID NO: 1307 - DNA, 119 bp, Homo sapiens
tatgtaacagttgaaatttggaagtgacgtcgcttacctgtctaacgtggtgtgggagagaatttacaagtcctttattgaaagaataattgttgcaaagtagaagcaatatattttgc

SEQ ID NO: 1308 - DNA, 532 bp, Homo sapiens
ctcagaccacatctgcaaccaaatcagcatcctgtcatttcgtgaatgaatctcagacgctgtaacccggcatcgagtgctgagtctcaaggataaatggctcttgggatatggttgctatgacaatgttgttgccttcttgccttgctctgatatttgatagctttttttgtttcttctttagcgtgtcctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagtcatctccagctggcgctggatgcggcctttgctccgctcccgaaacagagtctgtgcctcattgtactccgcca

SEQ ID NO: 1309 - DNA, 308 bp, Homo sapiens
ttttggtacgattgagactaaagactgatcatggttgtatgtaagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtactttttgaagcagcagatgaaatgtgtttactaccagcctaaatcaaagaacatggcaagagcaagactgttctcaggaaggaaaccataaatatggcatttatgtaaaatccttgcagcatctgac

SEQ ID NO: 1310 - DNA, 282 bp, Homo sapiens
gtcatatgagtcctccccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtacgtctaagcctcatgtaccgatttgaagtcagacttaaaaatgtatttacagattcacttgagactttttaatcggttcttcaaatatttcatgtttacattaaaaatttccagagaag

SEQ ID NO: 1311 - DNA, 355 bp, Homo sapiens
ctcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgttttgcttgtgatccttgaaattatcctagcaacaacattgtcatagcaaccatatcccaagagccatttatccttgagaccccacaaacatagccatgtccatgaacatctcatgcaactctcggatgctggtctccagcttcatgatgtccttgtgacgtgactcgatttcattgagagcttgtctagtaatttgtgaatctgata

SEQ ID NO: 1312 - DNA, 402 bp, Homo sapiens
ctttagtagtggtatttccatttacaaaacatagtaattctcgatcgctgaaaatgtcaaatcctggaaaatgtagtattcctacacgtgatgttaacatcgttctcaacagttagccgaagattcattcgatgagtccgaattttctgaaagagatgattctgatgattcagatgattctgatgttagttctgtttagaaataactccaagaatagtttttatattttattttcacattgaaaatcagtaagatttgcttcagcctccaagagtgtgtttacgtaaaattaaatgagcgctggcagtgagctgcactttttttttctaaatgggaaaagtgttaaactctgcttcttacaataaagctttgtaattttctccaaaaaggtcttgcatattt

SEQ ID NO: 1313 - DNA, 333 bp, Homo sapiens
gtaaattctctcccacaccacgttagacaggtaagtgacgtcacttccaaatctcaactgttacatagaagatccagaatgccaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaag

SEQ ID NO: 1314 - DNA, 294 bp, Homo sapiens
gaccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctagacgaagagatggaaaaacaatagcccactcatctccttcagcatcccacag

SEQ ID NO: 1315 - DNA, 480 bp, Homo sapiens
cagaaaagtcagctgcacaaaaacacttcagccaattctaacacagagggagcatagacatggaggggctgggggttaggctgggggagaccagccttccctgctaagggctcgtggtccaagcccacaaccagagggtgctctgggtggtgtccaggaacatgcagtgccggctccggggaggagggacgagaagagaaaggggagtcacagaggaggctgcagatgagcacgagtttattggactctggcctcgcgctgctgcttgatgaagttgatgagcccattggtagaagcgtcgtgagaggtcacttgagcactgccatcaagctcaggctctattttcttagccagctgctttcccagctcactccccactggtcaaagctgttgatgtcccagatgatgccctgaacgaagatcttgtgctcatacatggcgaccaaggctccaagcatgaatggtgtgagcttggtgaac

SEQ ID NO: 1316 - DNA, 372 bp, Homo sapiens
ttcatattggctaggtagggtcacctagggaagcacttgctcaaaatctgtgacctgtcagaacaaaaatgtggtttgtacatatcaaatagatattttaagggtaatattttcttttatggcaaaagtaatcatgttttaatgtagaacttcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgttttt

SEQ ID NO: 1317 - DNA, 434 bp, Homo sapiens
gtttgtgtgacatggctcaaatgtacaaaaatgaacatagggagaaattaacccaatagatttcaaattaagtgataaaagcaaggcaattcaaatattaacatggcataaaacttccctactttagtggtttccaaatgctatttataagcaagggatgagttcacttgcttagatatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttaactaga

SEQ ID NO: 1318 - DNA, 373 bp, Homo sapiens
cccaagtaccactcgtcatccaagtccaggtctagatcacactcaaaagcaaagcattctcttcttctctcggtggatctttgcttttgctcgaaggcctatcgggtggtttaacttctaaagtaggcagaggcctgcctccagtcagtagagggcagggcgtagtgctggattcctcgacactgaaaggactctcctcaattttcccagcttctgcttccggcagaggatttttgagggtctgtaaaaataacgccgctttccttttacgttctgcttgaagctgtttctcttttgactccttagacgcctgggccagcttttcccgggcagcagctgcgaggcgatcttccagcttttgctttgctttcac

SEQ ID NO: 1319 - DNA, 368 bp, Homo sapiens
gccctacaaaaaaaccctcccgggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacggcaagaattcccaacctcctgccatccactgatgttccatcctgtttggagttcttcattaaaacatgattacttttgccataaaagaaaatattacccttaaaatatctatttgatatgtacaaaccacatttttattctgacaggtcacagatt

SEQ ID NO: 1320 - DNA, 374 bp, Homo sapiens
ctctcccacaccacgttagacaggtaagtgacgtcacttccaaatttcaactgttacatagaagatccagaatgtcaacaccacttgcaatctccacaaggttgcaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatca

SEQ ID NO: 1321 - DNA, 317 bp, Homo sapiens
cagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtgaagattgcaagtggtgttgacattctggatcttctatgtaacagttgagatttggaagtgacgtcacttacctgtctaacgtggtgtgggagagaatttacaagtcctttattgaaagaataattgttgcaaaatatattgcttctactttgcc

SEQ ID NO: 1322 - DNA, 318 bp, Homo sapiens
gtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaacattcttttgaacagaaatagtgtaattaaaaataattgaaagtgttaaatacaaaaatgtgactggtcaaacagctcaagttcac

SEQ ID NO: 1323 - DNA, 323 bp, Homo sapiens
caccttcatattggctaggtaggtggagcaaacactgctttagcttaactgcactaatatttacaccatgtaacccttctaaccaaatagaatactgctgacctgtcatcatcagtttgtgtggcatggctcaaatgtacaaaaaataaacatagggagaaattaacccaatagatttcaaattaagtgataaaagcaaggcaattcaaatattaacatggcgtaaaacttccctacttcagtggtttccaaatgctatttataaacaagggatgagttcacttgcttaaatatttgaaatacaactttattctgattctaaa

SEQ ID NO: 1324 - DNA, 380 bp, Homo sapiens
ctgcagtttaatggcctcagatccttctccagatccccagggtttcttggtcttatttatggagaaaaaccggtcactttgtccagcgcactgtgaggcccccactcaggccagccctggcccccccttggtacttggaaccgaagttacggattatattaaaataataatgtacaaaactttgtttttttgccttattatgcggaagtgtaatttcttttttggtttgtttttttaaaagcaaacgaaacgtgtaaatagtctgttgatataaatatatgacgttactaaatacttaatctaaatagactttataaaaaccgattccagaaacccctctggttgtttgtctaacatggtctctataactccaaacgctg

SEQ ID NO: 1325 - DNA, 353 bp, Homo sapiens
gctttttataataaagttatgccaaaaatacagcaacaaatacagaaaaagtattaacaaacggagaagccccagatacacgtacagtaacaatacaaaaatgtgactggtcaaatagctcaagttcacatttaacactttcaattatttttaattacactatttctgttcaaaagaatgttttccttacatacaaccatgatcagtctttagtctcaatcgtaccaaaataaagctatatataagcactctgactaggtaaggtgtgaagtaccccgtgagttgctctgtggcttgagatgggacacatggtctcaaatgactcttatgcatgccttgccttaagaaagaaa

SEQ ID NO: 1326 - DNA, 570 bp, Homo sapiens
cgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaagcaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggtcttttaaaagaaatataggaaacacttcattctttataaaactttctataatgccttattcgaatgttaatcttatgtgctttctaaaaaatgttgtgaaataccaaacttatggattatcactacgttatcaagcatatattagtctttgtcagaataaaatgaaatttcataactgtggctattacttttgttcttggcccttcacagggcctgctcattcccaccttccaaggatcc

SEQ ID NO: 1327 - DNA, 483 bp, Homo sapiens
tgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccacggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaagaaattcatcgatctttcaagatgtaccaaggttttttaaaagaaatataggaaacacttcattctttataaaactttctataatgccttatttgaatgttaatcttacaagatccacaattctcgggtagatga

SEQ ID NO: 1328 - DNA, 297 bp, Homo sapiens
gaaactcaactgttgccagttaatacagtaagtagaactttattcagcttcacccttatttcattttcccatataattgggatgaaacctttcattcaggtattttgaattgaaggtgtatgtgttgtttgtaaccttgtggagattgcaagtggtgttggcattctggatcttctatgtaacagttgaaatttggaagtgacgtcacttacctgtctaacgtggtgtgggagagaatttacaagtcctttattgaaagaataattgttgcaaaatatattgcttctactttgcctc

SEQ ID NO: 1329 - DNA, 500 bp, Homo sapiens
caacaacatagaaagaaatgttattaatcatttcaccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagttatctccagctggcgctggatgcggcctttgctccgctcccgaaacagagtctgtgcctcattgtactccgccatggcttccacaaacttccgagacagcaccgaatgctgggttcttcgtatccgaagatccactgaagtccggttcccactctcatcctgatcaaaactttgttcaatagcctttaacttggctcgaattttattcgcagttttcttgatttctttgttcagatcttcaagctcttct

SEQ ID NO: 1330 - DNA, 370 bp, Homo sapiens
gccctacaaaaaaaccctcccggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaagttctacattaaaacatgattacttttgccataaaagaaaatattacccttaaaatatctatttgatatgtacaaaccacatttttattctgacaggtcacagattttg

SEQ ID NO: 1331 - DNA, 257 bp, Homo sapiens
cttggtacgctgcttcttcagagcaatacgccgccgtttgtgctgcaggacacgtggagtaacaagacgctgaatcttgggtgctttggtcctaggtttcttaccttctttatttaagggctttcttacaacatactggcggacatcatcttctttagagagattgaaaagtttgcggattctgctagctcttttggggcccaggcggcgaggcactgtagtatcagtcagtccaggaatatccttctctccttttt

SEQ ID NO: 1332 - DNA, 382 bp, Homo sapiens
gttttctttagatgtctgataatcttgagatgattgcttaccttaaaaggtatagaaagggtcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataatcgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtg

SEQ ID NO: 1333 - DNA, 328 bp, Homo sapiens
cacatgaatctggggagacagattcagaccacggcagatgtcaaggctggttcaaaggacaatgtgaagaacaaaggcatgctgaaatgaatttgataatagatgcaaacttgggtaacatcctacaggacaataaggtgtaagtaatacttgggatcatctctccttagacatgagcatcagttgcatctacagtgaacaacactgattacattgccatagaggaagctctgtgttgctctcagataagaagcatgcacactgctgtattctctacatgaacttctattctacagttgtaaaataattcagtcaatagaaagccaac

SEQ ID NO: 1334 - DNA, 447 bp, Homo sapiens
agcatggtcagatgctgcaaggattttacataaatgccatatttatggtttccttcctgagaacaatcttgctcttgccatgttctttgatttaggctggtagtaaacacatttcatctgctgcttcaaaaaatacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtacctggggc

SEQ ID NO: 1335 - DNA, 496 bp, Homo sapiens
cggaattgtgttaagtaagggacgcggcttctgagccgttcaatattctccacacctgtttggaatcaggcatctctacattagtttcaaaccaaatggtgttaaaagtcacatgcttacactactacatacaggagtaacaagagttcacgacatttggggcatcctgcatgcactcctttaacattctgactagtgactctcttaacagatgtccgctcaccagttcatacattttacaagtctaaaaataagtgatattcttctactaaaaaaatgagcaataaaaaggtttaattatcatgaatccctatacattttggaaattaacttttaaaagttcagcaaaacattaggtacttaacaacatgtatgtggatctgtacaatagtttaaatttgtaagaattactccatgtctcaagaataatttcctcgagtcccgagagtactgaacctcagtttcatcaccgtcttaaattcagaacttattcaaa

SEQ ID NO: 1336 - DNA, 433 bp, Homo sapiens
ggaagcacttgctcaaaatctgtgacctgtcagaataaaaatgtggtttgtacatatcaaatagatattttaagggtaatattctcttttatggcaaaagtaatcatgttttaatgtacaacttcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacattttaagttcttcaacagttcacactacaccgtttttttgtttttttttcccccccgggagggttttttttgtagggcagcacatcatatcatgaggatccacaattctccagttgtaataatct

SEQ ID NO: 1337 - DNA, 526 bp, Homo sapiens
cgctcagctaaataataatgaggtggcacacacgctgcaccgctgacatcacaggacagctgcctataaaactagacttctgacgctgggctccagcttcattctcacaggtcatcatcctcatccgggagagcaattgtctgagcaacctctaagtcgagctcatactgtgctgccaaagctgggtccatgacaacttctggtggggcgagagcaggcatggcaacaaattccaagttagggtctccaatgagcttcctagcaagccagaggaagggcttttcaaagttgtagttacttttggcaaaaatgtcataggactgaagattcttctttcggaggaagacaatggattccggcttcactttcctgaccttaatatgcactttgttgccacacaacacaaatggggatgggtttcacacacttgtacccggatctttatggcaaggtagggcacattcttggaagcgaacttctcgatgggtacatcgaacattattgagggcacccctggggcttggga

SEQ ID NO: 1338 - DNA, 448 bp, Homo sapiens
ttcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgttttttttcccccccgggagggtttttttgtagggcagcacagcagagcaggacatggatgaaatactaggaatatgcacagtggggcagtgtgggggcttctcagtaatggagaacagtcggtgaaactttttttttttaactaagcatttaatttatcttgcatattttccacatttaaaaatgaattaagtctattaggataattaggagtttgatccca

SEQ ID NO: 1339 - DNA, 570 bp, Homo sapiens
aaaaaattaataaactgttacttatatttaagaaagtgaggattttttttttttaaagataaaagcatttgagatgctttttataataaagttatgccaaaaatacagcaacaaatacagaaaaagtattaacaaacggagaagccccagatacacgtacagtaacaatacaaaaatgtgactggtcaaacagctcaagttcacatttaacactttcaattatttttaattacactatttctgttcaaaagaatgttttccttacatacaaccatgatcagtctttagtctcaatcgtaccaaaataaagctatatatgagcattctgactaggtaaggtgtgaagtaccccgtgagttgctctgtggcttgagatgggacacatggtctcaaatgactcttatgcatgccttgccttaagaaagaaaagtaatgctgatggtttaaaaagtaagtactttttgaagcagcagatgaaatgtgtttactaccagcctaaatcaaagaacatggcaagagcaagattgttctcaataaggaaaccataaatatggcatttatgtaaaatcc

SEQ ID NO: 1340 - DNA, 353 bp, Homo sapiens; identical to SEQ ID NO: 1244

SEQ ID NO: 1341 - DNA, 456 bp, Homo sapiens
cacctagggaagcacttgctcaaaatctgtgacctgtcagaataaaaatgtggtttgtacatatcaaatagatattttaagggtaatattttcttttatggcaaaagtaatcatgttttaatgtagaacttcaaacaggatggaacatcagtggatggcaggaggttgggaattcttgctgttaaaaataattacaaattttgcacttttttgtttgaatgtggagcaaacactgctttagcttaactgcactaatatttacaccatgtaacccttctaaccaaataaaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctat

SEQ ID NO: 1342 - DNA, 469 bp, Homo sapiens
ctgagacatggagtaattcttacaaatttaaactattgtacagacccacatacatgttgttaagtatctaatgttttgccgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcttgtgacttttaacaccatttggtttgaaactaatgtagagatgcctgattccaaacaggtgtggagaatattgaacggctcagaagccgcgtcccttacttaacacaattccgaattcccctagtaactgccacacagtgaccaccagcgagtgatcca

SEQ ID NO: 1343 - DNA, 365 bp, Homo sapiens
tgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggg

SEQ ID NO: 1344 - DNA, 349 bp, Homo sapiens
ggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgggatgggaagttttttccccataattgggatgaaacctttcattcaggtattttgaattgaaggtgtatgtgttgtttgtaaccttgtg

SEQ ID NO: 1345 - DNA, 481 bp, Homo sapiens
gccccaggtacacgtacagtatcaatacaaaaatgtgactggtcaaacagctcaagttcacatttaacactttcaattatttttaattacactatttctgttcaaaagaatgttttccttacatacaaccatgatcagtctttagtctcaatcgtaccaaaataaagctatatataaacactctgactaggtaaggtgtgaagtaccccgtgagttgctctgtggcttgagatgggacacatggtctcaaatgactcttatgcatgccttgccttaagaaagataagtaatgttgatggtttaaaaagtaagtactttttgaagcatcaaatgaaatgtgtttactaccagcctaaatcacagagcatggtacgagcaagattgttctcaggaaggaaaccatcaatatggcatttatgtaaaatccttgcagcatctgaccatgcttttgaggatccataattctctagtagtagttcta

SEQ ID NO: 1346 - DNA, 229 bp, Homo sapiens
tttgaaatacaactttactctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacag

SEQ ID NO: 1347 - DNA, 294 bp, Homo sapiens
gcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctgaagcagtgtttgctccaccttcatattggctaggtagggtcacctaggg

SEQ ID NO: 1348 - DNA, 487 bp, Homo sapiens
ctttggcagcacagtatgagcacgacttagaggttgctcagacaactgctctcccgggtgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcaacgactgaatagggtccgtaactgtcattgaggattcatagtactcggagtagacgacccgtgaatgtcggagcggaccctggaagtgtagcccgtttccctatggcgagccagatttacccttggcgatatcct

SEQ ID NO: 1349 - DNA, 431 bp, Homo sapiens
gccccagatacacgtacagtaacaatacaaaaatgtgactggtcaaacagctcaagttcacatttaacactttcaattaattacactatttctgttcaaaagaatgttttccttacatacaaccatgatcagtctttagtctcaatcgtaccaaaataaagctatatataagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtacttttttaagcagcagatgaaatgtgtttactaccagcctaaatcaaagaacatggcaagagcaagattgttctcaggaaggaaaccataaatatggcatttatgtaaaatccttgcagcatc

SEQ ID NO: 1350 - DNA, 309 bp, Homo sapiens
gtaaaaaaaaaaattaataaactgttacttatatttaagaaagtgaggattttttttttttaaagataaaagcatggtcagatgctgcaaggattttacataaatgccatatttatggtttccttcctgagaacagtcttgctcttgccatgttctttgatttaggctggtagtaaacacatttcatctgctgcttcaaaaagtacttactttttaaaccatcaacattacttttctttcttaggcaaggcatgcataagagtcatttgagaccatgtgtcccatctcaagccacagagcaactcacgg

SEQ ID NO: 1351 - DNA, 378 bp, Homo sapiens
aggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagagtcagaataaagttgtatttcaaatatctaggcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgag

SEQ ID NO: 1352 - DNA, 497 bp, Homo sapiens
cggcctcgtcctggagagggtgcacttcgagaagtacaaccagcgctttggcagcgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcagaaccttcccttgtaggaacagcctttctcgaatctgttttcagctcttgcattgcatagatgaacctcag

SEQ ID NO: 1353 - DNA, 623 bp, Homo sapiens
gtaattccaaggatcacaagcaaaacaattacacaaacaataatgaacatcaatttccttcttgccttgctctgatatttgatagctttttttgtttcttctttagcgtgttctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatctcattgagagcttgtctagtaatttgtgaatctgatataatgtcggaagtgaagatggatggcttcccgctctccagcatctcttctagctcgtcgtctgtggtggttctcccagttatctccagctggcgctggatgcggcctatgctccgctcccaaaacagggtctgtgcctcattgtactccgccatggcttccacaaacttccgagacagcaccgaatgctgggttcttcgtatccgaagatccactgaagtccggttcccactctcatcctgatcaaaactttgttcaatagcctttaacttggctcgaaatttattcgcaatttttttgatttctttgttcagatcttcaga

SEQ ID NO: 1354 - DNA, 509 bp, Homo sapiens
cgcagagaggaaagtctgcgtctcttcgcaatttgttcctggcgcttccccttagcctccttcattctcttggccaaaagtttagcatattctgcagcctcttctttatttttcttggtacgctgcttcttcagagcaatacgccgccgtttgtgctgcaggacacgtggagtaacaagacgctgaatcttgggtgctttggtcctaggtttcttaccttctttatttaagggctttcttacaacatactggcggacatcatcttctttagagagattgaaaagtttgcggattctgctagctcttttggggcccaggcggcgaggcactgtagtatcagtcagtccaggaatatccttctctcctttttttacaataaccaagttgagaacgctcagatttgcatccacaatgcaaccacgaactgattttctctttctttctccagttctccttggtctgtaacaggaatgccccttactcagtagcaggcggacacggccatgggt

SEQ ID NO: 1355 - DNA, 703 bp, Homo sapiens
ctgtgtactgagggttatgatttgtgtcaaaaattgacataagtgcttttacaagcaccaaagttgaatgaaatttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtctcctgaaggagttctttgttcctgaccaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattattgtcttcatggcatatttactcttactttacctcgtgccaaatcaaatgaaaacaagccgtcttacaagtgaagatccagaattc

SEQ ID NO: 1356 - DNA, 313 bp, Homo sapiens
attcttttttgatcttggggattctggctgtgaatttggtgcacgacaattatggtaaaaaaacatttgctcggtctaaagaagatcattaatgttttgtgaccatacaagttgtaacagtggatcgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctg

SEQ ID NO: 1357 - DNA, 350 bp, Homo sapiens
tgataatcttgagatgattgcttaccttaaaaggtatagaaaggatcacttaaatatatggaaaaatgaaataagggtgaagctgaataaagttctacttactgtattaactgacaacagttgagtttcttaagatctgaattgctgtgtatgttacgctgtattcagaaccagtttccaaccagcctgtgagatgggaagttttttccccataattgggatgaaacctttcattcaggtattttgaatcgaaggtgtatgtgttgtttgtaaccttgtggagattgtaagtgacgtcacttccaaatttcaactgttacatagaagatccagaatgtcaacaccacttg

SEQ ID NO: 1358 - DNA, 260 bp, Homo sapiens
aaaattcatcgatctttcaagatgaaccaaggtttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataaccgtggctattactttgttcttggtccttcacagggcctgctccatcccac

SEQ ID NO: 1359 - DNA, 346 bp, Homo sapiens
cacgttagacaggtaagtgacgtcacttccaaatttcaactgttacatagaaggtccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatgcagcgtaacatacacagcaattcagatcttaagaaactcaactgttgccagttaatacagtaagtagaactttattcagcttcacccttatttcatttttccatatatttaagtgatcctttctataccttttaaggtaagcaa

SEQ ID NO: 1360 - DNA, 418 bp, Homo sapiens
acccatggccgtgtccgcctgctactgaataaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctatgaccaaagcacccaagattcagcgtcttgttactccacgtgtcctgcagcacaaacggcggcgtattgctctgaagaagcatgaggatccacaattctcgagtagtagtagta

SEQ ID NO: 1361 - DNA, 549 bp, Homo sapiens
gtaacaatacaaaaatgtgactggtcaaacaactcaagttcacatttaacactttcaattatttttaattacactatttctgttcaaaagaatgttttccttacatacaaccatgatcagtctttagtctcaatcgtaccaaaataaagctatatataagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtactttttgaagcagcagatgaaatgtgtttactaccagcctaaatcaaagaacatggcaagagcaagattgttctcaggaaggaaaccataaatatggcatttatgtaaaatccttgcagcatctgaccatgcttttatctttaaaaaaaaaatcctcactttcttaaatataagtaacagtttattaattttttttttacagtgagatatggctatgggaagcaagtgatactattttgtttaagaaactgag

SEQ ID NO: 1362 - DNA, 270 bp, Homo sapiens
gtgaaattttctgcaggtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgag

SEQ ID NO: 1363 - DNA, 370 bp, Homo sapiens
cttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattattc

SEQ ID NO: 1364 - DNA, 615 bp, Homo sapiens
ctcaagacaagtgataccctcaacatagccacaaatcagtgagcacatcccacgacagggtgtttaaagaccaaaagaaaaagaacagtcagaggcagaattcccctagtaactgccacacagtgaccaccagcgagtgatccaatggacgcatcatggatgagggagattcggaattgtgttaagtaagggacgcggcttctgagacgttcaatattctccacacctgtttggaatcgggcatctctacattagtttcaaaccaaatggtgttaaaagtcacatgcttacactactacatacaggagtaacaagagttcacgacatttggggcatcctgcatgcactcctttaacattctgactagtgactctcttaacagatgtccgctcaccagttcatacattttacaagtctaaaaataagcgatattcttctactaaaaaaatgagcaataaaaaggtttaattatcatgaatccctatacattttggaaattaacttttaaaagttcagcaaaacattaggtacttaacaacatgtatgtggatctgtacaataagttaaatttgtaagaattactccatgtctcaggaataatttcctcgaagtccg

SEQ ID NO: 1365 - DNA, 212 bp, Homo sapiens
ctttttgatccaaatgtgtgatctgccctgataaataacaagttatagtaccatctcccccgccaataaaaaagagaagaaaaaagagaaaccagcaagtagatcctaaaacacatttcttaacctgagtcataactgaaaacatagattttaattacattttgttgaaaattcattcaactttggtgcttgtaaaagcacttatgtcaatt

SEQ ID NO: 1366 - DNA, 872 bp, Homo sapiens
ggaaggtgggatggagcaggccctgtgaaggaccaagaacaaagtaatagccacagttatgaaatttcattttattctgataaagactaatatatgcttgataacctagtgataatccataagtttggtatttcacaacattttttagaaagcacataagattaacattcaaataaggcattatagaaagttttataaagaatgaagtgtttcctatatttcttttaaaaaaccttggttcatcttgaaagatcgatgaattttttaaatatcagaagaaaagggaaataaaattttccccccaaaacacataagaaccacttactggcacttgtattttaagtacctgggaaaaaaacggaacagatttttaaaggcaataacgacttgtaagacggcttgtttcatttgatttggcacgaagtaaagtaagagtaaatatgccatggaagacataatcaagtttttcctccatctctcatatttccccacttctaccagaccacacagtacatcagcaaccatcctttagattccaatttttaaatggctgctcagacgacaccaatagagttctttccccttaaaatatggtggcagtgaatgctaacaggtatcaatttctttgatcaggaacaaagaactccttcaagaaactcactttcctggtccttggtaacctatcatgtagattctttttattggtacacctgtttactaattataattgattgctttttatgccaagggaacatttccccagcatggcctatctatttactaacaacaaagtatgcttacttttattacatagtggccacgggttgctcctttttctcctttttcagggatccggaatttctcgagtagca

SEQ ID NO: 1367 - DNA, 328 bp, Homo sapiens
cacatgaatctggggagacagattcagaccacagcagatgtcaaggctggttcaaaggacaatgtgaagaacaaaggcatgctgaaatgaatttgataatagatgcaaacttgggtaacatcctacaggacaataaggtgtaagtaatacttgggatcatctttccttagacatgagcatcagttgcatctacagtgaacaacactgattacattgccatagaggaagctctgtgttgctctcagataagaagcatgcacactgctgtattctctacatgaacttctattctacagttgtaaaatagttcagtcaatagaaagccaac

SEQ ID NO: 1368 - DNA, 645 bp, Homo sapiens
gcaaaatatattgcttctactttgcaacaattattctttcaataaaggacttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgaagaaaaaaatagctcaagattcctaactgctacaagaatagtgttgatgggatcaaactcctaattatcctaatagacctaattcatttttaaatgtgggaaaatatgcaagataaatttaaatgcttagttagaaaaaaaaaaaagtttcaccaacttgtttga

SEQ ID NO: 1369 - DNA, 263 bp, Homo sapiens
cgctggacaaagtgaccggtttttccccataaataagacaaagaaaccctggggatctggagaaggatctgaggccattaaactgcaaatcccaaccgaaaacgaagaagcaaaagtttcttttttggttcttttaaacgtctaaagagcataaaattaagaaaaatacaaatccattacaaacacttctcatctgtggggggaaaaggtacaaacgcgatttttttttcccaacagccgaatacgatactcagttatcagta

SEQ ID NO: 1370 - DNA, 459 bp, Homo sapiens
gtaagggacgcggcttctgagccgttcaatattctccacacctgtttggaatcaggcatctctacattagtttcaaaccaaatggtgttaaaagtcacatgcttacactactacatacaggagtaacaagagttcacgacatttggggcatcctgcatgcactcctttaacattctgactagtgactctcttaacagatgtccgctcaccagttcatacattttacaagtctaaaaataagtgatattcttctactaaaaaatgagcaataaaaaggtttaattatcatgaatccctatacactttggaaattaacttttaaaagttcagcaaaacattaggtacttaacaacatgtatgtggatctgtacaatagtttaaatttgtaagaattactccatgtctcaggaataatttcctcgagtcccgagagtactgaacctcaatttcatcaccggc

SEQ ID NO: 1371 - DNA, 401 bp, Homo sapiens
gataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaagcaatatattttgcaacaattattctttcaataaaggacttgtaaattctctcccacaccacgttagacaggtaagtgacgtcacttccaaatttcaactgttacatagaagatccagaatgtcaacaccacttgcaatctccacaagg

SEQ ID NO: 1372 - DNA, 388 bp, Homo sapiens
gaattctggatcctccccaagtaccattcgtcatccaagtccaggtctagatcacactcaaaagcaaagcattctcttcttctctcggtggatctttgcttttgctcgaaggcctatcgggtggtttaacttctaaagtaggcagaggcctgcctccagtcagtagagggcagggcgtagtgctggattcctcgacactgaaaggactctcctcaattttcccagcttctgcttccggcagaggatttttgagggtctgtaaaaataacgccgctttccttttacgttctgcttgaagctgtttctcttttgactccttagacgcctgggccagcttttcccgggcagcagctgcgaggcgatcttccagcttttgctttgctttcac

SEQ ID NO: 1373 - DNA, 644 bp, Homo sapiens
aggccgtatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacaggctatgtagaacacgctaaagaagaaacaaaaaaagctatcaaatatcagagcaaggcaagaaggaaaaagtggataattattgctgtgtcagtggttctggttgccataatcgctctaattattggcttgtcagttggcaaatgatggtgtggataacgtcagtgtgcatgcctctctgccagggtgggaagattgatgttcattattatttgtgtaattgttttgcttgtgatccttggaattatcctagcaacaacattgtcatagcaaccatatcccaagagctatttatccttgagactcagaccacatctgcaaccaaatcagcatcctgtcattttgtgaatgaatctca

SEQ ID NO: 1374 - DNA, 443 bp, Homo sapiens
ctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcaaacatctaaagaaaactttggtaaactggactatagtaatcgtatgagaaaaaaatagctcaagattcc

SEQ ID NO: 1375 - DNA, 352 bp, Homo sapiens
gtgaagttgatacgcaaggaaaatggtccatgtttacccacagttttcaggtactcctagactttaaagatgtcttgaacatttaagttcttcagcagttcacactaagcatctaacattcaaacaaaaaagtgtaaaatttgtaattatttttaacagcaagaattcccaacctcctgccatccactgatgtcccatcctgtttgaagttctatattaaaacatgattacttttgccataaaagaaaatattacccttaaaatatctatttgatatgtacaaaccacatttttattctgacaggtcacagattttgagcaagtgctttcctaggtgaccctacctagccaa

SEQ ID NO: 1376 - DNA, 240 bp, Homo sapiens
aaaccctcccgggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacttcctgacaaaacacatagcctac

SEQ ID NO: 1377 - DNA, 551 bp, Homo sapiens
ctgctctgctgtgctgtcctacaaaaaaaaccctcccgggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatttaacattcaaacaaaaaagtgcaaaatttgtaattatttttaacagcaagaattcccaacctcctgccatccactaatgttccatcctgtttgaagttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtgcaaaa

SEQ ID NO: 1378 - DNA, 308 bp, Homo sapiens
  misc_feature (1)...(308): n = A,T,C or G
ttttggtacgattgagactaaagactgatcatggttgtatgtaagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtactttttgaagcagcagatgaaatgtgtttactaccagcctgaatcaaagaacatggcaagagcaagattgttctcangaaggaaaccataaatatggcatttatgtaaaatccttgcagcatctgac

SEQ ID NO: 1379 - DNA, 328 bp, Homo sapiens
cacatgaatctggggagacagattcagaccacagcagatgtcaaggctggttcaaaggacaatgtgaagaacaaaggcatgctgaaatgaatttgataatagatgcaaacttgggtaacatcctacaggacaataaggtgtaagtaatacttgggatcatctttccttaggcatgagcatcagttgcatctacagtgaacaacactgattacattgccatagaggaagctctgtgttgctctcagataagaagcatgcacactactgtattctctacatgaacttctattctacagttgtaaaatagttcagtcaatagaaagccaac

SEQ ID NO: 1380 - DNA, 386 bp, Homo sapiens
caaacgtagactattaagcagccgtgagaatgatgatacagtctaagctactggcacggaaatatagacatggtaaatttaaaaactgaagctgcgaaacggcacggacagcagaaccccatttatataaaattgtgtgcacacacacacacacctagagaagccccgaaagaagtcaccataatgttgacactggtcatctctgagggatgggatttcaaacgatgtttggctatgtgtgtgtgcatgtgtgtgcgtgtgtgtgttatttaaacagcctgcagagtaggaatatcctggatctacagtgcaccaaggaatgaccatgggaagaaaatgaaccttgcttcattcacaatcaaccgtttttccctcattcacagcaa

SEQ ID NO: 1381 - DNA, 178 bp, Homo sapiens
aaaaaatcgcgtttgtaccttttccccccacagatgagaagtgtttgtaatggatttgtatttttcttaattttatgctctttagacgtctaaaagaaccaaaaaagaaacttttgcttcttcgttttcggttgggatttgcagtttaatggcctcagatccttctccagatccccag

SEQ ID NO: 1382 - DNA, 264 bp, Homo sapiens
ggatttttttttttaaaaataaaagcatggtcagatgctgcaaggattttacataaatgccatatttatggtttccttcctgagaacagtcttgctcttgccatgttctttgatttaggctggtagtaaacacatttcatctgctgcttcaaaaagtacttactttttaaaccatcaacattacttttctttcttaaggcaaggcatgcataagaatcatttgagaccatgtgtcccatctcaagccacagagcaactcacggg

SEQ ID NO: 1383 - DNA, 389 bp, Homo sapiens
tggaaacacagttgttgtggttgagaaagatcatttcatggatgatttcttccatcaggtggaggagattagaaacactattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaag

SEQ ID NO: 1384 - DNA, 297 bp, Homo sapiens
aatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacacctttaggtttgaaactaatgtagagatgcctgattccaaacaggtgtggagaatattgaacggctcagaagccgcg

SEQ ID NO: 1385 - DNA, 358 bp, Homo sapiens
cagtcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcagctcacggggtacttcacacctaacctagtcagagtgcttatatatagctttattttggtacgattgaggctaaagactgatcatggttgtatgtaaggaaaacattctttagaacagaaatagtgtaattaaaaataattgaaagtgttaaatacaaaaatgtgactggtcaaacagctcaagttcac

SEQ ID NO: 1386 - DNA, 482 bp, Homo sapiens
gttgacattctggatcttctatgtaacagttgaaatttggaagtgacgtcacttacctgtctaacgtggtgtgggagagaatttacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcaacttcacccttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtggtgatgggatcaaactcctaattattctaa

SEQ ID NO: 1387 - DNA, 369 bp, Homo sapiens
gtgaatttgtgtctcacaataaatctgtaaatccagttgctttctttctggaattttatatagtgtctcaccatgttccacaatgctggaaatgtcttttttggcatcaatctatgcacaaatttctgattacgtattttccccaaatgacatgtaactttttttaactttaccagaaaaatatggaaactttatcaaccacttattaactgaacaaaaagttagattactaccaaatgctcttttaattttgctctaacagatgttttaaaggttcagacatcgctgatgtttttgaggataactgcatacaacacactagatgatttcaaacgatgcatcttagtatccgaatcatttggcacatcc

SEQ ID NO: 1388 - DNA, 584 bp, Homo sapiens
gttttcagttatgactcaggataagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcgttcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgaggatccaaaattctcgagtagtagtagta

SEQ ID NO: 1389 - DNA, 478 bp, Homo sapiens
ggctaggagaggaaaaggggaatgactggtggtgggtgtgaagtttctttttgggttgataaaagtgttttaaattgattgtgtctggaaatacaccaaaaaccactgaattaattgtatgctccaaatatcattcacatattaagagatttacttctcaataaagttgttgagatgtcatttaatgaaaaaagttttaaagttagtaaattgcgaaatttgtttacttacactattttttgggaggtaattctcaatcatttaaaaatctatttgagagcacacatggtggtttacatgtataatcccagtgctttgggagaccaaggtggaaccttggaaaaactgtgttacaggaaagaagtcagtcacagaacacatagtgtataattccatttatatgaaacatccaaaatgggaaaatgtacaggagtaaaaagtagaatgcagttgccttgagctaggagaggaaatgggg

SEQ ID NO: 1390 - DNA, 448 bp, Homo sapiens
  misc_feature (1)...(448): n = A,T,C or G
agtcttggggaactccacgtgttagttggcatcccagtttcttaaacaaatagtatcacctgcttcccatagccatatctcactgtaaaaaaaaaaattaataaactgttacttatatttaagaaagtgaggattttttttttttaaagataaaagcatggtcagatgctgcaaggattttacataaatgccatatttatggtttccttcctgagaacagtcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggngtacttcacaccttacctagtcagagtgcttatatatagctttattttggtac

SEQ ID NO: 1391 - DNA, 416 bp, Homo sapiens
cagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaagatctacttgctggtttttctttttgatccaaatgggtgatctgccctgataaataacaaggttatagtaccatctcccccgccaatataaaagagaaggaataaagagaaacccgtggcactatgtaaacaaagtatgcttactttgaggatccagacttctcgagtaatagtagtagtagta

SEQ ID NO: 1392 - DNA, 636 bp, Homo sapiens
aaaagtaacatgtgcaaaagctccccgtccagctttgacagtcagttttgatgtcagctcctcggcagggtaggcctgatgacagccctgtccctccctgcctctgccttgcccaaggccacggagggcatctacagagaggcctgccttccggattccaggcgggtatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatatgccactgtgcttggacttagaagaagaaaatccccgtgacttcttcctcatcaccttgatggctttattctcaccttgtggggcatgtttgtatttattgcttcatggccgactggaatcctgagtcctgagaagctggcactgcggagatcttgcccggtgtcctggtcctcttgcttccgtcgcggccgcatgtgcgtgtgtccaaacaggtcctgggcgcctcaactgctgccgaggatccagatttctcaagtagtagta

SEQ ID NO: 1393 - DNA, 436 bp, Homo sapiens
ggaaagtgaatacttttatgcttctctggaaatttttaatgtaaacatgaaatatttgaagaaccgattaaaaagtctcaagtgaatctgtaaatacatttttaagtctgacttcaaatcggtacatgaggcttagacatacacatcattggacaagtgacttaaatatctaaatacaaatcaaatagcattttcctaacttcaactataaaaacacaaattttagtaggtactgcaaatctaagaagaataacttgaaaaataccataataagtgttgtaaaaggggaggactcatatgacagaccttgaaggaaaggtgggacatcacgggaggcaggtccccctgtggacatgattccacagaggcgtggagtccttttgccaccagcatgatcctgaaatattgaaaaccctcaagacaagtgataccttca

SEQ ID NO: 1394 - DNA, 516 bp, Homo sapiens
tctagctgggttcccttttttacagaaactcacaaatggagattgcaaagtcttggggaactccacgtgttagttggcatcccagtttcttaaacaaatagtatcacctgcttcccatagccatatctcactgtgaaaaaaaaaattaataaactgttacttatatttaagaaagtgaggattttttttttttaaagataaaagcatggtcaaatgctgcaaggattttacataaatgccatatttatggtttccttcctgagaacagtcttgctcttgccatgttctttgatttaggctggtagtaaacacatttcatctgctgcttcaaaaagtacttactttttaaaccatcaacattacttttctttcttaaggcaaggcatgcataaaagtcatttgagaccatgtgtcccatctcaagccacagaacaactcacgggggactacacaccttacctaatcagagtgcttatatatagctttattttggtcgattgaaaactaagactgatc

SEQ ID NO: 1395 - DNA, 528 bp, Homo sapiens
gtcccatagccatatctcactgtaaaaaaaaaaattaataaactgttacttatatttaagaaagtgaggatttttttttttttttttggatttcgcatttgagatgctttttataataaagttatgccaaaaatacagcaacaaatacagaaaaagtattaacaaacggagaagccccagatacacgtacagtaacaatacaaaaatgtgactggtcaaacagctcaagttcacatttaacactttcaattatttttaattacactatttctgttcaaaagaatgttttccttacatacaaccatgatcagtctttagtctcaatcgtaccaaaataaagctatatataagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtactttttgaaggaggatccaaaattctcgagtagtaatagta

SEQ ID NO: 1396 - DNA, 615 bp, Homo sapiens
tctagttaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtatggaagttttatgccatgttaatattcgaattgccttgcttttatcacttaatttgaaatctattgggttaatttctccctatgtttatctttgtacatttgagccatgtcacacaaactgatgatgaacaggtcagcagtattctatttggttagaagggttacatggtgtagatattagtgcagttaagctaaagcagtgtttgctccaccttcatattggctaggtagggtcacctaaggaagcacttgctcaaaatctgtgacctgccaaaataaaaatgtgggttggacattata

SEQ ID NO: 1397 - DNA, 111 bp, Homo sapiens
gtgagaatgaagctggagcccagcgtcagaagtctagttttataggcagctgtcctgtgatgtcagcggtgcagcgtgtgtgccacctcattattatctagctaagcggag

SEQ ID NO: 1398 - DNA, 739 bp, Homo sapiens
  misc_feature (1)...(739): n = A,T,C or G
ggcaaagtagaagcaatatattttgcaacaattattccttcaataaaggacttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaggaaaactttggtaaactggactatagtaatcgtatgagaaaaaaatagctcaagattcctaactgctacaagaatagtgttgatgggatcaaactcctaattatcctaatagacctaattcatttttaaatgtggaaaatatgcaagataaattaaatgcttagttaaaaaaaaaagtttcaccaactgttctccattactgagaagcccccacgctgccccactgtgcatattcctagtatttcatccatgtcctgctctgctgtgctgcccctacaaaaaaccctccccggng

SEQ ID NO: 1399 - DNA, 265 bp, Homo sapiens
caagttatagtaccatctcccccgccaataaaaaagagaagaaaaaagagaaacccgtggcgctatgtaaataaagtaagcatactttgttgttagtaaatagatgaggcatgcctgggaaaatgctcccttggcataaatagcaatcaatcataattagtaaacaggtatcaatttctttgatcaggaacaaagaactccttcaggaaactcactttcctggtccttgttaacctatcatgtaaattctttttattggtacacc

SEQ ID NO: 1400 - DNA, 459 bp, Homo sapiens
tacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgtt

SEQ ID NO: 1401 - DNA, 403 bp, Homo sapiens
agcattctcttcccagtgcctatcggtggatctttgcttttgctcgaaggcctatcgggtggtttaacttctaaagtaggcagaggcctgcctccagtcagtagagggcagggcgtagtgctggattcctcgacactgaaaggactctcctcaattttcccagcttctgcttccggcagacgatttttgagggtctgtaaaaataacgccgctttccttttgcgttctgcttgaagctgtttctcttttgactccttagacgcctgggcgagcttttcccgggcagcagctgcgaggcgatcttccagcttttgctttgcttgctttgcttctagctcctcctgggtaagttgaggcttcttctcctcaacaactacacagggtggggcaactgctgggttag

SEQ ID NO: 1402 - DNA, 411 bp, Homo sapiens
aatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagtcgtctgagcaacctctaagtcgtgctcatactgtgctgccaaagctgggtccatgacaacttctggtggggcgagagcaggcatggcaacaaattccaagttagggtctccaatgagcttcctagcaagccagaggaagggcttttcaaagttgtagttacttttagcagaaatg

SEQ ID NO: 1403 - DNA, 511 bp, Homo sapiens
ctcatgggctcgcgctgtgtgtcatagcgtcagggcctgggccgctgtccacagggcgcctggtgacagtggcggcagcagcagcagcatggtggcagccaccagtgggcctggggcccccgggggagaggatgccccagaggtgcatgagcagacctcgtaaccgtcctccgagcggctctggtcatgttgtcctggaggggcgcggggcccctctgccgcgtccacgcccgcagccacagatccattggcctgtgagtctccacacaccagccagtcccgggccgtggactgtgggtacccgggtgccacctccagttcgccatccagcactttccagtactcctggccacggaagaagtaggaggcaccgtcggaccagcgcatggcgtcgtccagcgtgctggggacacccctccacagggggctccgggcggggtagccggggtccatgtgcctcgtgtggtcatcgtagcgccagtacagctggtccttaaagaaataagtcctg

SEQ ID NO: 1404 - DNA, 235 bp, Homo sapiens
tcctgtgtgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatac

SEQ ID NO: 1405 - DNA, 149 bp, Homo sapiens
ctttgtttgtatcattggattcttgtattgctttcttaggccatatacgactaacgaagggggaaaccagagggtatatatatggctccaggagttttttgtagatccagagcagaactggaatgacgatacaaggaatgcacaccatt

SEQ ID NO: 1406 - DNA, 354 bp, Homo sapiens
ttcctgttacagaccaaggggaactggagaaggaaagagaaaatcagttcgtggttgcattgtggatgcaaatctgagagttctcaacttggttattgtaaaagaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagatccagcgtcttgttactccacgtgtcctgcagcacaaacggcggcgtattgctctgaagaagcagcgtac

SEQ ID NO: 1407 - DNA, 234 bp, Homo sapiens
ggctgcagggagcgtgtgaggagtggttgtaatatttgaagttcctggaatcctcaaatgaagactctgtaaaacatatgttgtctgcatttggaaatacactgtccagaaaggtatcaaagccaagaaaacaggggcaatcttgaccagagctttcacatcttccactttcccttctgtaaatggcccaccatgagacatcttacatgaatcaaacagactttgtttagaaga

SEQ ID NO: 1408 - DNA, 355 bp, Homo sapiens
atcttgttcgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttattttcgtacatttgagccatgccacacaaactgatggtgacaggtcagcagtattctatttggttagaagggttacatggtgtaaatattagtgcagttaagctaaagcagtgtttgctccacctacctagccaatatgaagg

SEQ ID NO: 1409 - DNA, 428 bp, Homo sapiens
tgggaattcttgctgttacaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgttttttttcccccccgggagggtttttttgtagggcagcacatcagagcaggacatggatgaaatactatgaatatgcacagtggggcagtgtgggggcttctcagtaatggagaacagttggtgaaactttttttttttttttaactaagcatttaatttatcttgcatattttccacatttaaaaatgaattaggtctatcaggataattaggagtttgatcccatcaacactattct

SEQ ID NO: 1410 - DNA, 412 bp, Homo sapiens; identical to SEQ ID NO: 1024

SEQ ID NO: 1411 - DNA, 206 bp, Homo sapiens
gtccacaacgccttcatttgcttcctcctcttcaattgtttcctcttgatcgtgcacttcgtcatcagtcaaagatatgctagcttttctttttcttccagacattcctgaatccagagaactttcctgtaatgcgtcaaatcctttaggtctcaattctttccctctcctggaaactttctgtaaatttaaggccttcttccttt

SEQ ID NO: 1412 - DNA, 495 bp, Homo sapiens
gatgaattaggtctattaggataattaggagtttgatcccatcaacactattctcgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacg

SEQ ID NO: 1413 - DNA, 197 bp, Homo sapiens
ccagtagccttattttgtcagggacgaattgtttaccccatgataatgtaggatatcataaattcttcttcaaaggttttagcctgtaatttgctaagtacattgagttctgagatcctctccaaagaaccaatgtatcagtatgttcagctcacctgttctttgttcttcattttaacttttaatttcctcattct

SEQ ID NO: 1414 - DNA, 282 bp, Homo sapiens
cgtgttctacatagcctgtggcattcataacatttgtttctatgttgttgatcatttcaccctgagtctccacaaacatagccatgtccatgaacatctcatgcaactctcggatgctggtctccagcttcatgatgcccttgtgacgtgactcgatttcattgagagcttgtctagtaatttgtgaatctgatataatgtcggaggtgaagatggatggcttcccgctctccagcatctcttctagctcgtcgtctgtggtggttctcccagttgcctcat

SEQ ID NO: 1415 - DNA, 89 bp, Homo sapiens
aagaaccaaaaaagaaaccctggggatctggagaaggatctgaggccattaaactgcaaatcccaaccgaaaacgaagaagcaaaagtt

SEQ ID NO: 1416 - DNA, 409 bp, Homo sapiens
cgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataactccattgtttggacctgcatatttagctgttttggaacgcagttgattccttgagtttcatatataagactgctgcagtcacaacacaatattcagtggtgaaatcttgtttgttactgtcat

SEQ ID NO: 1417 - DNA, 248 bp, Homo sapiens
gttgccttgggctaggagaggaaatggggaatgactggtggtgggtgtgaagtctctttttgggttgataaaagtgttttaaattgattgtgtgtggaaatacaccaaaaaccactgaattaattgtatgctccaaatatcattcacatattaagagattcacctctcaataaagtcgttgagatgtcatttaatgaaaaaagttttaaagttagtaaattgcaaaatttgtttacttacactatttt

SEQ ID NO: 1418 - DNA, 345 bp, Homo sapiens
ctccttagacgcctgggcgagcttttcccgggcagcagctgcgaggcgatcttccagcttttgctttgcttgctttgcttctagctcctcctgggtaagttgaggcttcttctcctcaacaactacacagggtggggcaactgctgggttagtgtttgcagcactactagaactttcttggccttctttgctttcttcatcatcatcactgtcatcatctagcttaacacgatttttttccaggggaagcagatcattttctttggccttgattgcaaagcttattggagcaaaggaagctttcaccagcttcccgtccgggacggtcttactggacgatgcctc

SEQ ID NO: 1419 - DNA, 516 bp, Homo sapiens
aatatctaagcaagtgaactcattccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattactgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcattggatggcacgaggttgggaattcttgctgttaaaaataattacaaattttgcacttttttggttgaatgt

SEQ ID NO: 1420 - DNA, 347 bp, Homo sapiens
aacattcttttgaacagaaatagtgtaattaaaaataattgaaagtgttaaatgtgaacttgaggtgtttgaccagtcacatttttgtattgttactgtacgtgtatctggggcttctccgtttgttaatactttttctgtatttgttgctgtatttttggcataactttattataaaaagcatctcaaatgcgaaatccaaaaaaaaaaaaaaaatcctcactttcttaaatataagtaacagtttattaatttttttttacagtgagatatggctatgggaagcaggtgatactatttgtttaagaaactgggatgccaactaacacgtggagttccccaagacc

SEQ ID NO: 1421 - DNA, 234 bp, Homo sapiens
tcttctaaacaaagtctgtttgattcatgtaagatgtctcatggtgggccatttacagaagagaaagtggaagatgtgaaagctctggtcaagattgtccctattttcttggctttgataccttactggacagtgtatttccaaatgcagacaacatatgttttacagagtcttcatttgaggattccagaaatttcaaatattacaaccactcctcacacgctccctgcagcc

SEQ ID NO: 1422 - DNA, 298 bp, Homo sapiens
gcacagtataagcaatatattttgcaacaattattctttcaataaaggacttgtaaattctcggccacaccacgttagacaggtaagtgacgtcacttccaaatttcaactgttacatagaagatccagaatgtcaacaccacttgcaatctccacaaggttacgaacaacacatacaccttcaactcaaaatacctgaatgaaaggtttcatcccaattatggggaaaaaacttcccatctcacaggctggctagaaactggttctgaatacagcgtaacatacacagcaattcaga

SEQ ID NO: 1423 - DNA, 652 bp, Homo sapiens
  misc_feature (1)...(652): n = A,T,C or G
aagattgccctacagatgaactgcaagatgggaggagagctctggagggtggacatccccctgaggctcgtgatgatcgttggcatcgattgttaccatgacatgacagctgggcggaggtcaatcgcaggatttgttgccagcatcaatgaagggatgacccgcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctancagctgtgccacatctattacaactggccaggtgtcattcgtgtttctgctccttgccagtacgcccacaagctggcttttcttgctgac

SEQ ID NO: 1424 - DNA, 369 bp, Homo sapiens
tattcagtggtgaaatcttgtttgttactgtcattcccattccttttcgtttggaatcagaataaagttgtatttcagatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccacctatctagccaatatgaagg

SEQ ID NO: 1425 - DNA, 226 bp, Homo sapiens
agatggtcactatggtagagattgaccaaatggtgattgatgggtgtaagagatacatgcgaaaaacgtgtggcgatgtcttagacaatcttaaaggagactgctatcaggttctaatagaagactgtatcccggtactgaagaggtacgccaaagaagggagagaatcttcttctggagacgtggagattggaacagctgtcaaatcattaatcacataatcaaa

SEQ ID NO: 1426 - DNA, 389 bp, Homo sapiens
ccttcatattggctaggtaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagatttgatgaccaagaattctgatgctactgctagta

SEQ ID NO: 1427 - DNA, 263 bp, Homo sapiens
cgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagt

SEQ ID NO: 1428 - DNA, 531 bp, Homo sapiens
tcctgtttgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtgatttccaaatgctatttataaacaagggatgagttcacttgctcagatatttgaaatacaactttattctgattctaaacgaaaaggaatgggaatgacagtaacaaacaagatttcaccactgaatattgtgatgtgactgcagcag

SEQ ID NO: 1429 - DNA, 470 bp, Homo sapiens
gagtataatgtctatggtgaagtcttttgtacagtggttagggtgtcgtagtcattcttcagcacgattcttgattggagaccaagaaccctgggcctttagaggtggtctagcaggagagttccagcgtttgctgccaattgatagggcaaatgatctcttttttcagccacctccactgactcctacctccaaagtttatactatcagaccttattttcctaaggatgaggcatccgtgtacaagatttgcagagaaatgtatgacgatggagtgggtctaccctttcaaagtcagcctgatcttattggagacaagttagtaggagggctgctttccctcagcctggattactgctttgtcctagaagatgaagatggcatatgtggttatgcctcgggcactgtagatgtgaccccctttattaaaaaatgtaaaatttccttgtcaccatttggcttggtatact

SEQ ID NO: 1430 - DNA, 374 bp, Homo sapiens
cagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtccttccca

SEQ ID NO: 1431 - DNA, 308 bp, Homo sapiens
cctcaggtagtccacctgccttggccccccaattataggtgtgagccacagcacccagccaaaaaagtaatttttcttagagtaataatgctataatgttggtgtgattccaacctccagctccccccacccgctgcctgcggttttgtttctgttaaaacgtcacctgatgaaatagaatgaatcctgaaatgcacctctgggatcgggaatggtccgtggttgacagaaattacactggccagaatccccagtccccatgaggcttgtccagacgcagtgaaccagtcgcagctgataacacacag

SEQ ID NO: 1432 - DNA, 233 bp, Homo sapiens
gcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacg

SEQ ID NO: 1433 - DNA, 300 bp, Homo sapiens
ctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactccccacacgctccctgcagcctg

SEQ ID NO: 1434 - DNA, 435 bp, Homo sapiens
ctggctcaatactgatggaagtaatctgcttaacaatctcagaaggactgtgcaagtcaatgagtcgcttgtgaattctcatctggaaacgatcccacgtcttagaaccttcaccacaaggagtttttcttgtagtgattctcaaagtcttggtaggcattcgaactggtcctttcactttgagattcttttcttttgcgcctcttatcaagtcagcacacaccttttccaaggattttacgttgcggcttgttagggtgattcgaattcggtgaattgccacctccggctccacgggtgtttttccggtatccctaaaagccatggctgttgcgcgcgggcttcctgaccgacttgttcctcggcgagagcggacagcggtgagtcaggagcaggagcgtgcggaccaaaaatcctcagcccttacgaccggat

SEQ ID NO: 1435 - DNA, 234 bp, Homo sapiens
ggctgcagggagcgtgtgaggagtggttgtaatatttgaaatttctggaatcctcaaatgaagactctgtaaaacatatgttgtctgcatctggaaatacactgtccagtaaggtatcaaagccaagaaaacagggacaatcttgaccagagcttttacatcttccactttctcttctgtaaatggcccaccatgagacatcttacatgaatcaaacagactttgtttagaaga

SEQ ID NO: 1436 - DNA, 548 bp, Homo sapiens
ccttcatattggctaggtaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatggatttcaaattaagtgataaaagcaaggcaattcaaatattaacatggcataaaacttccctactttagtggtttccaaatgctatttataaacagggaataagtcaattggttaaaattttgaaattccaccttatttttaatcttaaccaaaagggatgggaatggacagtaccaaccagaattcgctgacgaatattgctgaccataaatgcagattctaaccctagaattccacaccggaacctgcgagcgtaccatgtatgcgtaccatgagtccctatagagagtggcattataacgggcatagctgatggctgtaggagattgctgtgcgataacgatatcccaccacattcgaacacgacacacaaaccg

SEQ ID NO: 1437 - DNA, 216 bp, Homo sapiens
tgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggttttt

SEQ ID NO: 1438 - DNA, 476 bp, Homo sapiens
gccccagatacacgtacagtaacaatacaaaaatgtgactggtcaaacagctcaagttcacatttaacactttcaattatttttaattacactatttctgttcaaaagaatgttttccttacatacaaccatgatcagtctttagtctcaatcgtaccaaaataaagctatatataagcactctgactgggtaaggtgtgaagtaccccgtgagttgctctgtggcttgagatgggacacatggtctcaaatgactcttatgcatgccttgccttaagaaagaaaagtaatgttgatggcttaaaaagtaagtactttttgaagcagcagatgaaatgtgtttactaccagcctaaatcaaagaacatggcaagagcaagactgttctcaggaaggaaaccataaatatggcatttatgtaaaatccttgcagcatctgaccatgcttttatctttaaaaaaaaaaaatcctcact

SEQ ID NO: 1439 - DNA, 463 bp, Homo sapiens
ctcggggctgcctgcaccggtaattagaatggaacaggacaggacagggattttcatggtacttttctatacaatgtctgtaatctatagataacgtaaccgattaggtcatgggtcaatctttaactaccaggcccaggatgtggggccaggctgtctgcttgtggatttcatttctgccttttagattttacttctttctttggaggcagaaattgggcataagacagtatgaggggttgtctcctcccttaaaatcacgaactggtggtatagtgaggagctattccttccaaaatcttttaaaaacattactggtcatggctgagaaaagtgtctctggagtcttaaagttggtgaaaataatttttcccaatataattatcttactccacatacgaagtcttgtaatccaacctgtagagagttgccatgcactgtgacttactttgtataatatagt

SEQ ID NO: 1440 - DNA, 144 bp, Homo sapiens
atttcataccttcataaaagtcttaagaataatgccatgattcttaataatgctacatgattcttatgtgggtgccatgagcacctacatagtcttcccagattcaccaaggttaggtttttaccatgttatcatagtcttccc

SEQ ID NO: 1441 - DNA, 505 bp, Homo sapiens
catttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcgttgcagcgtgtgtgccacctcattattatctagctaagcggaacatgtgcttcatctgtgggatgctgaaggagatgagtgggcttcggagtgaatgcggcagtttaaaaaataacttcattgtttggacctgcatatttagctgttttggaacgcagttgattccttgagtttcatatataagactgctgcagtcacatcacaatattcagtggtgaaatcttgtttgttac

SEQ ID NO: 1442 - DNA, 434 bp, Homo sapiens
ggtaagtgacgtcacttccaaatttcaactgttacatagaaggtccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaaccgtatgagaaaaaaatagctcaagattcctaactgctacaag

SEQ ID NO: 1443 - DNA, 355 bp, Homo sapiens
ccttcatattggctaggtaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagat

SEQ ID NO: 1444 - DNA, 472 bp, Homo sapiens
agtgaggatttttttttttaaagataaaagcatggtcaggtgctgcaaggattttacataaatgccatatttatggtttccttcctgagaacagtcttgctcttgccatgttctttgatttaggctggtagtaaatacatttcatctgctgcttcaaaaagtacttactttttaaaccatcaacattacttttctttcttaaggcaaggcatgcataagagccatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaatagttgaaagtgttaaatgtgaacttgagctgtttgaccagtcacatttttgtattgttactgtacgtgtatctgg

SEQ ID NO: 1445 - DNA, 264 bp, Homo sapiens
caagttatagtaccatctcccccgccaataaaaaagagaagaaaaaagagaaacccgtggcgctatgtaaataaagtaagcatactttgttgttagtaaatagatgaggcatgcctgggaaatgctcccttggcataaatagcgatcaatcataattagtaaacaggtatcaatttctttgatcaggaacaaagaactccttcaggaaactcactttcctggtccttgttaacctatcatgtaaattctctttattggtacacc

SEQ ID NO: 1446 - DNA, 450 bp, Homo sapiens
agatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccgactctccacaggggagacgctggctgagtgcgccgagtgggccgcgggggccgcgggccggggcgctgcctgc

SEQ ID NO: 1447 - DNA, 386 bp, Homo sapiens
gcctcctgatggcagtgccttcaccgacatgttcaagatactgacgtattcctgctgttcccagaagcgaagtggagagcgccagagtaatggatgcagacaacatatgttttacagagtcttcatttgatgattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggccttttgctgcaggaattttggagagtaaaaggctgaaccttgttaaagagaaaacca

SEQ ID NO: 1448 - DNA, 244 bp, Homo sapiens
agaaccacctcaaggggaggaagaagaaagcatggaagctcaggagtgacattcccttcactccttttcctacccaagggggaagactggagcctaagctgcctgctactgggctttacatggtgacagacatttccgtgggatagggaagatagcaggaagaaaagcaaactccatagaagtgtcattccacagggttttgatattggcttagctgccagtctcccatttgtgacctatgcca

SEQ ID NO: 1449 - DNA, 522 bp, Homo sapiens
caaacaagatttcaccactgaatattgtgatgtgactgcagcagtcttatatatgaaactcaaggaatcaactgcgttacaaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgtgctgccaaagctgggtccatgacaacttctggtggggcgagagcaggcatggcaacaaattccaagttacggtctccaatgagcttcctagcaagccataggaagggcttttcaaagatgtagttacttttggcagacatgtcgtagtactgaagatgcttc

SEQ ID NO: 1450 - DNA, 423 bp, Homo sapiens
agatcatgctggtggcaaaaggactccatgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtatgtctaagcctcatgtaccgatttgaagtcagacttaaaaatgtatttacagattcacttgagactttttaatcggttcttcagatatttcatgtttacattaaaaatttccagagaagcataaaagtattcactttcctgccttgtcatttctggaaagattt

SEQ ID NO: 1451 - DNA, 522 bp, Homo sapiens
  misc_feature (1)...(522): n = A,T,C or G
gacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaacctaatagaatactgctgacctgtcatcatcagtttgtgtgacatggctcanatgtacaaaaataaacatagggagaaattaacccaataga

SEQ ID NO: 1452 - DNA, 196 bp, Homo sapiens
aaagcaaagcattctcttcccagtgcctatcggacagtgcggcggtcgaggtcccgctcccggtcccctcggaggagagcccactcccctgagagacagagggaaaagaggagtgtgctctagacctggacttggatgacgaatggtacttgggaaaacgtgatcttgttcgagatctttttttgtgctttttctt

SEQ ID NO: 1453 - DNA, 255 bp, Homo sapiens
ctggcaacagttaatacagtaagtagaactttattcagcttcacccttatttcatttttccatatatttaagtgatcctttctataccttttaaggtaagcaatcatctcaagattatcagacatctaaagaaaactttggtaaactggacgatagtaatcgtatgagaaaaaaatagctcaagattcctaactgctacaagaatagtgttggtgggatcaaactcctaattatcctaatagacctaattcattt

SEQ ID NO: 1454 - DNA, 331 bp, Homo sapiens
atccgaatcctggtcagcttccattaaaatcctacatttattcccaggaatggtaatttcacctccctacatctatactccactccctcagtaaataagtgaaaattgttaacccttgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattat

SEQ ID NO: 1455 - DNA, 702 bp, Homo sapiens
  misc_feature (1)...(702): n = A,T,C or G
ctcgatgatggtcatattttacagaaataatgaggaaaagcaggagggtagctccttgaatagcagccagaagaaaaaagtaatagttcaaatagcagccgttaatattaccaaagtctgtgtgactgctcatccatccgatggctttgatagacaccagtgccagcagtccagaacccacgaacgacccgacgccagagaagaaaaagaacaagcccattatggcactctgcatggacttgggggcagctgagtatgcaaattccaggcctgcgatacttgcaaagatctcgctgatcccaatcagcaagtactgcggcacctgccaccacagcgacagatcggcagcatggtagacgacgttgccgatggtctgattaatggttttctctttaacaaggttcagccttttactctccaaaattcctgcagcanaggctgagcacatgacaaagaacatgcccccggcgatcctcttcagggaggatgggagcaggccatgtcttctcaaaatgggatcgaccagtttgtccttcaaagggatgagcaggaggatgagcacagcaatcaacatggtcagcccggctgcagggagcgtgtgaagagtggtttgaataattgaaatttctggaatcctcaaatgaagactctggtaaacatatgttgtctgcatttggaaatacactgtccagtaagggatca

SEQ ID NO: 1456 - DNA, 461 bp, Homo sapiens
aagtaactacaactttgaaaagcccttcctctggcttgctaggaggctcattggagaccctaacttggaatctgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcggaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcaattgattccttggctgaccaagaattcagattctagtagtagta

SEQ ID NO: 1457 - DNA, 457 bp, Homo sapiens
caacatatgttttacagagtcttcatttggggattccagaaatttcaaacattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgtt

SEQ ID NO: 1458 - DNA, 362 bp, Homo sapiens
tcagaataaagttgtatttcaaatatctaagcaagtgaactcatcccttgtttataaatagcatttggaaaccactaaagtagggaagttttatgccatgttaatatttgaattgccttgcctttatcacttaatttgaaatctattgggttaatttctccctattattattctgacaggtcacagattttgagcaagtgcttccctaggtgaccctacctagccaatacgaaggtggagcaaacactgctttagcttaactgcactaatatttacaccatgtaacccttctaaccaaatagaatactgctgacctgtcatcatcagtttgtgtgacatggctcaaatgtacaaaaataaac

SEQ ID NO: 1459 - DNA, 484 bp, Homo sapiens
acaacgtgaacatgggtcagaaaagtcagctgcacaaaaacacttcagccaattctaacacagagggagcatagacatggaggggctgggggttaggctgggggagaccagccttccctgctaagggctcgtggtccaagcccacaaccagagggtgctctgggtggtgtccaggaacatgcagtgccggctccggggaggagggacgagaagagaaaggggagtcacagaggaggctgcagatgagcacgagtttattggactctggcctcgcgctgctgcttgatgaagttgatgagcccattggtagaagcgtcgtgagaggtcacttgagcactgccatcaagctcaggctctattttcttagccagctgctttcccagctccactccccactggtcaaagctgttgatgtcccagatgatgccctgagcgaagatcttgtgctcatacatggcgaccaaggctccaagcacgaatggtg

SEQ ID NO: 1460 - DNA, 531 bp, Homo sapiens
  misc_feature (1)...(531): n = A,T,C or G
ctgctgcagtcacatcacaatattcagtggtgaaatcttgtttgttgctgtcattcccattccttttcgtttagaatcagaataaagttgtatttcaaatatctaagcaagtgaactcatcccttgtttataaatagcatttggaaaccgctaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctanggaagcacttgctcanaatctgtgacctgtcagaataaaaatgtggtttgtacatatcaaatagatattttaagggtaatattttcttttatggcgaaagtaatcatgttttaatgtagaacctcaaacagga

SEQ ID NO: 1461 - DNA, 229 bp, Homo sapiens
actgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggttctacattaaaacatgattactt

SEQ ID NO: 1462 - DNA, 597 bp, Homo sapiens
  misc_feature (1)...(597): n = A,T,C or G
tttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattntgaattgaaggtgtatgtgttgtttgtagccttgtggagattgcaagtggtgttgacattctggatcttctatgtaacagttgaaatttggaagtgacgtcacttacctgtctaacgtggtgtgggagagaattacaagtcctttattgaaagaaataattgtgccaaatatattgcttttactttgcctt

SEQ ID NO: 1463 - DNA, 563 bp, Homo sapiens
gaatcctaatacctgaacagcaacttccaaatatcaactgttacatagaagatccataatgtcaacaccacttgcaatctccacaatgttacaaacaacacatacaccttcaattcaaaaaacctgaatggaaggtcacatcccaattatggggaaaaaacttcccatctcacaggctggttagaaactggttctgaatacagcgtaacatacacagcaattcagatcttaagaaactcaactgttgccagttaatacagtaagtagaactttattcagctccacccttatttcatttttccatatatctaagtgatcctttctataccttttaaggtaagcaatcatctcaagattatcagacatctaaagaaaactttggtaaactggactatagcaatcgtatgagaaaaaaatagcccaagattcctaactgctacaagaatagtgttgatggaatcaaactcctaattatcctaatagacctaattcatctttaaatgtggaaaatatgcaagataaattaaatgctttagttaaaaaaaaaagttttgctgaccaag

SEQ ID NO: 1464 - DNA, 390 bp, Homo sapiens
catggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtca

SEQ ID NO: 1465 - DNA, 216 bp, Homo sapiens
gagaagttctaagtaagtatatttctctatcggcagctgaagccttgagttccacctcttggatcagtcttatctgtgctgcctgctgctgccttttttgcctctccattttttctaatgttttttcgagggttcttaagtgtttaaggtgatcctcttgttgatcttttgctttcattagttcaacagtcagttttttaatttcattttgaagtt

SEQ ID NO: 1466 - DNA, 215 bp, Homo sapiens
ttatattaaaataataatctgtaacttcggttccaagtaccaagggggggctagggctggcctgagtgggggcctcacagtgcgctggacaaagtgaccggtttttctccataaataagacaaagaaaccctggggatctggagaaggatctgaggccattaaactgcaaatcccaaccggaaacgaagaagcaataatttcttttttggttctt

SEQ ID NO: 1467 - DNA, 428 bp, Homo sapiens
atttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtc

SEQ ID NO: 1468 - DNA, 433 bp, Homo sapiens
gtgctgtaatggtggatcaacaggaaagcctcccctcaatgtctccaatgtcccttccatttaacaggctacaattccaaggattttaaatcatggaggtagtagtgggtccttaaccttatgaaccaaagctcctatactagaacaggtgggatctatttcagcttgtgagagaagttcaagaaaaactgaagaagtgcttcatcaaacaccaaataataaggttataaatccccaatccatcattctactgttgtttcttgatctttatttttccacggccccgctaaggaacatctgtataagtttctctcctaattgcctccccatggaattttaatactacagctgtacacagatataccacactgtacatctgttcaggaactgggatcttcgggaggccacaaatcactgtaatgcctaagttttt

SEQ ID NO: 1469 - DNA, 376 bp, Homo sapiens
tggagcaggccctgtgaaggaccaagaacaaagtaatagccacagttatgaaatttcattttattctgataaagactaatatatgcttgataacctagtgataatccataagtttggtatttcacaacattttttagaaagcacataagattaacattcaaataaggcattatagaaagttttataaagaatgaagtgtttcctataattcttttaaaaaaccttggttcatcttgaaagatcgatgaattttttaaatatcagaagaaaagggaaataaaattttccccccaaaacacataagaactacttactggcacttgtattttaagtacctgggaaaaaaacgggacaaaattttaaaggcaattacgaa

SEQ ID NO: 1470 - DNA, 456 bp, Homo sapiens
gcaacatacagaagatatgttcactcagataagactgccctaaacaaccatttcgtcactcagttatttaactgtgtttagctcatttaaatcaagatgtgtactttaatctaaaatgttctaataatctgtatttcttataattttaacactatgagctgcctatataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctcttgctgacccagaattcggattctagtagtagta

SEQ ID NO: 1471 - DNA, 229 bp, Homo sapiens
ctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaacaatgaagttatttt

SEQ ID NO: 1472 - DNA, 174 bp, Homo sapiens
ggcatggcaacaaattccaagttagggtctccaatgagcttcctagcaagccagaggaagggcttttcgaagttgtagttacttttggcagaaatgtcgtagtactgaggattcttctttcggtggaagacaatggatttcgccttcactttcctgtccttaatatccactttg

SEQ ID NO: 1473 - DNA, 651 bp, Homo sapiens
tggcgtcactctggccacacagcgggctgtcttcatacggtggtcttctccaaatccttgcacctaaaaccattttgtcccctttctttcttccttccgtcagccctgtcatcaggcaggtttcttaccttgtatcacaggatatcttttcctgtgctgtatgctttgtttcttcaaatggcaagtgagtttcttcttggaccagggcatgttacataggtccacagtgctttctctggaatggttggggctgtatgtgtttcagagttcagaatttttcagattttaggaagatagtacaatgtataagaggtgtattatgtaatccccaggtggggtctaggactgcaccctgtaatcaggcacattcacacagctctccagtgaaatgtgagtattcacagtaagggggaggagttaagattataaagagccatgactcagtttaggtcagattttgccgctcattgaattttgacatcgagcttaaggaaaacccagttttcataatgttgtggatttcagcattctggataaggaattacgaatgtatactgcatttcacattctgtaaccccaggctgtttcttagacttagcggttagccggtgggaagagctttgtgaacgtgagacatgaactgtaactttt

SEQ ID NO: 1474 - DNA, 369 bp, Homo sapiens
tattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaacatttgaattgccttgcttttaacacttaatttgaaatctattgggttaatttctccctatgtttatttttgtacatttgagccatgtcacacaaactgatgatgacaggtcagcagtattctatttggttagaagggttgcatggtgtaaatattagtgcagttaagctaaagcagtgtttgctccacctacctagccaatatgaagg

SEQ ID NO: 1475 - DNA, 318 bp, Homo sapiens
ttacatgtttgacattctcaaccatctctagcacatccataacttcttcaggctgactatcctgctgcttctcactttcccttacctcagtttcctcctccatcttaacctccatttcctgtttttgttcttcctcctcctgttctttctctgcatcactatgaacaatcgctatttccttttcctcttcctctcctgcttcctctatttctacatcattgtgctgattacctgtctcctccaactcttcctctcgctgagccaccttaccctcttcttgttccgccttctgttctccattacgcaccacctgacgct

SEQ ID NO: 1476 - DNA, 248 bp, Homo sapiens
aaaatagtgtaagtaaacaaattttgcaatttactaactttaaaacttttttcattaaatgacatctcaacaactttattgagaggtgaatctcttaatatgtgaatgatatttggagcatacaattaattcagtggtttttggtgtatttccacacacaatcaatttaaaacacttttatcaacccaaaaagaaacttcacacccaccaccagtcattccccatttcctctcctagcccaaggcaac

SEQ ID NO: 1477 - DNA, 290 bp, Homo sapiens
caagtcctaggaaagattgtcttctgaaaatttgatgtcttctgggttgatggagatgggaagggttctaggccagaatgttcacatttggaggactctttcaaattataactgttgttacatgttcgcagtttattcaagactgctgtatacatagtagacaaattaactccttacttgaaacatctagtctatctagatgtttagaagtgcccgatgtatgttagatgtataggtagtaaaataccactttgtaaatatctttttgctaaaattcataggaaatgctt

SEQ ID NO: 1478 - DNA, 457 bp, Homo sapiens
caacaaatgttttacagagtcttcatttgaggattccagaaatttcaaatattacaaccactcctcacacgctccctgcagccgggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgtt

SEQ ID NO: 1479 - DNA, 234 bp, Homo sapiens
ggctgcagggagcgtgtgaggagtggttgtaatatttgaaatttctggaatcctcaaatgaagactctgtaaaacatatgttgtctgcatttggaaatacactgtccagtaaggtatcaaagccaagaaaacagggaccatcttgaccagagctttcacatcttccactttctcttctgtaaatggcccaccatgagacatcttacatgaatcaaacagactttgtttagaaga

SEQ ID NO: 1480 - DNA, 305 bp, Homo sapiens
cacaactcactccttctaaagaaaaaattgaaatgtaaggctgtgtaagatttgtttttaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatctccagttgtctctgatgcagcttatacgaaataattgttgttctgt

SEQ ID NO: 1481 - DNA, 226 bp, Homo sapiens
caatttccttctagccttgctctgatatttgatagcttttttcgtttcttctttagcgtgttctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatttcattgagagct

SEQ ID NO: 1482 - DNA, 346 bp, Homo sapiens
atgctttgaagactgatacactcaaccatctatattcatgagctctcaatttcatggcaggccatagttctacttatctgagaagcaaatccctgtggagactataccactattttttctgagattaatgtactcttggggcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcgcttcccaacatagggacg

SEQ ID NO: 1483 - DNA, 524 bp, Homo sapiens
aagtaactacaactttgaaaagcccttcctctggcttgctaggaagctcattggagaccctaacttggaatttgttgccatgcctgctctcgccccaccagaagttgtcatggacccagctttggcagcacagtatgagcacgacttataggttgctcagacaactgctctcccggatgaggatgatgacccgtgagaatgaagctggagcccagcgtcagaagtctagttgtataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctcttggaacgcagttgattccttgagttcatatataagactgctgcagtcacatcacaatattcagtggtgaaatcttgtttgttacttgctgaccacgaattccgattctagtagtacta

SEQ ID NO: 1484 - DNA, 355 bp, Homo sapiens
ccttcatattggctaggtaggtggagcaaacactgctttagcttaactgcactaatatttacaccatgtaacccttctaaccaaatagaatactgctgacctgtcatcatcagtttgtgtgacatggcccaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagat

SEQ ID NO: 1485 - DNA, 401 bp, Homo sapiens
cgctggctgagtgcgccgagtgggccgcgggggccgcgggccggggcgctgcctgcttgctgggtgacaccgactgggacctggccttggacttggtccgcgaccgggaccgcctcttcttcttcttctcgtggggacttctggagcgggtccgcttcctgctggccccagggctgcggctcacgcggtaggcagtgggcacactcctctcttccctccgtctctcaggggagtgggctctcctccgaggggaccgggagcgggacctcgaccgccgcactgtccgataggcactgggaagagaatgctttgcttttgagtgtgatctagacctggacttgaatgacgaatggtacttgggagaacgtgatcctgttcgagatctttttttgtgctttttc

SEQ ID NO: 1486 - DNA, 568 bp, Homo sapiens
tctgagtccactaccttcaagggcttcatcagctcttcaaggcggttacacttcttggaggcaaagagagagggatgaaggtaattcccatcttcttcatcatcatcatcttcattgtcagagctgactcctgattttttttttctcgtcacttttgttttctgccaggacagtgtagcgtccctctttcatggctttctggatgaacttatagtaggggttgaggtagtggtcgaagcgcacaaagtcaaactgggagttccgggcctgcttggccttcagcatgatctcaaactgtgctccctgcctgcacacgaagctggccgtgcgctcgatgatggcgtgcattctagcggttggtggcaactccacgtcagacgggacgctcaatcctaagggggcaacgaagggctcttcattttcctctaaattttcggcctcatttttttctctctgtttggaaggctcctcctcctccgtcggctctgacgggtcgtaatagtcgctaccgtaagtgaaccccacggcattgtagctcccatcctctgctagtgcttcactcaatcgc

SEQ ID NO: 1487 - DNA, 417 bp, Homo sapiens
gatttctttcagctggattaagcctccaactccagggcgagcccaaccttgtggcctccagcattaatgctcttcccatctaccagagcagagagtataagcttcacaccaggcctcagagtctgagtatagcctactccaattaagctagagttgttgactttcgcagaaatggaagcagtgggatccaactgatatttagctgcaatgccagaacgagtgcagttggtacctgatgtccaagcagggtttactgaagtgtcaagatcttcacaaactttctgataaattgatcctccaaattctgtcccatcattgacattagtgtgtagctggaagtccccagtcctgtagcccactgctgtccaagcaaggtttactgaagtgtcaagatctttgctgaccaggagttcggat

SEQ ID NO: 1488 - DNA, 529 bp, Homo sapiens
tcggagcgggcgcctactactactagaatccgaattactggacagcaaaagcaatatattttgcatcaattattctgtcaataaaggacttgtgaattctctcccacaccacgttagacaggtaagtgacgtcacttccaaatttcaactgttacatagaagatccagaatgtgaacaccacttgcaatctgcacaaggttacaaacaacacatacaccttcaattcaaaatacctgaatgaaaggtttcatcccaattatggggaaaaaacttcccatctcacaggctggttagaaactggctctgaatacagcgtaacatacacagcaattcagatcttaagaaactcaactgttgccagttaatacagtaagtaaaactttattcagcttcccccttatttaatttttccatatatttaggtgatcctttctataccttttaaggtaagcaatcatctcaggattatcagacatctaaggaaaactttgccaaactggactatggtaatcgtatgagaaaaaaata

SEQ ID NO: 1489 - DNA, 248 bp, Homo sapiens
aaaatagtgtaagtaaacaaattttgcaatttactaactttaaaacttttttcattaaataacatctcaacaactttattgagaggtgaatctcttaataagtgaatgatatttggagcatacaattaattcagtggtttttggtgtatttccacacacaatcaatttaaaacacttttatcaacccaaaaagaaacttcacacccaccaccagtcattccccatttcctctcctagcccaaggcaac

SEQ ID NO: 1490 - DNA, 604 bp, Homo sapiens
  misc_feature (1)...(604): n = A,T,C or G
atggtgaaggcattggagtctttcagcaatcttctaaccaaagtctgtttgattcatgtaagatgtctcatggtgggccatttacagaagagaaagaggaagatgtgaaagctctggtcaagattgtccctgttttcttggctttgataccttactggacagtgtatttccaaatgcagacaacatatgttttacagagttttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggatttgcatactcagctgccncc

SEQ ID NO: 1491 - DNA, 335 bp, Homo sapiens
gaataatgctgcttattagatgacatttgaattatgacatttattcatttacttttgtcttctgtggcacaaactatgaaaaatagtaattaacaattaggtttccaaaacctgtgtacatgtttcttcgaagtcattacacatttaactcaaaaggaaagcattaacttccaaacatggaaagtgttcaggcatctgactctcattacgtggactttattgatcctcatttaatacatgctacattcagctcaacccccttttacatgaggcggagctaaactcttagggaaaccagtgtgccgagacattgtttaccgatttcctttctgcag

SEQ ID NO: 1492 - DNA, 380 bp, Homo sapiens
caagatttcaccactgaatattgtgatgtgactgcagcagtcttatatatgaaactcaaggaatcaactgtgttccaaaacagctaaatatgcaggtccaaacaatgaagttattttttaaactgccacattcactccgaagcccactcatctccttcagcatcccacagatgaagcacgtgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgtgctgccaaagctgggtccatgaca

SEQ ID NO: 1493 - DNA, 363 bp, Homo sapiens
tgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggccatcatcctcatccgggagagcagttgtctgagcaacctctaagtcg

SEQ ID NO: 1494 - DNA, 520 bp, Homo sapiens
  misc_feature (1)...(520): n = A,T,C or G
attagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaagaaagagaaacccgtggcactatgtaaataaagtaagcatactttgttgttagtaaatagatgaggcatgcctgggaaatgctcccttggcataaatagcaatcaatcataattagtaaacaggtgtaccaataaaaagaatttacatgataggttaacaaggaccagganagtgggtttcctggaggagttctttgttcctgatcaaagaaattgatacctgttagca

SEQ ID NO: 1495 - DNA, 451 bp, Homo sapiens
aggaaagacaggacccggggcccgcctcacaccccagtggatttggagttgcttaaaatagactccggccttcaccaatagtctctctgcaaggatgccgcccagcactgtggccttcctgggggtgggccctggggatggctcatttgttaacccaggggaggctcttgaatttgcgaagcagttatctgtcctcttatttgtaaatgggtagcaaagccaactcaaatacacagatgtatatttacggagggctctaaacaaaagttttcttctgagggctgaatcaactactttaccacaaattagttacacaagaggctacttcactggaggagcttcccttcgctggaaaaccaaaacaaaacaaaaccctttaagtacatttttcctttcagtgtatcacagcatcctgaatttcagggtaaacacttttttatgtatttctctt

SEQ ID NO: 1496 - DNA, 264 bp, Homo sapiens
agtgtaccaataaaaagaatttacatgataggttaacaaggaccaggaaagtgagtttcctgaaggagttctttgttcctgatcaaagaaattgatacctgtttaccaattatgattgattgctatttatgccaagggagcatttcccaggcatgcctcatctatttactaacaacagagtatgcttactttatttacatagtgccacgggtttctcttttttcttctcttttttattggcgggggagatggtactataacttg

SEQ ID NO: 1497 - DNA, 231 bp, Homo sapiens
ctgctcccccggatgagggtgatgacctgtgagaatgaagctggagcccagcgtcagaagtctagttttataggcagctgtcctgtgatgtcagcggtgcagcgtgtgtgccacctcattattatctagttaagcggaacatgtgcttcacctgtgggatgctgaaggagatgagtgggcttcggagtgaatgtggcagtttaaaaagtaacttcattgtttggacctgca

SEQ ID NO: 1498 - DNA, 224 bp, Homo sapiens
ggtttacaggaagaaatatgttatctacattgaacgggtgcagcgggaaaaggcaaatggcacaactgtccacgtaggcattcatcccagcaaggtggttatcactaggctaaaactggactactttgccaatttgctgacctttatagtgtccacgtacaacctgaacttcatcatcctttcggatgggcatggatcgcacgttgtacttctgtctcagctct

SEQ ID NO: 1499 - DNA, 368 bp, Homo sapiens
aagtaactacaactttgaagagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttct

SEQ ID NO: 1500 - DNA, 537 bp, Homo sapiens
catttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatggggacgatgacctgcgagaatgaagctggagcccagcgtcagaagtctagtttaataggcagctgtcctgtgatgtcagcgttgcaccgggggtgccacctcattattatctacctaaccggaccatgtgcttaatctgtggaatgctgaaggaaataattgggcttcgaagtgaatgtgcagtttaaaaaataacttcattgtttggacctgcatatttagctgttttggaacgcagttgattccttgagtttcatatataagactgctgcagtcacatcacaatattcagtggtgaaatcttgtttgttactggctggccagcaattaagattctagctattag

SEQ ID NO: 1501 - DNA, 385 bp, Homo sapiens
cccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgttttctgaccaagaattcggattc

SEQ ID NO: 1502 - DNA, 461 bp, Homo sapiens
acccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaagggtattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaagaccaaagcacccaagattcagcgtcttggtactccacgtgtcctggagcacaaacggcggcgtattgctctgaagaaagcgcttaccaagaaaaataaagaagaggcttgcaaatatgcttaactttttggcaagagaatgaaggaggcttagga

SEQ ID NO: 1503 - DNA, 369 bp, Homo sapiens
ccttcatattggcaaggtaggtggagcaaacactgctttagcttaactgcactaatatttacaccatgtaaccctcctaaccaaatagaatactgctgacctgtcatcatcagtttgtgtgacatggttcaaatgtacaaaaataaacatagggagaaattaacccaattgacttcagattaagtgataaaagcaaggcaattcaaatattaacatggcataaaacttccctactttagtggtttccgaatgctatttataaacaagggatgagttcacttgcttagatatctgaaatacaactttattccgattctaaacgaaaaggaatgggaatgacagtaacaaacaagatttcaccactgaata

SEQ ID NO: 1504 - DNA, 355 bp, Homo sapiens
ccttcacattggccaggtaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaactaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagat

SEQ ID NO: 1505 - DNA, 313 bp, Homo sapiens
gagacctttgccacggtgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacagggagctgtcaggtgggaatgcagtttcctgttctcagcaggaagcagccatcggtgctcatgagaagtctccaggtgctcaaatgttggcagccaattttaaaaaaataaatcaggc

SEQ ID NO: 1506 - DNA, 314 bp, Homo sapiens
agggttttcaggagttggagattatagaatattaggaagaaatgttggtatcctccattatagatggatggcataggtcacaaatgggagactggcagctaagccaatatcaaaacccagtggaatgacacttctatggagctgacttttcttcctgctatcttccctatcccacggaaatgtctgtcaccatgtaaagcccagtagcaggcagcttaggctccagtcttcccccttgggtaggaaaaggagtgaagggaatgtcactcctgagtttccatgctttcttcttcctctccttgaggtggttcttc

SEQ ID NO: 1507 - DNA, 384 bp, Homo sapiens
tgtcacggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatatgcttcatctgtgggatgctgaaggagatgagtgggcttcggagtgaatgtggcagtttaaaaaataacttcattgtttggacctgcatatttagctgttttggaacgcagttgattccttgagtttcatatataagactgttgcagtcacatcacaatattcagtggtgaaatcttgtttg

SEQ ID NO: 1508 - DNA, 463 bp, Homo sapiens
tctgcaatggtgacttccacctcaactcctggctcaatactgatggaagtgatctgcttaacaatctcagaaggactgtgcaagtcaatgagtcgcttgtgaattctcatctggaaacgatcccacgtcttagaaccttcaccacaaggagtttttcttgtagtgattctcaaagtcttggtaggcattcgaactggtcctttcactttgagattcttttcttttgcgcctcttatcaagtcagcacacaccttttccaaggattttacgttgcggcttgttagggtgattcgaactcggtgaattgccacctccggctccacgggtgtttttccggtatccttaaaagccatggctgttgcgcgcgggcttcctgaccgacttgttcctcggcgagagcgaacagcggtgagtcaggagcaggagcgtgcggaccaaaaatcctcagcccttacgaccgcgt

SEQ ID NO: 1509 - DNA, 309 bp, Homo sapiens
tcctttagattccaatttttaaatggctgctcagacgacaccaatagagttctttctccttaaaatatggtggcagtgaatactaacaggtatcaatttctttgatcaggaacaaagaactccttcaggaaactcactttcctgggccttgttaacctatcatgtaaattctttttattggtacacctgtttactaattataattgattgctatttatgccaagggagcatttcccaggcatgcctcatctatttactaacaacaaagtatgcttactttatttacatagtgccacgggtttctctttt

SEQ ID NO: 1510 - DNA, 475 bp, Homo sapiens
cagaaataatgaggaaaagcaggagggtagctccttgaatagcagccagaagaaaaaagtaatagttcaaatagcagccgttaatattaccaaagtctgtgtgactgctcatccatccgatggctttgatagacaccagtgccagcagtccagaacccacgaacgacccgacgccagagaagaaaaagaacaagcccattatggcactctgcatggacttgggggcagctgagtatgcaaattccaggcgatacttgcaaagatctcgctgatcccaatcagcaagtactgcggcacctgccaccacagcgacagatcggcagcatggtagacgacgttgccgatggtctgattaatggttttctctttaacaaggttcagccttttactctccaaaattcctgcaacaaaggctgagcacatgacaaagaacatgcccacggcgatcctcttcagggaggatgggagcaggcca

SEQ ID NO: 1511 - DNA, 391 bp, Homo sapiens
gtaacaaacaagatttcaccactgaatattgtgatgtgactgcagcagtcttatatatgaaactcaaggaatcaactgcgttccgaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgtgctgccaaagctgggtccataacaact

SEQ ID NO: 1512 - DNA, 430 bp, Homo sapiens
cgccgactactagaattcgaatacacggcctgcacaacccaatgactggacagtgtaatctcctctgcaaggtaagccagaagacagccctgtccctccctgcctctgccttgcccaaggccacggagggcgtctgcagagaggcctgccttccggattccaggcgggcatgccctgcaaaccccgcctgggcctcccttggactgcccagacctcggttagccctgcctgaatcagtagatacttgaacgagtccccagtctgcgggaggcagaggtggggccgtggacccatgcggggggttgcagggtcacacgccacataacagacaaaaatacacacacgtgtgttattctttgcaatacttgaaatattgccactgggcttggacctagaagaagaaaatccccgtgacttcttcctcatcacc

SEQ ID NO: 1513 - DNA, 229 bp, Homo sapiens
aaaataacttcattgtttaaactgccacattcactccgaagcccactcatctccttcagcatcccacagatgaagcacatgttccgcttagctagataataatgaggtggcacacacgctacaccgctgacatcacaggacagctgcctataaaactagacttctgacgctgggctccagcttcattctcacagggcatcatcctcatccgggagagcagctgtctgag

SEQ ID NO: 1514 - DNA, 355 bp, Homo sapiens
cccagtgttgggcaacaaatgatctttgaggaacatggttttgggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcc

SEQ ID NO: 1515 - DNA, 566 bp, Homo sapiens
  misc_feature (1)...(566): n = A,T,C or G
gtttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgaatatgttaaccatatatgctgtatttattttgtcgttaagcatactttcagtttactcagaattttcaatttgctataaagacgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttacgatctacttgctggttnttccttttgatccaaatgtgtgatctgccctgataaataacaagttatagtaccatcttccccgccaataaaaaagagaagaaaaaagagaaacccg

SEQ ID NO: 1516 - DNA, 596 bp, Homo sapiens
ggcaaagtagaagcaatatattttgcaacaattattccttcaataaaggacttgtaaattctcttccacaccacgttagaaaggtaagtgacgtcacttccaaatttcaactgttacatagaagatccagaatgtcaacaccacttgcaatttccacaaggttacaaacaacacatacaccttcaattcaaaatacctgaatgaaaggtttcatcccaattatggggaaaaaacttcccatctcacaggctggttagaagctggttctgaatacagcgtaacatacacagcaattcagatcttaagaaactcaactgttgccagttaatacagtaagtagaactttattcagctccacccttatttcatttttccatatatttaagtgatcctttctataccttttaaggtaagcaatcatctcaagattatcagacatctaaagaaaactttggtaaactggactatagtaatcgtatgagaaaaagatagctcaagattcctatctgctacaagaatagtgttgatgggatcaaactcctaattatcctaatagacctaattcatttttaaatgtggaaaatatgcaagataaa

SEQ ID NO: 1517 - DNA, 462 bp, Homo sapiens
acgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccaggtgagaattcacaagcgactcattgacttgcacagtccttctgagattgttaagcagattacttccatcagtattgagccaggagttgaggtggaagtcaccattgcag

SEQ ID NO: 1518 - DNA, 355 bp, Homo sapiens
ccttcatattggctaggtaggtggagcaaacactgctttagcttaactgcactaatatttacaccatgtaacccttctaaccaaatagaatactgctgacctgtcatcaccagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaaccttattctgattctaaacgaaaaggaatgggaatgacagtaacaaacaagat

SEQ ID NO: 1519 - DNA, 497 bp, Homo sapiens
agcattttggacaacacattcttggcaatagaacctggacaacatttatcaaacacggtagggaaagttctcactctgcattataaaaaggacagccagatatcaactgttacagaaatgaaataagacggaaaatttttaacaaattgtttaaactattttcttaaagagactgcctccactgccagagatcttgaatagcctcttggtcagtcatccggaagcaattcttcacataattgatgaatttggcttccactttgggaagagaaccacctttttctatacttgcttgcatttttgctttaatgtcttctacagaactaggtccttttggtgttttaggagttttttcctgtttcttgaaggattcttgtccttttgatcttggtgttgatgatggttttgagtcttttccattctgatttgacttttgtgcatttttggctggagtatctcgtatagatttcttcactggcgctttttcttcagcttcc

SEQ ID NO: 1520 - DNA, 214 bp, Homo sapiens
cagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgtt

SEQ ID NO: 1521 - DNA, 368 bp, Homo sapiens
actgaatattgtgatgtgactgcagcagtcttatatatgaaactcaaggaatcaactgcgttccaaaacaactaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgtgctgccaaagctgggtccatgaca

SEQ ID NO: 1522 - DNA, 293 bp, Homo sapiens
acccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataagctttcaggatcggctgcacacg

SEQ ID NO: 1523 - DNA, 488 bp, Homo sapiens
agaatagtgttgatgggatcaaactcctaattatcctaatagacctaattcatttttaaatgtggaaaatatgcaagataaattaaatgcttagttaaaaaaaaaaaagtttcaccaaccgttctccattactgagaagcccccacactgccccactgtgcatattcctagtatttcatccatgtcctgctctgctgtgctgccctacaaaaaaaccctcccgggggggaaaaaaaacaaaaaaaaaggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggttctacattaaaacatgattactt

SEQ ID NO: 1524 - DNA, 199 bp, Homo sapiens
gagtggggcagtgtgggggcttctcagtaatggagaacagttggtgaaacttttttttttttaactaagcatttaatttatcttgcatattttccacatttaaaaatgaattaggtctattaggataattaggagtttgatcccatcaacactattcttgtagcagttaggaatcttgagctatttttttctcatacga

SEQ ID NO: 1525 - DNA, 383 bp, Homo sapiens
agcattctcttcccagtgcccatcggtggatctttgcttttgctcgaaggcctatcgggtggtttaacttctaaagtaggcagaggcctgcctccagtcagtagagggcagggcgtagtgctggattcctcgacactgaaaggactctcctcaattttcccagcttctgcttccggcagaggatttttgagggtctgtaaaaataacgccgctttccttttacgttctgcttgaagctgtttctcttttgactccttagacgcctgggcgagcttttcccgggcagcagccgcgaggcgatcttccagcttttgctttgcttgctttgcttctagctcctcctgggtaagttgaggcttcttctcctcaacaactacacaggg

SEQ ID NO: 1526 - DNA, 431 bp, Homo sapiens
actgttctccattactgagaagcccccacactgctgtgctgtgctgtgctgctctgctgtgctgccctacaaaaaaaccctcccgggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggctctacattaaaacatgattacttttgccataaaagaaaatattacccttaaaatatctatttgatatgtacaaaccacatttttattctgacaggtcacagatt

SEQ ID NO: 1527 - DNA, 406 bp, Homo sapiens
gaaactcattgaagtggacgatgaacgcaaacttcgtactttctatgagaagcgtatggacacgtggagtaacaagacgctgaatcttgggtgctttggtcctaggtttcttaccttctttatttaagggctttcttacaacatactggcggacatcatcttctttagagagattgaaaagtttgcggattctgctagctcttttggggcccaggcggcgaggcactgtagtatcagttagtccaggaatatccttctctcctttttttacaataaccaagttgagaacgctcagatttgcatccacaatgcaaccacgaactgattttctctttctttctccagttctccttggtctgtaacaggaacgccccttactcagtagcaggcggacacggccatgggt

SEQ ID NO: 1528 - DNA, 643 bp, Homo sapiens
ccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataactaaacctttttattgctcatttttttagtagaagaatatcacttatttttagacttgtaaaatatatgaactggtgagcggacatctgttaagagagtcactagtcagaatgttaaaggagtgcatgcaggatgccccaaatgtcgtgaactcttgttactcctgtatgtagtagtgtgagcatgtgacttttaacaccatttggtttgaaactaatgtagagatgcctgattccaaacaggtgtggagaatattgaacggctcaaaagccgcgtccc

SEQ ID NO: 1529 - DNA, 555 bp, Homo sapiens
cagcaattgtctcagcttgggaccgaagtatttacaaagcaagcgaacaagagacgaagcaagagggacacttctgaggccggtggtgcggaaactcaccgccaaacagggtggggggccagtcacctcttcaggagtgtcccatgtgtcagctgacataacatcttaaatacagaattccaattgaaggaaaaacaaacaacaacaaaagaaacaccagtcaagcataagtgatgttacttcctctctgaacagggaaacatctcgctcgctgggagataaaaggtaaatctctcatttgctgctctcttcccctaagtgccagcaagaagctgggtgtggtgatgaagaaagaaggcagccatcacctaagaccccacaagccaagccgtggtcccctccgtgagggcacggtcctttcatgaagccgtaaaagagaccacagctcggacctgagcactcaaggttacctactggggtcttgtcatattccttatgttgatttctgccaagacccaaactgattccttttttttttttttgagacagaagtta

SEQ ID NO: 1530 - DNA, 663 bp, Homo sapiens
cagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacggtcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcaggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagctgggggcgtcactgcaaggcaccggcagaaactggggtctgaaaacagcagcccagaatggatttggaacagaacagggtggtacagaaaggaagtt

SEQ ID NO: 1531 - DNA, 596 bp, Homo sapiens
ggcaaagtagaagcaatatattttgcaacaattattctttcaataaagggcttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatccaaagaaaactttggtaaactggactatagtaatcgtatgagaaaaaaatagctcaagattcctaactgctacaagaatagtgttgatgggatcaaactcctaattatcctgatagacctaattcatttttaaatgtgaaaaatatgcaagataaa

SEQ ID NO: 1532 - DNA, 142 bp, Homo sapiens
aagaaccaaaaaagaaaccctggggatctggagaaggatctgaggccattaaactgcaaatcccaaccgaaaacgaagaagcaaaagtttcgctgaccaggaattggatttgctgaccagaattcggattctagtagtagta

SEQ ID NO: 1533 - DNA, 335 bp, Homo sapiens
gaatccgaattccggtcagcaagaaatagtgtaattaaaaataattgaaagtgttaaatgtgaacttgagctgtttgaccagtcacatttttgttcaaaagaatgttttccttacatacaaccatgatcagtctttagtctcaatcgtaccaaaataaagctatatataagcactctgactaggtaaggtgtgaagtaccccgtgagttgctctgtggcttgagatgggacacatggactcaaatgactcttatgcatgccttgccttaagaaagaaaagtaatgttgatggtttaaaaagtaagtactttttgaagcagcagatgaagtgtgtt

SEQ ID NO: 1534 - DNA, 313 bp, Homo sapiens
gaaatagtgtaattaaaaataattaaaagtgttaaatgtgaacttgagctgtttgaccagtcacatttttgttcaaaagaatgttttccttacatacaaccatgatcagtctttagtctcaatcgtaccaaaataaagctatatataagcactctgactaggtaaggtgtgaggtaccccgtgagttgctctgtggcttgagatgggacacatggtctcaaatgactcttatgcatgccttgccttaagaaagaaaagtaatgttgatggtttaaaaagtaagtactttttgaagcagcagatgaaatgtgtt

SEQ ID NO: 1535 - DNA, 566 bp, Homo sapiens
gtgattgggtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaattcccagtttgactttctgcgcttcgaccactacctcaacccctactataagttcatccagaaagccatgaaagagggacgctacactgtcctggcagaaaacaaaagtgacgagaaaagaaaatcaggggtcaactctgacaatgaagatgatgatgatgaagatgatgggaattaccttcatccctctctctttgcctccaagaagtgtaaccgccttgaagagctgatgaagcccttgaagtagtggacccaga

SEQ ID NO: 1536 - DNA, 285 bp, Homo sapiens
gaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgcgtgccacctcattattatctagctaagcggaacatgtgcttcatctgtgggatgctgaaggagatgagtgggcttcggagtgaatgtggcagtttaaaaaataacttcattgtt

SEQ ID NO: 1537 - DNA, 387 bp, Homo sapiens
agttgtcatggacccagctttggcagcacagtacgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaagataacttcattgtttggacctgcatatttagctgttttggtacgcagttgattccttgagtttcatatataagactgctgcagtcacatcacaatattcagtggtgaaatcttgtttg

SEQ ID NO: 1538 - DNA, 146 bp, Homo sapiens
gcactgtagtatcagtcagtccaggaatatccttctctcctttttttacaataaccaagttgagaacgctcagatttgcatccacaatgcaaccacgaactgattttctttttctttctccagttctccttggtctgtaacaggaa

SEQ ID NO: 1539 - DNA, 393 bp, Homo sapiens
tgacagtaacaaacaagatttcaccactgaatattgtgatgtgactgcagcagtcttatatatgaaactcaaggaatcaactgcgttccaaaacagctaaatatgcaggtccaaacaatgaagttactttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgtgctgccaaagctgggtccatgaca

SEQ ID NO: 1540 - DNA, 314 bp, Homo sapiens
  misc_feature (1)...(314): n = A,T,C or G
naacacatttcatctgctgcttcanaaagtacttactttttanaccatcaacattacttttcttccttaaggcgaggcatgcataagagtcatttgagaccatgtgtcccatctcaagccacagagcaactcacggngtacttcacaccttacctagtcagagtgcttatatatagctntattttggtacgattgagactaaagactgatcatggttgtatgtaaggaaaacattcttttgaacaaaaatgtgactggccaaacagctcaagttcacatttaacactttcaattatttttaattacactatttc

SEQ ID NO: 1541 - DNA, 434 bp, Homo sapiens
agtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcagttcagatcttaagaaactcaactgttgccagttaatacagtaagtagaactttattcagctccacccttatttcatttttccatatatttaagtgatcctttttataccttttaaggtaagcaatcatctcaagattatcagacatctaaagaaaactttggtaaactggactatagtaatcgtatgagaaaaaaatagctcaagattcctaactgctacaag

SEQ ID NO: 1542 - DNA, 436 bp, Homo sapiens
actgctgaagaacttaaaagttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctctagctaaactgcactaatatttacaccatgtaacccttctaaccaaatagaatactgctgacc

SEQ ID NO: 1543 - DNA, 428 bp, Homo sapiens
agagacagtttcacaagactgtaatcaggatatggaagagatgatgtctgagcaggaaaatccagattccagtgaaccagtagtagaagatgaaagattgcaccatgatacagatgatgtaacataccaagtctatggggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgcttcaaaacatctttagtgttccttcccaaagatcttgatctgctcagtaattgcttcacaagatctatcacagccatctt

SEQ ID NO: 1544 - DNA, 297 bp, Homo sapiens
tgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacatggagctgtcaggtgggatgcagtttcctgttctcagcaagaagcagccatcggtgctcatgagaagtctccaggtgctcaaatgttggcagccaattttaaaaaaataaatcaagcc

SEQ ID NO: 1545 - DNA, 464 bp, Homo sapiens
cccatctacctgtctgtccatccatccacccatgcatccacccatctacccgtccatccatccacccatgcatccatcatccacccatctgtccatccaaccacccatgcatctgtccatccacccacccacccgtctgtccatccatccacctgtctgtccatctatccacccatgcacccattcatctacctgtttgtccatccatccacccatgcctccatccatccacccatctgaatcacaatagaagaaggtggagcagcgtactggagtgttccgcactgggcgggcagtaccctgctccctgacactgtgctgactcagggaacacttggtctctcccaagcattgcctgagtccctgtttactgtgtctgcctgtgctaggtaggcaaggataaaagacagccccgcccactggatgcttacagtctactgaagagagacacagaaacaagcaac

SEQ ID NO: 1546 - DNA, 563 bp, Homo sapiens
cacaaaccctggggcagcaggcaggctcgggctgtggttgtgttctggggtgtgagaagggatgaggtactgctgcctctgggaagctcccagcttgttccagcctcctgcctgcccctctgtggctgacagtcgactcccctggagtcactgccctgagtctcaagggtacttctctgcaagctccaggtatgctgccttaccctgacctatagacagtacctctccccgggtttctagagcagtaaccattttcctcctctacttattacattcctttgattatcccagtgagagtatgcgggtggccgggaagggtgagagctggatcacttgtgctcaggtaacctactcgaatgagaggcccaaagacacatatagtgaattgcctagttagcggttcatccacatggatttggttttgctgaatgatcaccattctcatacaacaaggcatctttatgcaaaggacggtcctcttatcaccccagcccactttctcaatcttttgtctccactctgcctttccttctgacccaagagctgtcgccttgccccactgc

SEQ ID NO: 1547 - DNA, 312 bp, Homo sapiens
catttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcg

SEQ ID NO: 1548 - DNA, 383 bp, Homo sapiens
ggtcactttgtccagcgcactgtgaggcccccactcaggccagccctggcccccccttggtacttggaaccgaagttacagattatattaaaataataatgtacaaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcctatttatggagaaaaaccggtcactttgtccagcgcactgtgaggcccccactcaggccagccctggcccccccttggtacttg

SEQ ID NO: 1549 - DNA, 285 bp, Homo sapiens
ggagaaaggaagtgacccagttccggggtcaacctgagcaggggctgcctcgggaaaattgccatctgcaaagaaagagatgggagagccctggggagcgtcccagacagcaggagcagccagggaaagggagctctcccacagctgctggaggtgtgcaaggagggtgtgctagaggtgtgcaaggagggttgctggagggtgcaaggagggcgtgctggaggggtgcaaggagggtgtgctggaggggtacaaggagggttgctggagggtgcaaggagggtg

SEQ ID NO: 1550 - DNA, 317 bp, Homo sapiens
cacacaccacacacagggacaccacacacacagacacaccacacacacagacacacagggacaccacacacacagacgcacacacagacaccacacacacagagacaccacatacacacacagaggcaccaaatgcacagagacacccacacacagacaccacacacacagagacacatacagacaccacgcacacacagatgccacacacacacaccacacacacagacatacacacacacagacacacagagacaccacacacacagacacacatacacagagacacatatagacaccacacacacacagacaca

SEQ ID NO: 1551 - DNA, 303 bp, Homo sapiens
ttgctggatcaggtgggagctctatttccacatttttgaggaacctccctgccgtctcccatggtggctgtgccaacgacgttcccagggacagagtgtaacgggcccctttcctccatgtcctcgccaacactcgctatcttttgcgttttgatgacagtcatcccaataggtgccagttggtacctcctgtggtttttatttgattttcctgatgattagtgatgctggacattatttcgtctacacatcggccacttacatgttttcctttgagacatgcagagtcaggtcctttgcata

SEQ ID NO: 1552 - DNA, 377 bp, Homo sapiens
cagcactatcaagagaacattcaaccaggggcagcagttgaggcgcccaggacctgcttggacacacgcacatgcggccgcgacggaagcaagaggaccaggacaccgggcaagatccccgcagtgccagcttcccaggactcaggattccagtcggccatgaagcaataaatacaaacatgccccacaaggtgagaataaagccatcaaggtgatgaggaagaagtcacggggattttcttcttctaagtccaagcacagtggcaatgtttcaagtattgcaaagaaaaacacacgtgtgtgtatttttgtctgttatgtggcgtgtgaccctggaaccccccgcatgggtccatggccccaccactgcctcccgc

SEQ ID NO: 1553 - DNA, 498 bp, Homo sapiens
tgggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgtgctgccaaagctgggtccatgacaacttctggtggggcgagagcaggcatggcaacaaattccaagttagggtctccaatgagcttcctagcaagccagaggaagggcttttcaaag

SEQ ID NO: 1554 - DNA, 370 bp, Homo sapiens
ctgttctgttccaaatccactctgggctgctgttttcagaccccagtttctgccggtgccctgcagtgacgcccccagctgggcctcctgagggtgcaggttgccctcgaggcttccgaggcaggggcggcacctcctccaagtgccgggggtgagggcctgaatggggggcccttgttgctgctccctgccactgcccagagtcctccggtaactgctgacccctcccaaggcggtgaggcccttaccgacgcttgagggtctgacgcccgctgcagtgttcgtgggacccccgaggtgccccgtggcgaccgatggctctgagccccttctctggacttctgggcttccagtgcatcctaaatcttcc

SEQ ID NO: 1555 - DNA, 470 bp, Homo sapiens
tatgatggctgatcgcctctttcctcgtctcaattacaacatttacccctctcccttccgacacatcatcctgccctatctctcttataccctaccttctactctctcctcttccctacttctctctcctattactatattgctctttctaccccattaccatctacaaccactccttctcatcttctgatcctccctatttctcttttcccattattcttccatcaccgaattctctcacctgccctctctctccatcccacccttcacccatataccccatccccacctatataccttcccctcatccactacccatctcgcctcttcactcttcttacatattctcattacacatctccatatctctctctaccactttcacccctcaaacccactactcattcatattctctccctccccattcttttacccccaccccattctatttcttttattcattcccttc

SEQ ID NO: 1556 - DNA, 461 bp, Homo sapiens
  misc_feature (1)...(461): n = A,T,C or G
cacctaactaaacctaatgaagaaaacctatgttgttggtaaccaaatactgagttggagatcagagctcagattcctgctctaagttatcagcaaaagcattctagggtatataagcagacaaggagggtctctaggaaccataggagtttaacccacgtgagccatcagcctgatttacagcttcctgccctgcagcctgttcttccctaaaccctgggtggactatagtaacctagttggttgaaaccagctcctgacagaccctggcaacttagagatgaaccctggtgaatcttcctcatgactgtaacgtctccatcctggaggaactgtagttccgttatcataacatgtaacccatgtgttgccatgatgacactgtgtctgcaccgctgggacccctcatctacatgcgataatgcaccctctcccctctccatcaccccatanaaccctnc

SEQ ID NO: 1557 - DNA, 637 bp, Homo sapiens
  misc_feature (1)...(637): n = A,T,C or G
agaacatggcaagagcaagactgttctcaggaaggaaaccataaatatggcatttatgtaaaatccttgcagcatctgaccatacttttatctttaaaaaaaaaaatcctcactttcttaaatataagtaacagtttattaattttttttttacagtgagatatggctatgggaagcaggtgatactatttgtttaagaaactgggatgccaactaacacgtggagttccccaagactttgcaatctccatttgtgagtttctgtaaaaaagggaacccagctagaggattcacagagaccttgaatgacaagcgacatactcgaaatctgcagctctcctcccggagggcccagcgtgccaggagacacgctgcagtaaggcacttaccaagctcctttggatagagggaaagaagaaatcaatccaggcaacatgcaagtttcagtgaagtcagacattttatgggaatttaaagtcttgcctgttctcagtgcaccccagtcagttactgacatgtcagcctcagaaaccgcacatggcctcangaaagtcaggcccctcctgctggtgggcacgccattggctcttgaacgctgatggtctcgatgatggtcatttatttctgtgaaatgagg

SEQ ID NO: 1558 - DNA, 538 bp, Homo sapiens
gcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaactcgctaaagaagaaacaaaaaaagctatcaaatatcagagcaaggcaagaaggaaaaagtggataattattgctgtgtcagtggttctggttgccataatcgctctgattattggcttgtcagttggcaaatgatggtgtggataacgtcagtgtgcatgcctctctgccagggtgggaaaattgatgttcattattatttgtgtaattgttttgcttgtgatccttggaattat

SEQ ID NO: 1559 - DNA, 389 bp, Homo sapiens
ggttggggtagtggtcgaagcgcagaaagtcaaactgggagttccgggcctgcttggccttcagcatgatctcaaactgtgctccctgcctgcacacgaagctggccgtgcgctcgatgatggcgtgcattttagcggttggtggcaactccacgtcagacgggacgctcaatcctaagggggcaacgaagggctcttcattttcctctaaattttcggcctcatttttttctctctgttcggaaggctcctcctcctccgtcggctctgacgggtcgtaatagtcgctaccgtaagtgaaccccacggcattgtagctcccatcctctgctagtgcttcactcaatcgcttgtattcttcctcttgccttgcctcctcctcaagcaag

SEQ ID NO: 1560 - DNA, 664 bp, Homo sapiens
ctacatgcatggtctggagttcagtaaactggaaagtttcacccccaagtcttaatttaatcaaaattgctgaactctgttcaatcttcattgttaaaagcagctttaaagctgggtgatttcttagtcaaatgtataacgaagcttttacttatcaatttctttttgggagggggcatgggctgaaatacatcttgtgctcaataaacctccccacatcaatatttcaaagcactttctaggttacaataatgacatttcaattccatatacgcatacatagaatatatacttttaaacagagtgggtcttaagagtatacttggaaccctcggagtcctccatggacaagaacagggtggcccatggacttccagccaaaggctccactgtggggctgctttggggagagactcacagctggacttctctatccgaccatacaatgttagccagcaccaattacccacaatgctttgcccataagagatagaaataatggaactcacaggaagaaacagtattgataacatacacaggcttacagaggccaggcccagtaattaccatgagacagaagcctacaagtggcggtgctttgactgggctgggattattgatacattactggaggatccaggaatctcgagtagtaatagtagtc

SEQ ID NO: 1561 - DNA, 305 bp, Homo sapiens
ggcgcggggcccctctgccgcgtccacgcccgcagccacagatccgtcggcctgtgagtctccacacaccagccagtcccgggccgtggactgtgggtacccggatgccacctccagctcgccatccagcaccttccagtactcctggccacggaagaagtaggaggcaccgtcggaccagcgcatggcgtcgtccagcgtgctggggacacccctccacagggggctctgggcggggtagccggggtccatgtgcctcgtgtggtcatcgtagcgccagtacagctggtccttaaagaaataag

SEQ ID NO: 1562 - DNA, 333 bp, Homo sapiens
ttaatcccagacacccgctgatcagagacatgcttcgacgaattaaggaagatgaagatgataaaacagttttggatcttgctgtggatttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaagaagaaacagcaaaggaatctacag

SEQ ID NO: 1563 - DNA, 546 bp, Homo sapiens
ggggagacgctggctgagtgcgccgagtgggccgcgggggccgcgggccggggcgctgcctgcttgctgggtgacaccgactgagacctggccttggacttggtccgcgaccgggaccgcctcttcttcttcttctcgtggggactggagcgggtccgcttcctgctggccccagggctgcggctcacgcggtaggcagtgggcacactcctctcttccctccgtctctcaggggagtgggctctcctccgaggggaccgggagcgggaccttgacgttttaccaggttttccctcaaaagagctcgcggagccaaatctggtggtggtcgaggctgcctgataacttcctggctcggctgccgctgtcactgacgcgctgctctgacagggctccgcgcgcagcgtccctggggaggctgtgactctcgaccgccgcactgtccgataggcactgggaagagaatgctttgcttttgagcgtgatctagacctggacttggatgacgaatggtacttgggagaacgtgatcttgttcgagatctt

SEQ ID NO: 1564 - DNA, 352 bp, Homo sapiens
tctagtagaagtgtgggggcttctcagtaatggagaacagttggtgaaacttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactgg

SEQ ID NO: 1565 - DNA, 502 bp, Homo sapiens
  misc_feature (1)...(502): n = A,T,C or G
gttgcttgtttctgtgtctctcttcagtagactgtaagcatccagtgggcggggctgtcttttatccttgcctacctagcacaggcagacacagtaaacagggactcaggcaatgtttgggagagaccaagtgttccctgagtcagcacagtgtcagggagcagggtactgcccgcccagtgcgggacactccagtacgctgctccaccttcttctattgtgattcagatgggtggatggatggatgcatgggtggatggatggacaaacaggtagatgaatgggtgcatgggtggatagatggacagacaggtggatggatggacagacgggtgggtgggtggatggatagatgcatgggtggttggatggacagatgggtggatgatggatgcatgggtggatggatggacgggtagatgggtggatgcatgggtggatggatggacagacaggtagatggggaggattcagaattntngagtagtagtaatagtagaat

SEQ ID NO: 1566 - DNA, 587 bp, Homo sapiens
cccctttgtgtcccctcccattttatgggagctctgttttcactctattaaatcttgcaactgcacactcttctggtctgtgttttttatggctcgagctgagctttcactcgccgtccaccactgtttgccgtcattgcagacccgcagctgacttccaaccctctggatctggcaggggtggatctgctgcacttgtgatccagcgaggcagtgtccattgctgctcccaatcgggctagaggcttgccattgttcctgcgcgggctaagtgcctggggttcatcctaattgggctgaatagagctataacactcaatgcatggcccaagattccattccttagtatccgtgaggccaagaaccccaggtcagagaacaagaggcttgccgccatcatggaagcggcccaccatcatctttggagctctaagaacaaggactccctggtaatattttggcaatcatgaagggaccctcaaagtgctttcgcttgctattctgttctacccttccttaggatttggaggaaaataccaggccacctgtcggaccgttaaaaacgatagggcgggcacccagactta

SEQ ID NO: 1567 - DNA, 263 bp, Homo sapiens
gtgcggggtgctggaggtcagcagctgcctggcctgggagccagggacacccatccccttcctgacacctgaggcggcccagctgggcaagaccaggcctgcaggaccagagcctcctgtcacgtggcgcaggggtccaggtggtcaacgctgctctctggaggaccactggttagagcctgcccagctcccctgaggtctggagacagtcaaagcccccatgcctggctgttgaattgttcttaaggcatcatatctagaag

SEQ ID NO: 1568 - DNA, 276 bp, Homo sapiens
tgagaagtggtcacgagggccattattggatggtgaggtccgacagactcagaggggccttgtaggctggcagaccatggtacagggagctgctgcctgctggctgccattggagctcaggacaagcagagaaggagagacttgatatcggggtctcctcatggctacaggaaggctcacctttccagccttggccatcagggtcatagacaagcgtgagcactgccggggctaagagactctaaaactcccagaccaggacttcacctacgccag

SEQ ID NO: 1569 - DNA, 527 bp, Homo sapiens
ctcatgctgacaccacactgccttggttactgtagctttctggtaagtcttgaaatcctgctctttgtcaaggaggttgttttgggtctcccaggtcatctgcatttccacacacgctttggagtttgtgtgccaatttctagaaaagccgtgggagctctgagtgggactgcactgcatctctgcgtcaacttgtggagaacaggagtctcagtaatacttagttggctaatattttgtgaagtatttttgcatctatgttcttgagagtcctggtctgtgaacatatacttatgggcacacacagcactggtctgtgaacacacatgcatgtgcaccagtactgatctgtgaacacacatgtgcacacacagcactggtctgttaacacgcatgcacaccagtactgatctgtgaacacacacgggcgcacacacagtactgatctgtgaacacacacatatgcacacacagtactggtctgtgaacacacacggaggatccaaaattctcgagtagtaatagta

SEQ ID NO: 1570 - DNA, 421 bp, Homo sapiens
tggagaaccaggcgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgag

SEQ ID NO: 1571 - DNA, 285 bp, Homo sapiens
caccctccttgcaccctccagcaaccctccttgtacccctccagcacaccctccttgcacccctccagcacaccctccttgcaccctccagcaaccctccttgcacacctctagcacaccctccttgcatacctccagcagctgtgggagagctccctttccctggctgctcctgctgtctgggacgctccccagggctctcccatctctttctttgcagatggcaattttcccgaggcagcccctgctcaggttgaccccggaactgggtcacttcctttcccc

SEQ ID NO: 1572 - DNA, 726 bp, Homo sapiens
  misc_feature (1)...(726): n = A,T,C or G
gaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccaggaaataggtccaccatctgtccgctcaccccggcttccagtagctgtggacggccacctccattggtgccgccagtgagcactaccctctcggccgtgggggtgccatctcacgagcgcctcctctggttctcacccactgatgtcaccacccagtgccttgcgtggggcagccgtgcatttccactctttccaagcacaaggagcttgttttgtgtccccatgtggagttcgtgcagcctcctggctgtgtgggtggaccgtgtctgcgtctggagctacacagagaaggatggagcattgcacatcgtagccttgagcttcataacacggcactgctaagtgcatgggggtcaggacactcanggtcccagagccttccagaggacgagccttacattgccagggccacctncacaaccaccaccacaagtgcacttgcccccgtggccgccatcat

SEQ ID NO: 1573 - DNA, 394 bp, Homo sapiens
ggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttagctaga

SEQ ID NO: 1574 - DNA, 595 bp, Homo sapiens
  misc_feature (1)...(595): n = A,T,C or G
gtctagacagggctgagctgtttgtcgttggaaattgaggctcggccagaggcgggagcccctacagtgccacgatcaggctgaggctcaccacaccgtggaaggggcagggatgggcccaggggtagccttgtagtgtgaggtgtgcccgaccacatgtaggtcaacagccagacgggacgctgcaggggactgtggggaagccgggagaaggcgctgcccaccctgtggggtccccctcgcctggagaccctgcaggcaacccttcagtgcatgcccacgggggtggtggaggcagagtcctgagaggtgggggtgggagcccccgggtcccctgcaggtcctgacccaccagatgggcccatgtgccccctgtagcttgggggccctggaggtggacaccagcacctcctgactaccagggggagggcctggactgaaacccacaccttcaccattcgccactgggccactctgcangaactgcagcaccccacagatcctttatgcccagcacgccactcactctcacacccctttgcacacatgcacacacagcacgcacacaccaggctcacgcgcttcgcacaagtgg

SEQ ID NO: 1575 - DNA, 580 bp, Homo sapiens
gcggggaccttgctgggggcccctcagcgtctttctgtgcctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcacgaggtgctggtgtccacctccagagcccccaagctacagggggcacatgggcccatctggtgggtcaggacctgcaggggacccggaggctcccacccccacctctcatgactctgcctacaccacccccgtgggcatgcactgaagggttgcctgcacggtctacaggcgagggggaccccacagggtgggcagcgccttctccggcttacccacaataccctgcagcgtaccgtctggctgttgacctacatgtggtcgggcacaccttacactacaaggctacccctgggc

SEQ ID NO: 1576 - DNA, 292 bp, Homo sapiens
gtgcactttcattctaggattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcggtgtgtggtggcccgaaccttatgcaaacagctaactgtcatggccattgctacaaagattgccctacagatgaactgcaagatgggaggagagctctggagggtggacatcctcg

SEQ ID NO: 1577 - DNA, 541 bp, Homo sapiens
ttaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggtactggtgtctatcaaagccatcggatggatgagcagtcacacagactttggtaatattaacggctgctatttgaactattacttttttcttctggctgctattcaaggagctaccctcctgcttatcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgaccccactgag

SEQ ID NO: 1578 - DNA, 273 bp, Homo sapiens
gaagtggtcacgagggccattattggatggtgaggtccgacagactcagaggggccttgtaggctggcagaccatggtacagggagctgctgcctgctggctgccattggagctcaggacaagcagagaaggagagacttgatatcggggtctcctcgtggctacaggaaggctcacctttccagccttggccatcagggtcatagacaagcgtgagcactgccagggctaagagactctaaaactcccagaccaggacttcacctacgccag

SEQ ID NO: 1579 - DNA, 263 bp, Homo sapiens
tccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatccgacagtgcggcggtcgag

SEQ ID NO: 1580 - DNA, 581 bp, Homo sapiens
cagggaggcagaggttacaggcaaagtcataaatcaatacatggaaactgtgcattggtttgacctaaaagggtgggacatctcgaagcggggcccgcaggtcataggtggattcaaagatcctctgatttgtgattggttaaggaggcaaagctttgtctaaaaacctggggtcagcagaaaggaatgttgagctctggcctgtgggtgtgacttcctccaggcccctcaggaagaaatgttgaacaaagaatggtggtctgagttcagtcctcggctcccaactgaagtctctgtgccagtggatggcattttccatttgctgggggcctgggtttctcttccaagttctgaattttacaacaggaaattgaggcccagagaacagaaggacacatgggtgctgctggtagagcccgaactggaacccagatctgcctccagtcccgggctcatctgccaccgtgtaccatgccctctctctgttgtcacatgcagtcacttgcccgattgtccacaccctgcaaaacttgcttcctgagcgacaggacagttctcagggccctgcatgtagcacctca

SEQ ID NO: 1581 - DNA, 431 bp, Homo sapiens
cttgtttaataagaaaatcacttctttaaaaaaatagttctttacatgctgaggttcatctatgcaatgcaagagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtccccttcactgccttccaggggactgggcaccttggcgcccgtgccacctgccgtgagagcggtggcactgaagttgtggatgggctaggtgctcagccactgggccatggagcgttcgtcccgctcggtgccgatgatggtggggtagatgtgctcctcc

SEQ ID NO: 1582 - DNA, 363 bp, Homo sapiens
cccaaccgtatttctttagatacaggagttttgaactcaaatacttaggagaaaacaagttatgactgcattatcctgcaactcattaccagtaatatattgcaaagcgaaacagcttggaaaagagggtgggagaaaagggaagtgagggagggaagataaagaaaaggaattaagttgatcaagtggaattctttttttttttttttaattcttgggaactatgaagtctttgcaagcacagctcgtttctgcagattattttccaaacgtgtacaaaatggaaccaaaacggagaatcccttaagaacctgaagaggcgcaacattaaaagttacgattatccagtagcaagtgttcctc

SEQ ID NO: 1583 - DNA, 431 bp, Homo sapiens
tcaatttaaaacacttttatcaacccaaaaagaaacttcacacccaccaccagtcattccccatttcctctcctagcccaaggcaactgcattctactttttactcctgtacattttcccattttggatgtttcatataaatggaattatacactatgtgttctgtgactgacttcgatccttccaccttggtctcccaaagcactgggattatacatgtaaaccaccatgtgtgctctcaaatagatttttaaatgattgagaattacctcccaaaaaatagtgtaagtaaacaaattttgcaatttactaactttaaaacttttttcattaaataacatctcaacaactttattgagaagtaaatctcttaatatgtgaatgatatttggagcatacaattaattcagtggtttttggtgtatttccac

SEQ ID NO: 1584 - DNA, 594 bp, Homo sapiens
gtggaactgtcaacctgtgccttaccaacaaatgctgccaagggattaactgggtccactacccttaaaggcttcatcagctcttcaaggcggttacacttcttggaggcaaagagagagggatgaaggtaattcccatcttcttcatcatcatcatcttcattgtcagagctgactcctgatttttttttctcgtcacttttgttttctgccaggacagtgtagcgtccctctttcatggctttctggatgaacttatagtaggggttgaggtagtggtcgaagcgcagaaagtcaaactgggagttccgggcctgcttggccactgatatgggtgtactccgaaaagggggagtcatctggcaaaaatgtcactttgcctgctgtattcaaagctcctattcaaccagatattgtgaactttgttcacaccaacttgcgcacaaacaacagacagccctatgctgtcagtgaattaacacgtcatcaaactagtgctgagtctttggggactggcagaactgtggctctaattcccaagatcgaggtgggtgactcaccgctctggccaggtgctttggaaacatgtgtcgt

SEQ ID NO: 1585 - DNA, 557 bp, Homo sapiens
gacaggcaagggcctgagaccactgccgactcaaagccaaagcgagctcctgcttagggcaggtcagcaggcactgtgcccaggaagagcctgtggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgtgcaccggaccacgttgctgcccaggtctggacctcagcgggagaactggctccggggggagtggggccctgcgctaaaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcg

SEQ ID NO: 1586 - DNA, 593 bp, Homo sapiens
  misc_feature (1)...(593): n = A,T,C or G
cttcccctggaaaaaaatcgtgttaagctagatgatgacagtgatgatgatgaagaaagcaaagaaggccaagaaagttctagtagtgctgcaacactaacccagcagttgccccaccctgtgtagttgttgaggagaagaagcctcaacttgcccaggaggagctagaagcaaagcaagcaaagcaaaagctggaagatcgcctcgcagctgctgcccgggaaaagctcgcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaaggaaaagaanaaagcgcanaaaaagatctcgaacaagatcacgttctcccaagtaccattcgtcatccaagtccaggtctagatcacactcaaaagc

SEQ ID NO: 1587 - DNA, 575 bp, Homo sapiens
  misc_feature (1)...(575): n = A,T,C or G
cattggctcttgatcgctgatggtctcgatgatggtcatatttcacagaaataatgaggaaaagcaggagggtagctccttgaatagcagccagaagaaaaaagtaatagttcaaatagcagccgttaatattaccaaagtctgtgtgactgctcatccatccgatggctttgatagacaccagtgccatctgtccagatcccacgatcgacccgtcgcctgagaagaaaaagaacatgcccattatggcactctgcatggacttgggggcatctgattatgcaaattccatgcctgcgatacttgcaaagatctcgctgatcccaatcatcaagtactgcggctcctgccaccacatcgacagatcggcatcatggtaaacgacgttgccgatggtctgattaatggttttctctttaacaaggttcatccttttactctccaaaattcctgcaacatatgctgatcacatgacaaagaacatgcccacggcgatcctctttanggaggatgggagcangccatgtcttctcaaaatgggatcgaccagtttgtccttcaaagggatgagcang

SEQ ID NO: 1588 - DNA, 411 bp, Homo sapiens
catctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccggctaaggttgaagccaaggaagagtcggaggagtcggacgaggatatgggatttggtctctttgactaatcaccaaaaagcaaccaacttagccagttttatttgcaaaacaagga

SEQ ID NO: 1589 - DNA, 519 bp, Homo sapiens
ctttgctggccaccaatgtggacaaaattacaccactctaaggatggttcataaaaccagaccaggtgatgaatgcctgtgccactcagcaacacgggaggctgctggcctggctgtgccttctcattaggctggaggccccagtcacaggcaggtggcaaggggtgcacacgtgcacaacacgcaacgccacgtgcacaacacacaacgccacgtgcacaacacacaacgccaagtgcacaacacgcaacgccatgtgcacaacacaatgccacatgcacagcatgcaaacacacaaacacaggtcacacacacgcgggtgcacacacacacacacacgcacacacagaggcccagagaggaacccgtgacactgttctacaaggcaacgcacagccccatgcagcccaccacacgggggtaccacggacacgagctgcacacaggacaggcacagacctgcccacacgcacatgcacacatgcacgcacacacacatacacacatgcacatgcacac

SEQ ID NO: 1590 - DNA, 294 bp, Homo sapiens
tttgtttgagtcttcttcagtttctttcatcattgtcgtatagttctgggtgtagagatcttttacctccttggttaaatttattcgtagacattttattttttacaaccattgcaaatggggcagttttctggattacttcttcagatagttcatttttagtttataaaaatgcttacaattttttatgttgcttttgtgtcctgcaactttactcaattcattcattagttctaacagttattttggtggagtacttagggccttctatatataagacagtgctatctttaa

SEQ ID NO: 1591 - DNA, 170 bp, Homo sapiens
ctggctgcgtgaatcctgagccggaattcctaatcctgctgttatttgtcggttttacaacgggactggtccccccaagcgaggagggaatctgttttggggaggggctgttatcctttttgttcccaacttaaactgtaaactaggttcctgtcaaagttagtttggcc

SEQ ID NO: 1592 - DNA, 589 bp, Homo sapiens
ctgcagccaacagccacagcctccaggagctgcaggtgagtgaggctctggagcagacacgccagagccggacttgcctgtgcaccctccccacagtgccaaggccccatgggctgtgcgcccgcctgcgagggtgcctcccggtgggggctcaagccctcaggagaggctgtgccacgtggcggccccgtggccatcactgccagggaaagctctgggctctgcgtcgcccactggaggcccccactcagtgcacctggcacagtccgtgcttgccttgggccttgcaggactcaggcagcccttgacctccagtccaggcccgtgaagagacagctggggatgggaaaggggagtggtggggctgcagggctggcacccctgcctctggccccaggatctcccgatgcatttctgaactttccctgagagctgccaagggagcaagcctagagagccctgtgtcggcgagaaacgtgggctggagccctggttagaaggacaggcagctggagaacacaccctcccaggccccttccgtctcaagacctcctatgaatcaaactaactccttcccagccctggcccc

SEQ ID NO: 1593 - DNA, 428 bp, Homo sapiens
cgggtccctgcagggcgcttttcagcctaagacttcaagccccattgaggtggcccgctgggctggtgcggttcacacactcctgcagaaagcgcctggggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagac

SEQ ID NO: 1594 - DNA, 197 bp, Homo sapiens
gaatttaaatgagacagcaaaggagatgcagcataatttattgcaaaagaaaaggagtattttgaaagttaggtgcagaacagacagtacacctgagagagagaattcagagccggctgctcgtaagggtgagacagcattgattattgctggagaaactccctttatgggagttttgcattattattcataaggag

SEQ ID NO: 1595 - DNA, 464 bp, Homo sapiens
gttgcttgtttctgtgtctctcttcagtagactgtaagcacccagtgggcggggctgtcttttatccttgcctacctagcacaggcagacacagtaaacagggactcaggcaatgtttgggagagaccaagtgttccctgagtcagcacagtgtcagggagcagggtactgcccgcccagtgcgggacactccagtacgctgctccaccttcttctattgtgattcagatgggtggatggatggatgcatgggtggatggatggacaaacaggtagatgaatgagtgcatgggtggatagatggacagacaggtggatggatggacagacgggtgggtgggtggatggatagatgcatgggtggttggatggacagatgggtggatgatggatgcatgggtggatggatggacgggtagatgggtggatgcatgggtggatggatggacagacaggtagatggg

SEQ ID NO: 1596 - DNA, 563 bp, Homo sapiens
ctggttgaagcactatggagggagagaggaagaacaacaacaaacggtggtatctcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccggcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagactttttacttcatggcaaccaacagaactgac

SEQ ID NO: 1597 - DNA, 480 bp, Homo sapiens
agaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacac

SEQ ID NO: 1598 - DNA, 301 bp, Homo sapiens
gtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcagatcctgggcgcctcaactgctgcccctggttgaatgttctcttgatagtgctggaccctttgtctattttaaagcgaattttgtgtgatttcctg

SEQ ID NO: 1599 - DNA, 468 bp, Homo sapiens
catgagtgggatcttctgatctgtggattgcaaagacccatggaaaaagcagtttcccaggctgggtagcatgctcactcactgcctcccttggctggctgagggtgagggctccccttgccccatgtggctcccaggtgggccaatccaccagcccatctttccttgttctctatgggtcacggcaaccacctagtcagtcctgatcatagaacctggatgtgtcagttgctgctgcaggatttgcacactcttttagttcttctcagtgggagcctcaaactgcagctgcttctagtcggctatcttgcccctgcccccttgtccttttgaaaaattattgttcatttgaaatctgttttgtctgaaattaggatcgcaacctctgctttttttctgttttctatttgtctggtagatttttctccatccttttagtttgagacgatgagtgtcattatgtgtgag

SEQ ID NO: 1600 - DNA, 554 bp, Homo sapiens
tgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgcttcgatgaccacacgaggcacatggaccccggctaccccgcccagagccccctgtggaggggtgtccccagcacgctggacgacgccatgcgctggtctgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggag

SEQ ID NO: 1601 - DNA, 612 bp, Homo sapiens
  misc_feature (1)...(612): n = A,T,C or G
tacacatcatagcggttcaaactgtacgagtttgggtagctctgccggctgtattggaagtggtctgttaagatgttgttgcggccgtactgatagtccccgtgctgggggaagaggaggccgttgtggggcttctccagtgggctccggtgacgctccttgctgctcaggtctgctgtggtgacggggaggaggtgcttcctggcttgctggtttgcatcgtacttggtcttgttatagaggaagacccccaggatggcggtcatcatgcccaggacgttggtgctggtgactgggttgcgcagcatgatcagggacaccgtgatgaccatgattcttttggtggcattggcgaccgagtagctcagcgggctaacgaggttaaggatgctgaaggcgataacattctgggcaaagttacagaagccgctgacagccaggagcaggagcgtccagggcccctggtagacgtaggtcaagtcgctgctgaccagganagccgagaggtccaccagaacccaggtggggatcataaagaagacggcgtggcagcccaggatgttgagcagccggagatggtgaagccgctgacagccaggagcaagagcgtcc

SEQ ID NO: 1602 - DNA, 268 bp, Homo sapiens
gcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaacctttcatttcctgtccttccttgaaattgctgattgttctgctccctctacagatatttatatcaattcctacagctttcccc

SEQ ID NO: 1603 - DNA, 654 bp, Homo sapiens
tttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactctgagaatcactacaagaaaaactccttgtggtgaaggttctaagacgtgggatcgtttccagatgagaattcacgagcgactcattgacttgcacagtccttctgagattgttaagcagattacttccatcagtattgagccaggagttgaggtggaagtcaccattgcagatgcttaagtcaactattttaataaattgatgaccagttcgaatgcctaccaagactttgagaatcactacaagaaaaactccttgtggtgaaggttctaagacgtgggatcgttttcagatgagaattcacaagcgactcattgacttgcacagtccttctgagattgttaagcagattacttccatcagtattgaaccaggagttgaggtgg

SEQ ID NO: 1604 - DNA, 516 bp, Homo sapiens
ggaaaagaaaacgaaagtacaccaccaagttaaagaaagggaagcttggggtacagattcagctgcctcacgaagactgagctggacgggcgtggagaaggtgctcgtctgtcaaggacgtccccgtaaggagcggtggctgcagcagctgctcgctgggctgtggccagggcaggcttggcccctgggatgagaagagaggcctgcttgtctcctgaaaaccgttcatgatgtaaggaaacacagtgatgcaagcagcacagagcagtgctgtgggaggagcggtggacaggcagctcgggacaggccatccacatgaaaacacctccgctcactcagccatctcctgagtgcctgcgcctcccccttactggctattttcaaaagggacaggatgctggctcttaccaaagtctgtgtgactgctcatccatccgatggctttgatagacaccagtgccagcagtccagaacccacgaacgacccgacgccagagaagaaaaggaacaagccca

SEQ ID NO: 1605 - DNA, 287 bp, Homo sapiens
ctgccctacaaaaaaaccctcccgggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccattcactgatgctccatcctgtttgaggttctacattaaaacatgattac

SEQ ID NO: 1606 - DNA, 297 bp, Homo sapiens
ggggaggtggtgtgccgtgcacgtgcagatcgcctggcagatctaccgtcaccagcagaagataaaggggatgcagctggacccccacaagctggaggtgggtgcaaagctggacctgttcggcagaccccctgtcccgggcgtgtttacaggcttccactacccacaggacctggcccggcccctcttccccagcacaggtgccgcccatcctgcctccaacccatttggaccctcagcccatcctggcagcttcctgcccactggccccctgacagaccctttcagcagaccgag

SEQ ID NO: 1607 - DNA, 555 bp, Homo sapiens
agactgtgttacaggaaagaagtcagtcacagaacacatagtgtataattccatttatatgagacatcctaaatgggaaaatgtacaggagtaaaaagtagaatgcagttgccttgggctaggagaggaaatggggaatgactggtggtgggtgtgaagtttctttttgggttgataaaagtgttttaaattgattgtgtgtggaaatacaccaaaaaccactgaattaattgtatgctccaaatatcattcacatattaagagatttacttctcaataaagttgttgagatgtcatttaatgaaaaaagttttaaagttagtaaattgcaaaatttgtttacttacactattttttgggaggtaattctcaatcatttaaaaatctatttgagagcacacatggtggtttacatgtataatcccagtgctttgggagaccaaggtggaaggattgcttgggctaagagaggaaatggggaatgactggtggtgggtgtgaagtttctttttgggttgataaaagtgttttaaattgattgtgtgtggaaataca

SEQ ID NO: 1608 - DNA, 587 bp, Homo sapiens
cttaagactgaagggtggagctgggatatagatgtgttgtttcttttcaaatcaaacctgctttaggtcgtcactcgagggtgtctagcgattatgggcagtgggggcctgggattaaggatttctaaaggcgtttgatttgaaaaggataacattacatgatgtaggtggtttgctcccctctttcttcccattttttcaatcccccttcccctcgtctctgggttttggggttgttgtggggtggttttttttcttttttgcctgttcggctacttctggggcccggactgaaaagctaaccatgaccaaccattaaactgtggaatagtctctccacgtgaagaaagcccatcgtttgagaccattaaaactggattcttcatagccctggggcatgactgtagggatgacctctgagctggccagaatggacacattaatgaccaaataggcctttttccatccctgacgtttccttttggaattagagctcgaaaacgagaactggtgaagggagggccgcggaatcagatcatgtctggatctgatggctccgtgctgtgctcaagcgtgctgtgccttca

SEQ ID NO: 1609 - DNA, 513 bp, Homo sapiens
caggaaaacccaagtgctgttggggaggttggccaacaactgctctaattgcttcctgctgaattggggtgtagtaggggttgtgcagttgagatttcctctggaggggtgccttcgatgtcattaacattggagcatgggctagcaggccggtccaggggtccgcggtagattttagtcatggactgcatctagggctccatttgaagaatgagttgtggctttacagcttcgattctggaaaagacaaacttaacaaggaggttaaagatacagagattgaaatgtatggcctgcagtgcaggggattatttctttggcacacttcacaggccctgactatctgcttgatagttttgaaaaggcctggtccatctcctcattcttaaaaaatgagattgaattttgattagcccaggaaaattgtctatgtgtttagatttctttctttatagtgtcatttagtgctgttctctttgttgcatattctgcacaagggaatttgagtccaga

SEQ ID NO: 1610 - DNA, 312 bp, Homo sapiens
cgctaagtctaagaaacagcctggggttacagaatgtgaaatgcagtatacattcgtaattccttatcctgaatgctgaaatccacaacattatgaaaactgggttttccttaagctcgatgtcaaaattcaatgagcggcaaaatctgatctaaactgagtcatggctatttataatcttaactcctcccccttactgtgaatactcacatttcactggagagctgtgtgaatgtgcctgattacagggtgcagtcctagaccccacctggggattacataatacacctcttatacattgtactatcttcc

SEQ ID NO: 1611 - DNA, 249 bp, Homo sapiens
ctgacatagatgtctctaacatcatgtcactttcattcatttcaatttcaaaggtttcttccaaggaaggtctggaatctggagttttccttgaggtttccaatggcgtaagccccgtttcttctgcagtctgtttttctacttcaaattccctgaaatcccacggaggtgaaataatgttctttagtgtcttcattgtatgcacatcaaagtcataacattttaatttgtctttaatgtctgctccaa

SEQ ID NO: 1612 - DNA, 417 bp, Homo sapiens
ccagggcatgttacataggtccacagtgctttctctggaatggttggggctgtatgtgtttcagagttcagaattttccagattttaggaagatagtacaatgtataagaggtgtattatgtaatccccaggtggggtctaggactgcaccctgtaatcaggcacattcacacagctctccagtgaaatgtgagtattcacagtaagggggaggagttaagattataaatagccatgactcagtttaggtcagattttgccgctcattgaattttgacatcgagcttaaggaaaacccagttttcataatgttgtggatttcagcattctggataaggaattacgaatgtatactgcatttcacattctgtaaccccaggctgtttcttagacttagcggttagccggtgggaagag

SEQ ID NO: 1613 - DNA, 285 bp, Homo sapiens
caccctccttgcaccctccagcaaccctccttgtacccctccagcacaccctccttgcacccctccagcacaccctccttgcaccctccagcaaccctccttgcacacctctagcacaccctccttgcacacctccagcggctgtgggagagctccctttccctggctgctcctgctgtctgggacgctccccagggctctcccatctctttctttgcagatggcaattttcccgaggcagcccctgctcaggttgaccccggaactgggtcacttcctttcccc

SEQ ID NO: 1614 - DNA, 530 bp, Homo sapiens
ctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcaggaggtgctggtgtccacctccagggccgccaagctacagggggcacatgggcccatctggtgggtcaggacctgcaggggacccggaggctcccacccccacctctcaggactctgcctccaccacccccgtgggcatgcactgaagggttgcctgcagggtctccaggcgagggggaccccacagggtgggcagcgccttctcccggcttccccacagtcccctgcagcgtcccgtctggctgttgacctacatgtggtcgggcacacctcacactacaaggc

SEQ ID NO: 1615 - DNA, 642 bp, Homo sapiens
  misc_feature (1)...(642): n = A,T,C or G
ccccctcgtcccatcccagggatggcacccatcccaggatgaggctgccagggccgggcaggcaggccccaggccaggcctcatggagccgggccacctccccgtgaagagaggccacatcctcatggagtccagccgtgtcctctgtcccccgcctgttcaccatctgctccctggagcaggaggagtccctgcccgtcagaccagtctgtggaaagaccgacctccctcctgtctgtcggggacactggctttgccctgcaccaagtggtgtttcctcatcacgctttgttgcccagcagcctgtggggtgaagtcccccgtgcagctggcccagccccgtggtccccacgtcctgggtcatgccccagtgcaaagccggctgtgggccttgtctgctgagtcgggctctcacgttggcagggctcactgcggttttgaagtccaaactctccgtcataagcctcttctgccggtcctatctctggtgaagaggtgaaccgtaggcggggcaggggggctgctctgaacttgcctctccatgctgcagcccacctccctctggcagtggggtggccgtgctgggtcctggggcanggcctggagccccggcagcccatgacgcatttcatgagcccccac

SEQ ID NO: 1616 - DNA, 313 bp, Homo sapiens
gtcatctataagcacattgtccattttgaagaatgctttctcacaatcttcttccttttcaaattcaataaaagcgtaacagagggactctcctgtcttccagtctcggataacttcacaacttcttattggcccaaatctagagaatattatttccagatcctcgtctgtggtcactgggttcaatttacacacaaacagtacattttctggaggtttaatatctgcatcaggtaggtctcccaccatctccaaaagtatagcctgagttttagcctcttttactgcctttatttccttttgctgctgttgt

SEQ ID NO: 1617 - DNA, 572 bp, Homo sapiens
ctaaaagttacagttcatgtctcacgttcacaaagctcttcccaccggctaaccgctaagtctaagaaacagcctggggttacagaatgtgaaatgcagtatacattcgtaattccttatccagaatgctgaaatccacaacattatgaaaactgggttttccttaagctcgatgtcaaaattcaatgagcggcaaaatctgacctaaactgggtcatggctatttataatcttaactcctcccccttactgtgaatactcacatttcactggagagctgtgtgaatgtgcctgattacagggtgcagtcctagaccccacctggggattacataatacacctcttatacattgtactatcttcctaaaatctgaaaaattctgaactctgaaacacatacagccccaaccattccagagaaagcactgtggacctatgtaacatgccctggtccaagaagaaactcacttgccatttgaagaaacaaagcatacagcacaggaaaagatatcctgtgatacaaggtaagaaacctgcctgatgacagggctgacggaaggaagaaagaaag

SEQ ID NO: 1618 - DNA, 465 bp, Homo sapiens
ggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcag

SEQ ID NO: 1619 - DNA, 566 bp, Homo sapiens
  misc_feature (1)...(566): n = A,T,C or G
tcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttgaaacgattgtttcggatcatattgatctctctcctttttccttttgtcctttcgctgtatgacttgaatcagttttgattctatttgtaagtgtttcttgtcgtgaggcacctgccatatctgttgcgttttcctcggcagcgtgtagggcttcagcttcctgggttttcacccttcctgcaacactgttagatgtgaggaaaggaagtgccaaaaatgcctggacagatggcttgtcccaaggccaggacacacactntaaaatccaacattcac

SEQ ID NO: 1620 - DNA, 464 bp, Homo sapiens
cccatctacctgtctgtccatccatccacccatgcatccacccatctacccgtccatccatccacccatgcatccatcatccacccatctgtccatccaaccacccatgcatctatccatccacccacccacccgtctgtccatccatccacccgtctgtccatctatccacccatgcacccattcatttacctgtttgtccatccatccacccatgcgtccatccatccacccatctgaatcacaatagaagaaggtggagcagcgtactggagtgtcccgcactgggcgggcagtaccctgctccctgacactgtgctgactcagggaacacttggtctctcccaaacattgcctgtgtccctgtttactgtgtctgcctgtgctaggtaggcaaggataaaaggcagccccgcccactggatgcttacagtctactgaagagagacacagaaacaagcaac

SEQ ID NO: 1621 - DNA, 408 bp, Homo sapiens
ctgcagcagacagctggccggcatggcgatgacctccgcaacaccaagcatgagatctctgagatgaaccggatgatccaggggctgagagccgagattgacaatgtcaagaaacagtgcgccaatctgcagaacgccattgcggatgccgagcagcgtggggagctggccctcaaggatgccgggaacaagctggccgagctggaggaggccctgcagaaggccaagcaggacatgacccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggc

SEQ ID NO: 1622 - DNA, 369 bp, Homo sapiens
gaggtccaaacaatgaagttattttttaaactgccacattcactccgaagcccactcatctccttcagcatcccacagatgaggcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgtgctgccaaagctgggtccatgacaacttctggtggggcgagagcaggcatggcaacaaattccaagttagggtctccaatgagcttcctagcaagccagaggaag

SEQ ID NO: 1623 - DNA, 632 bp, Homo sapiens
  misc_feature (1)...(632): n = A,T,C or G
gtgaaaacagagctcccatacaaagggaggggacccaaagggggttgctgttgccagctcgaatgtctgggtttatttcctgatcgttgtccctccctctgtgctctcaggcaacagatgattggctatttctttacctcctgtttttgcctaattagcattttagtgagctctctttactatctgattggtcaggtgtgagctaagttgcaagccctgtgtttaaaggtggaagcggtcaccttcccagctaggcttagggattctttgtcggcctaggaaatccagctagtcctgtctctcagtgccccctctcaacaggaaaacccaagtgctgttggggaggttggccgacaaccactctaactgcttcccgctgaattgggacgtagtaggggttgtgcagttgagatttcctcaggaggggtgccttcaatgtcattaacattggagcatgggctagcaggccggtccaggggtctgtggtagattntagtcatggactgtctggggctccatttgaagaacgatttgtagttttacagcttcaattctggaagagacaaacttaacaaggaggttaaagatagagggattgaaatgtatggcctgcagtgcaagggattatttct

SEQ ID NO: 1624 - DNA, 360 bp, Homo sapiens
tctcaacaatcccacaaggtggttactgttctagctactcatcttatagacgagggagactgcacacagggggtcgaaatcgcttgcccggggttacacaggtcacgctgcaaatgtgacaacatatctttacgttttattagtactgaggcgtgggacattgcttggtttttaaaaagaagggtttgtgtctagatttttaaggcagattcttgaaaaccatgaattataggcttttattttaggtagcctcaaaattcctacttaaaaaatgaaacaaaaaacaggtaacataatttaaaaacaccacccaagtctaagcaatttaacaagccaattaaaaaatgtatttatctaaag

SEQ ID NO: 1625 - DNA, 277 bp, Homo sapiens
gggggtgtttgggggggctttgactgtctccagacctcaggggagctgggcaggctctaaccagtggtcctccagagagcagcgttgaccacctggacccctgcgccacgtgacaggaggctctggtcctgcaggcctggtcttgcccagctgggccgcctcaggtgtcaggaaggggatgggtgtccctggctcccaggccaggcagctgctgacctccagcaccccgcacttgctcatgaggacgaggatccagagttctcgagtagtagtagta

SEQ ID NO: 1626 - DNA, 285 bp, Homo sapiens
ggggaaaggaagtgacccagttccggggtcaacctgagcaggggctgcctcgggaaaattgccatctgcaaagaaagagatgggagagccctggggagcgtcccagacagcaggagcagccagggaaagggagctctcccacagctgctggaggtgtgcaaggagggtgtgctagaggtgtgcaaggagggttgctggagggtgcaaggagggtgtgctggaggggtgcaaggagggtgtgctggaggggtacaaggagggttgctggagggtgcaaggagggtg

SEQ ID NO: 1627 - DNA, 346 bp, Homo sapiens
ggataacactacatgatgtaggtggtttgctcccctctttcttcccattttttcaatcccccttcccctcgtctctgggttttggggttgttgtggggtggtttttttcttttttgcctgttcggctacttctggggcccggactgaaaagctaaccatgaccaaccattaaactgtggaatagtctctccacgtgaagaaagcccatcgtttgagaccattaaaactggattcttcatagccctggagcatgactgtagggatgacctctgagctggccagaatggacacattaatgaccaaataggcctttttccatccctgacgtttccttttggaattagag

SEQ ID NO: 1628 - DNA, 364 bp, Homo sapiens
gtcatcgtagcgccagtacagctggtccttaaagaaataagtcctgtcattgtgggcccaggagaaggcagcgtcgatgccgccaggcgggaggctgaagtcggagacggggcgcgggtatccttcctctacgttattgtccttgaacacccagtacctgtctcctttaaagaagacgatcctgtggtcgctggtgcgctcgtacacggcgtccacgctgtccaggtgcagcggcaggccccgccagaagcggtgcatctgtgccggctgcagggacaccaggtgccggtcccgcgtcagccgccagaagtacttgcctttgaagaagaaagcttcaccccggatctgggccaccgcgtcaaag

SEQ ID NO: 1629 - DNA, 218 bp, Homo sapiens
tcttttgttttccgagtttgggattcggctgttgggaaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccag

SEQ ID NO: 1630 - DNA, 519 bp, Homo sapiens
gtgtgcatgtgcatgtgtgtatgtgtgtgtgcgtgcatgtgtgcatgtgcgtgtgggcaggtctgtgcctgtcctgtgtgcagctcgtgtccgtggtacccccgtgtggtgggctgcatggggctgtgcgttgccttgtagaacagtgtcacgggttcctctctgggcctctgtgtgtgcgtgtgtgtgtgtgtgtgcacccgcgtgtgtgtgacctgtgtttgtgtgtttgcatgctgtgcatgtggcattgtgttgtgcacatggcgttgcgtgttgtgcacttggcgttgtgtgttgtgcacgtggcgttgtgtgttgtgcacgtggcgttgcgtgttgtgcacgtgtgcaccccttgccacctgcctgtgactggggcctccagcctaatgagaaggcacagccaggccagcagactcccgtgttgctgagtggcacaggcattcatcacctggtctggttttatgaaccatctttagagtggtgtaattttgtccacattggtggccagcaaag

SEQ ID NO: 1631 - DNA, 507 bp, Homo sapiens
ctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagatcaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaggtttacaattccaactaaaaatcaccctgcttctggcttatctgaatcccttacccaccccaccccaccaccctactcctatttattcagcac

SEQ ID NO: 1632 - DNA, 539 bp, Homo sapiens
gacactttggaaaagcaagcctgacaactcaggcgacacattcaatataaaccatggtgtgaaggcacagcacgcttgagcacagcacggagccatcagatccagacatgatctgattccgcggccctcccttcaccagttctcgttttcgagctctaattccaaaaggaaacgtcagggatggaaaaaggcctatttggtcattaatgtgtccattctggccagctcagaggtcatccctacagtcatgctccagggctatgaagaatccagttttaatggtctcaaacgatgggctttcttcacgtggagagactattccacagtttaatggttggtcatggttagcttttcagtccgggccccagaagtagccgaacaggcaaaaaagaaaaaaaaaccaccccacaacaaccccaaaacccatagacgaggggaatggggattgaaaaaatgggaagaaagaggggagcaaaccacctacatcatgtaatgttatccttttcaaatcaaacgcctttagaaatccctaatcccag

SEQ ID NO: 1633 - DNA, 239 bp, Homo sapiens
ggtgtgaaggcacagcacgcttgagcacagcacggagccatcagatccagacatgatctgattccgcggccctcccttcaccagttctcgttttcgagctctaattccaaaaggaaacgtcagggatggaaaaaggcctatttggtcattaatgtgtccattctggccagctcagaggtcatccctacagtcatgctccagggctatgaagaatccagttttaatggtctcaaacgatg

SEQ ID NO: 1634 - DNA, 297 bp, Homo sapiens
ctcggtctgctgaaagggtctgtcagggggccagtgggcaggaagctgccaggatgggctgagggtccaaatgggttggaggcaggatgggcggcacctgtgctggggaagaggggccgggccaggtcctgtgggtagtggaagcctgcaaacacgcccggggcagggggtctgccgaacaggtccagctttgcacccacctccagcttgtgggggtccagctgcatctcctttatcttctgctggtgacggtagatctgccaggcgatctgcacgtgcacggcacaccacctcccc

SEQ ID NO: 1635 - DNA, 505 bp, Homo sapiens
gtaagaaggctttctaatcttaactttctgtattttatatagaattttagtaatttaatatataaaacaaaatacattccatgtagcatcctacccaattagaaatattaacaactgcggtattctactgtgggctggcagcagtcatgaaaaatgatcaattaggtctgttcaggcccaagtgacaagtccgatccattctgagtggaggctgcgtttgtaacagtttattctatctgataacaacagcattaacactttcaatattttggttaaaatttagttatcttttatactccaataattcatattactgaggagatcaccacccctcccatttctaacttgcattttaaagccacttggatccctggaaatgattattgctggcagagcttggatggaggaggcaggtttgcagccagtttagaaaaatgcaatcctactaaataaaacacgcactcactgttcccggaagagctgaggcagaattccacaagaaaag

SEQ ID NO: 1636 - DNA, 377 bp, Homo sapiens
ctcagaagccccatgaaggtgccactgtctctgcagatgaggaaacaggctcggagaaacgaagagacctttgccacggtgtccagtgtccacgaagcagtggggccaggacctgcccacgccgggctccgtgaagcagtggggccaggacccgcccccagactgagtcccagggtgcacgttaactctgggctgtgcccagcattcgacaccccagggctggggcccagaagctgggggaggtgttgggaacccacagggagctgtcaggtggggatgcagtttcctgttctcagcaggaagcagccatcggtgctcatgagaagtctccaggtgctcaaatgttggcagccaattttaaaaaaataaatcaggcc

SEQ ID NO: 1637 - DNA, 521 bp, Homo sapiens
ctaggataattccaaggatcacaagcaaaacaattacacaaataataatgaacatcaatttccttcttgccttgctctgatatttgatagctttttttgtttcttctttagcgtgttctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagctgaaagacccgcaaccacagccccactcagaatgcagcagctccacccgtatccgcatccacatccacatccacactctcatcctcactcgcacccacaccctcacccgcacccgcatccgcaccaaataccgcac

SEQ ID NO: 1638 - DNA, 276 bp, Homo sapiens
ctggcgtaggtgaagtcctggtctgggagttttagagtctcttagccgtggcagtgctcacgcttgtctatgaccctgatggccaaggctggaaaggtgagccttcctgtagccacgaggagaccccgatatcaagtctctccttctctgcttgtcctgagctccaatggcagccagcaggcagcagctccctgtaccatggtctgccagcctacaaggcccctctgagtctgtcggacctcaccatccaataatggccctcgtgaccacttctca

SEQ ID NO: 1639 - DNA, 480 bp, Homo sapiens
ctggtcatcaatttattaaaatagttgacttaagcatctgcaatggtgacttccacctcaactcctggctcaatactgatggaagtaatctgcttaacaatctcagaaggactgtgcgagtcaatgagtcgcttgtgaattctcatctggaaacgatcccacgtcttagaaccttcaccacaaggagtttttcttgtagtgattctcaaagtcttggtaggcattcgaactggttctttcactttgagattcttttcttttgcgcctcttatcaagtcagcacacaccttttccaaggattttacgttgcggcttgttagggtgattcgaattcggtgaattgccacctccggctccacgggtgtttttccggtatccctaaaagccatggctgttgcgcgcgggcttcctgaccgacttgttcctcggcgagaacgaacagcggtgagtcaggaacaggagcgtgcggaccaaaaatcc

SEQ ID NO: 1640 - DNA, 471 bp, Homo sapiens
gtttacttggaaataatttcagacctgcacaaagctgagggaagtgagaggccatagctcctgctggccagcgcccaacagagacgcccctgcacagccagcgcccagactcacgtggaagcccagcggtctccctctctggccaacttggatctggaacaattctgcaccttgtagtgacacgccccagcacatctgggcccccaggcctcacatgccagggcccctggtgaggttctttactttgagtcatccaagtcaggagcacgccccagcccggggaaacccgtcccaggactggctggtgtggctcgctgcagccatgagcctggctccctgccgaccttcggctcacccagaggcccgctctgtgcacctcctgcagcaacaggcctccctgggtggctgacaaggtgcacacaaggcagacggtgccagtgcgaattaagggatgtcacccaggcccctgag

SEQ ID NO: 1641 - DNA, 519 bp, Homo sapiens
ctttgctggccaccaatgtggacaaaattacaccactctaaggatggttcataaaaccagaccaggtgatgaatgcctgtgccactcagcaacacgggaggctgctggcctggctgtgccttctcattaggctggaggccccagtcacaggcaggtggcaaggggtgcacacgtgcacaacacgcaacgccacgtgcacatcacacaacgccacgtgcacaacacacaacgccaagtgcacaacacgcaacgccatgtgcacaacacaatgccacatgcacagcatgcaaacacataaacacaggtcacacacacgcgggtgcacacacacacacacacgcacacacagaggcccagagaggaacccgtgacactgttctacaaagcaacgcacagccccatgcagcccaccacacgggggtaccgcggacacgagctgcacacaggacaggcacagacctgcccacacgcacatgcacacatgcacgcacacacacatacacacatgcacatgcacac

SEQ ID NO: 1642 - DNA, 395 bp, Homo sapiens
gtttcggtctgctgaaagggtctgtcagggggccagtgggcaggaagctgccaggatgggctgagggtccaaatgggttggaggcaggatgggcggcacctgtgctggggaagaggggccgggccaggtcctgtgggtagtggaagcctgcaaacacgcccggggcagggggtctgccgaacaggtccagctttgcacccacctccagcttgtgggggtccagctgcatctcctttatcttctgctggtgacggtagatctgccaggcgatctgcacgtgcacggcacaccacctccccggcttcttgaccaccgcccggtacgggtcagacaccccaggcgctttctgcaggagtgtgtgaaccgcaccagcccggcgggccacctcagtgggg

SEQ ID NO: 1643 - DNA, 214 bp, Homo sapiens
gtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttag

SEQ ID NO: 1644 - DNA, 539 bp, Homo sapiens
gacactttggaaaagcaagcctgacagctcaggcgacacattcaatataaaccatggtgtgaaggcacagcacgcttgagcacagcacggagccatcagatccagacatgatctgattccgcgggccacccttcaccagtcctcgttttcgagctctaattccaaaaggaaacgtcagggatggaaaaaggcctatttggtcattaatgtgtccattctggccagctcagaggtcatccctacagttatgctccagggctatgaagaatccagttttaatggtctcaaacgatgggctttcttcacgtggagagactattccacaatttaatggttggtcatggttagcttttcagtccgggccccagaagtagccgaacaggcaaaaaagaaaaaaaaaccaccccacaacaaccccaaaacccagagacgaggggaagggggattgaaaaaatgggaagaaagaggggagcaaaccacctacatcatgtaatgttatccttttcaaatcaaacgcctttagaaatccctaatcccag

SEQ ID NO: 1645 - DNA, 361 bp, Homo sapiens
cagttctgagaccgttcttccaccactgattaagagtggggtggcaggtattagggataatattcatttagccttctgagctttctgggcagacttggtgaccttgccagctccagcagccttcttgtccactgctttgatgacacccaccgcaaccgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtc

SEQ ID NO: 1646 - DNA, 714 bp, Homo sapiens
gtcagggtagcctcagctgcatgtgcatatcaaaaggtgggggctcatgaaatgcgtcatgggctggcggggctccaggccctgccccaggacccagcacggccaccccactgccagagggaggtgggctgcagcatggagaggcaagttcagagcagcccccctgccccgcctacggttcacctcttcaccagagataggaccggcagaagagacttatgacggagagtttggacttcaaaaccgcagtgagccctgccaacgtgagagcccgactcagcagacaaggcccacagccggctttgcactggggcatgacccaggacgtggggaccacggggctgggccagctgcacgggggacttcaccccacaggctgctgggcaacaaagcgtgatgaggaaacaccacttggtgcagggcagagccagtgtccccgacagacaggagggaggtcggtctttccacagactggtctgacaggcagggactcctcctgctccagggagcagatggtgaacaagcgggggacagaggacacggctggactccatgaggatgtggcctctcttcacggggaggtggcccggctccatgaggcctggcctggggcctgcccgcccggccctggcagcctcatcctgggatgggtgccatccctgggatgggacaagggggctgtgggctttggcttctgggtgcccggaaagagga

SEQ ID NO: 1647 - DNA, 579 bp, Homo sapiens
aggagtgcatgcaggatgccccaaacgtcgtgaactcttgttactcctgtatgtagtagtgtaagcatgtgatttttaacaccatttggtttgaaactaatgtagagatgcctgattccaaacaggtgtggagaatattgaacggctcagaagccgcgtcccttacttaacacaactccgaatctccctcatccatgatgcgtccattggatcactcgctagtggtcactgtgtggcagttactaggggaattctgcctctgactgttctttttcttttggtctttaaacgccctgtcgtgggatgtgctcactgatttgtggctacgttgaaggtatcacttgtcttgagggttttcaatatttcaggatcatgctggtggcaaaaggactccatgcctctgtggaatcatgtccacagggggacctgcctcccgtgatgtcccacctttccttcaaggtctgtcatatgagtcctccccttttacaacacttattatggtatttttcaagttattcttcttagatttgcagtacctactaaaatttgtgtttttattgttgaagtttggaaaatgct

SEQ ID NO: 1648 - DNA, 562 bp, Homo sapiens
gctactactacccaataattcagaatcctgatggttcaaagtgatgggatcatactaatgtaacaggtaatcacaagttcagcgttgccagagctcacatttatttttcccaaatagcaaggcatccaaatttagatgtgaaacctttcaaactgtgactattagttcactttcttttggtaccagctttatggatacatattcccataccatataattcacttatataaactgaagaattcagtggttttttagtacattcacagagatgtgcaccaatcttaccctcccctcccccagtatcaggaaactgtactaatctgcattgactgtaaggatttgcctattgcctattctggccattgcatataaatgtgatcttgccagatgtggtctcggctcactttattgttgctttaaactcagcttgagttttctcaaatgaggcaaggcaatcggattagattactatcattcaaaaatggcagagtgtattgagcactgttgggacactgggttatcacatgattcaaatcatttgctttgctttcattccatggct

SEQ ID NO: 1649 - DNA, 556 bp, Homo sapiens
gaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttacacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaaggaggatccacaattctcgagtagtagtagta

SEQ ID NO: 1650 - DNA, 322 bp, Homo sapiens
cagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctca

SEQ ID NO: 1651 - DNA, 302 bp, Homo sapiens
cagcagttgaggcgcccaggacctgcttggacacacgcacatgcggccgcgacggaagcaagaggaccaggacaccgggcaagatccccgcagtgccagcttcccaggactcaggattccagtcggccatgaagcaataaatacagacatgccccacaaggtgagaataaagccatcaaggtgatgaggaagaagtcacggggattttcttcttctaagtccaagcacagtggcaatatttcaagtattgcaaagaaaaacacacgtgtgtgtatttttgtctgttatgtggcgtgtgaccc

SEQ ID NO: 1652 - DNA, 793 bp, Homo sapiens
gcttattatgagtttaagaagcagttcttcctccagaaagaagggggcgatagcatgcaggctgtgtctgcaccagaagaggctcccacagactctgctcccgagaagccaagtgatgccggggaggatggcgcgcctgaagacgcagccgaggtgggagcacgggcaggctcaggcgggaagaaggaggcatcgtccagtaagaccgtcccggatgggaagctggtgaaaggtgactgccctggcatcagcgagtgtgcccttgccatgaagtccccagtcagtgcggttctcacagcatggttcaggggctcaccccagccccacgccatgcagtgcacatctgcacagatctgctctgacggcacggcgtcccccaccgtagaccctgcatatgatgtggctccatgctagtcatccccttcccagcagccgatgctcagcaaagcaaaagctggaagatcgcctcgcagctgctgcccgggaaaagctcgcccaggcgtctaaggagtcaaaagagaaacagcttcaagcagaacgtaaaaggaaagcggcgttatttttacagaccctcaaaaatcctctggcggaagcagaagctgggaaaattgaggagagtcctttcgtggtcagggaatccgcactacgccctgccctttactggctggaggcggcccttgcctactttagaagttaaaccacccgataggccttcgagcaaaagccaagatccccccgggagaagatgaggaagaaaaggaaaaggaaaaagcccccaaaaaagatcttgaac

SEQ ID NO: 1653 - DNA, 329 bp, Homo sapiens
tcttcctaaaatctgaaaaattctgaactctgaaacacatacagccccaaccattccagagaaagcactgtggacctatgtaacatgccctggtccaagaagaaactaacttgccatttgaagaaacaaagcatacagcacaggaaaagatatcctgtgatacaaggtaagaaacctgcctgatgacagggctgacggaaggaagaaagaaaggggacaaaatggttttaggtgcaaggatttggagaagaccactgtatgaagacagcccgctgtgtggccagagtgacgccatcctgaagcaaaaccaccgtgatgaccgatgctcg

SEQ ID NO: 1654 - DNA, 599 bp, Homo sapiens
ctgggattatacatgtaaaccaccatgtgtgctctcaaatagagttttaaatgattgagaattacctcccaaaaaatagtgtaagtaaacaaattttgcaatttactaactttaaaacttttttcattaaatgacatctcaacaactttattgagaagtaaatctcttaatatgtgaatgatatttggagcatacaattaattcagtggtttttggtgtattccacacacaatcaacttaaaacacttttatcaacccaaaaagaaacttcacacccaccaccagtcattccccatttcctctcctagcccaaggcaactgcattctactttttactcctgtacattttcccattttggatgtttcatataaatggaattatacactatgtgttctgtgactgacttctttcctgtaacacaggatttgcaaggtttcaccatggggtgggcagggtgtggtggctcacatgtatactaatcccaccttggtctcccaaagcactgggattatacatgtaaaccaccatgtgtgctctcaaatagggttttaaatgattgagaattacctccccaaaaaatagtgtaagttaaacaaat

SEQ ID NO: 1655 - DNA, 425 bp, Homo sapiens
ctccttttggatcccccaaagtgtatctgcactcttcttcaaacgggcctcttcctcagtagtcagagtcaccttcacaaggtctgagattccattctgtcccaaaatgcaaggaacactaaggaagacatcatcctttattccgtaaagacccttaatcatggtggaaactgggtgcacccgcctaagattcttcattatactctctgccaaatctgctacagagagtccaatagcccaggatgtgtagcctttgagtttgatcacctcataagcactctcaaccacctgcttgtgaacctctttccactgttccttatctttatcagtccctaaatctgggtgcagagtcttcagagagacaccagcaacattcattccactccatacaggcacactggaatctccatgttccccaaggaccc

SEQ ID NO: 1656 - DNA, 596 bp, Homo sapiens
gtcagtcattcactcatccagttcaatctaatacctatttatcattggcaagtgctgtgccagcctctagaactacaatcgtggttaaaacaaagatcccggccatcccagctttgaagacaggcattcaatagttgcacaaaataagtataaattataaccggtgctgtgggaaaaaagtatagggagttccaaggccataaaaacggggagctaacctagtgtggcagggttaggaaagtgatatttgagctgacagctggaaatgacaagcatcaacagacaggtggcaaaggtccaattcgggcattcaattattctctccttagacattgattaaatatatattgcctgctgtgtggcagcactgtgctgaccatcagtctatctggcggacatttaaaaaagttttttaaaaagagaatgcctgcaacttcaagacttactggcaggtttacttctccagatgacctactgggaagccaccttcccagctactggctccaccctcatcttagctggagggaatggatgaagaagaggaggtggtcttaccctaattgaatcattgccgcagctggggatcacgatccctt

SEQ ID NO: 1657 - DNA, 612 bp, Homo sapiens
tttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagagaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccaacaggaagcggacccgctccagcgaggaatccaggaggtgacactgaagcagcgcggctctcctgctcccagcagctgtcttctcatttgtctcagcatccctgggtgacccctgcctgaatcagttcttacactgctgactgccaaataatgactttccccctctc

SEQ ID NO: 1658 - DNA, 436 bp, Homo sapiens
cctccaatacctatgagttgggtaaattcctctcttcttgaggtcccaagataacttggggctcctggacctgttagaaagtgacattctttactcatcacaggttaggagccctgtacaaggactgtgtagacaaggtatgaggccagtttctcctttttttttggctctgcaagtcaagcttgattccttaaagggaagcacacccttctatcagaaactggtaaaaccaccagtttctccaattgtgtcctgttgcaaaagaaaatggattcttgttgcacttatgcaaataactacattgccataataatactcacaaatagtttctgaattctagagaaaccagcagaggaacaaatacactccaaattttgttcacaggagtataccttactcaattgttaaaagctgtaaatagttcaaaataaaagtt

SEQ ID NO: 1659 - DNA, 490 bp, Homo sapiens
ctgattaaatataaatacagaagttgaatacataggttagaaagtttaaattttaaaaaaatttaagaaaggctaaataccatgaaagtttacatgtattctttaattctagacaccgtacaacagtgacaaccaattacaataaaatcacaattgcttttagatgacagtactttcagatttctaatacccaattactttcatttccacaatgtcaacttcatgctgcattttcatttctatagagcagacaagcttccagactgcagaccaagtttcttgtgtaataatactactatcttgatcatgaccacaggaaaccaattttatattccctgtactatagagatgagacattatttggtgtatatgaaactcttcagtggtggtgttcaagaatattcaaatagtagctgaaaatagggtttgctagagcagtccacatattttattaaaagaaaaatgcccagtcaaaacatttagaaataaa

SEQ ID NO: 1660 - DNA, 551 bp, Homo sapiens
ttatcaattataggttttaaatttaccctggcttttaaagaaatagggttcacttttttctttactacttctatctttctctttctctctttctttctcctttctgtctttgtagatggattttggaaacccagtggaaggatgttcgctcattgcccccatttgccactataggactatgcgcctcccttttatttactcaatttgcttttatcctgatctattatgttgttgtagacccagttccagttgttacaatactgggttatcagttctaaggccctggcaagggtggtgtggaacaggtcccacataactgcccatgtcgagagctctaagcctaaattgggagggacaccagggacaagactcctgggttcatagcctaggggcctaaggtcgcagcatagagcttccttagatccctttggagatactaatacttgggagaggaagtgaaagtctgaagcattagtatctagaaggcagggatcagaggaagtagattcagaggtaaggagaattttggggctacactttcaagaaagttg

SEQ ID NO: 1661 - DNA, 576 bp, Homo sapiens
gtcctcatgagcaagtgcggggtgctggaggtcagcagctgcctggcctgggagccagggacacccatccctttcctgacacctgaggcggcccagctgggcaagaccaggcctgcaggaccagagcctcctgtcacgtggcgcaggggtccaggtggtcaacgctgctctctggaggaccactggttagagcctgcccagctcccctgaggtctggagacagtcaaagcccccccaaacaccccctcccttttgggcgagtggcgtgccttggactccagaagactcgagtggggctgccttgaggccaggtcctgagggggtggcaacacctgaccacaggtgggggcctgggagccagggacacccatccccttcctgacacctgaggcggcccagctgggcaagaccaggcctgcaagaccagagcctcctgtcacgtggcgcaagggtccaggtggtcaacgctgctctctggaggaccactggttagagcctgcccaacctcccctgaggtctggagacagtcaaaggccccccaaacacccccatccttttgggcgagtgggcgtggac

SEQ ID NO: 1662 - DNA, 485 bp, Homo sapiens
aaaaaatcaggagtcagctctgacagtgaagatgatgatgatgaagaagatgggaattaccttcatccctcgctctttgcctccaagaagtgtaaccgccttgaagagctgatgaagcccttgaaggtagtggacccagatcatcccctcgcagcacttgttcgtaaggcacaggctgacaggtccgctcccaccccatacaacgcagacggtgcgcctgtgcagccctcccaggtggagtacacggcagactcgaccgtggcagccatgtattacagctactacatgctaccggacggcacttactgcctggcgccgccccctcccggaatcgatgggactacttactacagcacccttcctgctggcgtgaccgtggctaactcccctggagtgacgaccaccggcccaccaccttctgggaccacaccaccaccggccccaaccacagcagagattagcagcggggccacctccacaaccac

SEQ ID NO: 1663 - DNA, 548 bp, Homo sapiens
ggtagatgtgctcctccttgaaggctgcgacctttccttcctcctgcgcccagtccagcggctcatgcgggccatcgttgccaaagcgctggttgtacttctcgaagtgcaccctctccaggaccaggccgagtccgggcgccttgggcacgtccaccttctctgtgccccagctgcgctccagcacgctctcaggggcataacccttcacaatggccaccaccaggccgaccatcttccggatctgatgcatcatgaagctctggcccttcaccctgatcaccgcaaactccaggccctcccgcacaaagggttcctcgcagtacatctccaggatgtagcggcaggcactgggatcctgcggccccttctgcgaggtgaaattgtggaagttgtgcgtgcccttgtagcaggccaggagcctgttggcctgctgcagcgtctcggcgctcaggcggtaggtctcatcctgaacgtcccggtccttgtgcgcaaaggcaaacgtgggcagcaggtagcaataggtcctggcatcacatctgttcttg

SEQ ID NO: 1664 - DNA, 422 bp, Homo sapiens
cagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccaga

SEQ ID NO: 1665 - DNA, 557 bp, Homo sapiens
gacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagtagaggcaccgtgttctctcagccctggacacgtcttgtaatctttcacactttattcctaaaacgtgtcttatttttatgcagctcattttttctttaaaggagaaaacttgtaggtgtttaagaattggttttgggagggcg

SEQ ID NO: 1666 - DNA, 486 bp, Homo sapiens
cagtgcagtaggggttgagactgaccactgtccccagacggatatgtgatttacccagctccacgtgtgggaagaccaacctctcccctagtgctgtggtgccgcctttgccgtcagtcacgggaggggcgacgtggctgtttctggactctgctctgtccgtcatcccatttgcatgccggtacgattgcaactgccacgtcctatgccaaggcctgagaccggctcgtgtaaaccctccagcttgttattccaggcggcctcggctatttttggcacgtaagcagcacagggaggcccccaacagcagcaaccgagtcttcgtgtactgcgcccttcctggacttaagctccggggaaggggtctggggcaaaccacgggtgggcgcctccaaaaggaaacctcacctactccgtcttaccgttgcactcacgaggatcccgaattctcgagtggtagtagtagacgacccggggaattccgga

SEQ ID NO: 1667 - DNA, 622 bp, Homo sapiens
tggaatggcggccacgggggcaagtgcacttgtggtggtggttgtggaggtggccccgctgctagtctctgctgtggttgggggcggtggtggtgtggtcccaggaggtggtggggcggtggtcgtcactccaggggagttagacacggtcgcgccagcaggaagggtgctgcagtaagtagtcacatcgattccgggagggggcggcgccaggcagtaagtgccgtcccgtagcatgtagtagctgtaatacatggctgccacggtcgagtctgccgtgtactccacctgggagggctgcacaggcgcaccgtctgcgttgtgtggggtgggagtggaactgtcagcctgtgccttgcgaacaagtgctgcgaggggatgatctgggtccactaccttcaagggcttcatcagctcttcaaggcggttacacttcttggaggcaaagagagagggatgaaggtaattcccatcttcttcatcatcatcatcttcattgtcagagctgactcctgattttttttttctcgtcactttttgtttctgccaagacagtgtagcgtccctctttcatggctttctggatgaacttatagtacgggttgaggtagtggtccaagcg

SEQ ID NO: 1668 - DNA, 497 bp, Homo sapiens
gtcaggtaacatatacggggaagtccaagggagagaatacagtcacgggttgttagtttctgttcctgattgggccagtaaagcccttcctcatccctcttttccgcttaccactagggagagaaactaaataccacagcttcaggctgctaagcacctaaaacaaaacaaaacagaacaaaaacaacaacaaaataaggcaagttggaagaacttgtaagtaaacagcaaaggaaatgctaggagaaatttacaaaagcacaacagaagaaggaacattaaagtagcactcaattccttcacaaaataagcaagtaaagtcacaaggacagagtctgacctaaaaggtatggaatcttacagcaaaagagtaagtcttatttatacctttcagagacaccttttcaagtgccaacatgtctgcaataattgactatgttaggccatgaggagaagttcaaggaggatccaaaattctcgagtagtattagtagtag

SEQ ID NO: 1669 - DNA, 366 bp, Homo sapiens
cactcgtctggtcagagcaggtttgcggtcaccctctgggtcccaaccccggccacccactcctcaggcttcgctctcctaggggaggctcccagatcactgggtcttcctcacctgcctcggtggaatcccggctgttcgcagccgcactggatgaagctctcgtctcctctctggttcctcacaggtgtcggtggacttcggggaaggcaggtgcagcctcctgcgttggctccatcacctctggccaaggccatggcacacactctgcccgcgttcctctgcactcccaggaaggcgatgcccccggccccagcctcggagaagtggacacgaagccccacttgctctttgtggccggttcca

SEQ ID NO: 1670 - DNA, 476 bp, Homo sapiens
caagatcacgttctcccaagtaccattcgtcatccaagtccagggctagatcacactcaaaagcaaagcattctcttcccagtgcctatcggacagtgcggcggtcgagagtcacagcctccccagggacgctgagcgcggagccctgtcagagcagcgcgtcagagacagcggcagccgatccatgaagttatcacgcagcctctaccaccaccagatttgactccgcgagctcttttgagggaaaacctggtaaaacgtcgaggtcccgctcccggtcccctcggaggagagcccactcccctgagagaccgagggaagagaggagtgtgcccactgcctaccgcgtgagccgcagccctggggccagcacgaagcggacccgctccagaagttccctctagaagaagaagaagaggcggtcccggtcgcggaccaagtccaaggccaggtctcagtcggtgtcacccaccaag

SEQ ID NO: 1671 - DNA, 471 bp, Homo sapiens
gtttacttggaaataatttcaaacctgcacaaagctgagggaagtgagaggccagagctcctgctggccagcgcccagcagagacgcccctgcacagccagcgcccagactcacgtggaagcccagcggtctccctctctggccaacttggatctggaacaattctgcaccttgtagtgacacgccccagcacatctgggcccccaggcctcgcatgccagggcccctggtgaggttctttactttgagtcatccaagtcaggagcacgccccagcccggggaaacccgtcccaggactggctggtgtggctcgctgcagccatgagcctggctccctgccgaccttcggctcagccagaggcccgctctgtgcacctcctgcagcaacaggcctccctgggtggctgacagggtgcacacaaggcagacggtgccagtgcgaattaagggatgtcacccaggcccctgag

SEQ ID NO: 1672 - DNA, 463 bp, Homo sapiens
ctctgatatttgatagctttttttgtttcttctttagcgtgttctacatagtctgtggcattcataacatttctttctatgttgttgatcatttcaccctgagtctccacaaacatagccatgtccatggacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagctttatccctgaaacagacccgtctgtccccgaagaaggcgccatttccactgccacagccaactgtccccatagacacccctgaaaagagtctggggcaatagggccgctgcctctgctcacagacaaggagagatgtgaggagccatgaag

SEQ ID NO: 1673 - DNA, 445 bp, Homo sapiens
gtcagctccttgcctgacaactctacacttgcaacaccatgcaaagaccaggtcatggcctgagcgatcccatatcctccgataccgtgcaaagaccaggtcatggcctgaacaatcccatatcctacaataccatgcaaaggccaggtcatggcttgaacgatcccatatcctacaataccatgcaaaggccaagtcatggcctgaacaattacatatcctccaataccgtgcaaagaccaggtcatggcctgaacaatcccatatcctacaataccatgcaaagtccacatcatggcctgaacaatcccatatcctggtgtcaccatgcaaagtccaggtcacagcctgaacaatcccatatcctcctagctctttcccatttatacggcggcatcttgcaaaagttcccctgccacacccctaaataccaaacatacttgga

SEQ ID NO: 1674 - DNA, 467 bp, Homo sapiens
tttttttttttttttttttttttcttttttttttttttttttttagaaagtaccaggttttattatctttttatcaaaaaaaatcagtaacagacaacagtgtgagaggtggcaggtgcattgttcattctcttggatttccaacgaacatttattatgcttttctgcaattgttactttccttgtctatcttggaaatgaagaaactgggttctcatctctgtgtctccactgcttagtttctttttctttctttctttctttcttttttttttttgaatagtcactctgcaattggggagggtcgcaagattaccttgttcaacaatttgttagaagaactaaccaaatgtggcaaacctggtttcctccccatcccagtttattatagcgaaatgatcccgtttaaaatcagcaccaaaaaaaaaagggggcttagggtaggacctttgggaccctgggggtag

SEQ ID NO: 1675 - DNA, 351 bp, Homo sapiens
catctcaagccacagagcaactcacggggtacttcacacctaacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaaaaaaaaaaaaaaaaaaaaaaggagaaaaaaaaaa

SEQ ID NO: 1676 - DNA, 416 bp, Homo sapiens
ctaatataaacactaacaccgacatcaatactaacaccaacaccaatccagcactgataatagtatgaacactaacacgagtcctaatatagacactaacagcaacaccaatactaacaccaacactaatccagcactgatgataatatgaacactaacatgagtcctaatataaacactaacagcaacaccaatactaacaccaacaccaatccagcactgataataatattaacaccaacacgaatcctaatataaacactaacaccgacaccaatactaacaccaacaccaatccagcactgatgataatattaacaccaacacgaatcctaatataaacactaatagcaacaccaatattaacaccaagactttaaataaattttagaatgcaaaaactcggaaaaaaaaaa

SEQ ID NO: 1677 - DNA, 175 bp, Homo sapiens
gttggatgtgagtgtgtttactagatcccatcagcgttggatgtgagtgtgtttactagatcccatcagtgttggatgtgagtgtgtttactggagtccatcagcgttggatgtgagtgtgtttactggagtccatcagcgttggatgtgtgtttactagatcccatcagcgttg

SEQ ID NO: 1678 - DNA, 686 bp, Homo sapiens
ccctatggtctttgactaacatacaaacattttaaacgtgggctgtgcttagctttccattttgcagagtgtgtgggtcctgggaaggctccctgcatgggccatcctgcccctggcgcggccgcagcccctgccccagcctgtgctctctgaggaggcccccgaggtccagccctgtctcaatgctttcacatgcagtgtggccaggtacagagtgtggctgtggttatgtgcttctccaattcatctgacctagacctcccgatctatttccacctacatgtcaagacacaaaaaagacaaaagtcaaggaaccgctgccatcctcactgctttccaaagctgcatttcccgtgcacgctcctcagttaggctcactgccgctctgttcttcacccccacttgctcgcagacgattacgggcgagaccgcccttctccagacttctatgaagagtcagaaactgaccctggtgccgaagagctcccggcccggatctttgtggctctctttgaccacgacccgctcaccatgtccccaaacccagatgctgcagaggaggagcttcccttcaaagaaggccagatcatcaaggtgcgggatggctgcctgcgggcgtcttcatcagcccctgaggcgggtctgggtcatgggggcagagactggcaacagggtatcgacttaga

SEQ ID NO: 1679 - DNA, 306 bp, Homo sapiens
gagagctctcagaatgtgctttggggagagtagggtggggaggctggaagcagagaggcccgagtcaagtccacagcaaggggggcctgggcaagagtgcacagagcagcgggaggccccagagggactcaggaagctgcttcctgggctccacagttgggatgagggagagcaggagagagggacaaagagactcccagggtgacggataagcaaggggagaggttagcatggtccgtgtggtgatggaggagggctggagacgtcagtgtgaactcacgtgcagctgaacatagctacaggtgg

SEQ ID NO: 1680 - DNA, 175 bp, Homo sapiens; identical to SEQ ID NO: 1677

SEQ ID NO: 1681 - DNA, 175 bp, Homo sapiens; identical to SEQ ID NO: 1677

SEQ ID NO: 1682 - DNA, 81 bp, Homo sapiens
ctttgtcttatttatggagaaggatctgaggccattaaactgcaaatcccaaccgaaaacgaagaagcaaaagtttctttt

SEQ ID NO: 1683 - DNA, 227 bp, Homo sapiens
tccttacgttggtattatacaatataacgcaaagggcaggaaatcacacaaaattcgctttaaaatagacaaagggtccagcactatcaagagaacattcaaccaggggcagcagggccttgtggtagcgtgggacgcagccctcacggtgctggaacatctcgtccagggcagccgactgcaccatctgcacagcgtggctgaagatgagcctctcggcagtgatg

SEQ ID NO: 1684 - DNA, 564 bp, Homo sapiens
tgacggatgagtcttttaatagaaaaacacacgtgcaacagtatcaacacacactcacaaactcagacacactcaagctgtcacactcacacacactcactctcacactcacacactcgctctcacacactcatacactctcacacattctcacacacacagtcacacacactgacacaaacacacactttcacatacacacacacacattcacacaaactcacatacacattcgccgcctgtgggttctatttctctggagaaccctgcctgatacaggcgtcatgccatgttcccaagaggaagcccgaggctggaggaccctgagctttgagcccaccgctgcatggttcacttcctacaaaactgctctccccccttggaagagtactttcaaacaggacgtatcactttaaacacacgggcatgagagcggtgtctgtagaagttgagggtttttataaaccaattgtgcatgtcctgttagagcctgctggaaaactcacccatacaggggccctttgtgtgtactgtgggacgcagagcaaccctggtgtgggcacg

SEQ ID NO: 1685 - DNA, 460 bp, Homo sapiens
tgaacgccctcctgctagctgactttgagtactggtgtggatgatggtgagtctatgaatgaacgccctcctgcttgctgactctgagtactggtgtggatgatggtgagtctatgaatgaacgccctcatgcttgctgactttgaccactggtgtggatgatggtgagtctatgaatgaacgccctcctgctcattgattttggatactggtgtggatgacagtgggtcttatgaatgaacgccctcctgcttgctgactttgagcactggtgtggatgacggtggacctatgaatgaaagccctccgtattaggaatcactgtggatcagtcaagaaaccaaaagggaaaaagtttttttttttaaagattggcaaatatattgtcttccctttagcctaagggtttaattcttctggggttgtatattttggggtgggaaatagcaattaagtgaaa

SEQ ID NO: 1686 - DNA, 175 bp, Homo sapiens
caacgctgatgggatctagtaaacacacatccaacgctgatggactccagtaaacacactcacatccaacgctgatggactccagtaaacacactcacatccaacactgatgggatctagtaaacacactcacatccaacgctgataggatctagtaaacacactcacatccaac

SEQ ID NO: 1687 - DNA, 305 bp, Homo sapiens
gaaaataactttatttcattgtggggagcgggccgatgtccagcctcagaacttctggaactgcttcttggtgccggcagccttggtgaccttgagcactggtgtggatgatggtgagtctatgaatgaacgccctcctgcttgctgactttgagcactggtgtggatgatggtgagtctatgaatgaacgccctcctgcttgctgactttgagcactggtgtggatgatggtgagtgtatgaatgaacgccctcctgcttgctgagtttgagcactggtgtggatgatggtgagtctatgaatg

SEQ ID NO: 1688 - DNA, 451 bp, Homo sapiens
tacatgcaaaagccatggagactccagtttatgggagatctcaggagttttcaaaggtcattttgatcatctatcatttttacctatgggctcaccttataactcaagcaccatgtatcatgtgaccctccaatatgtctggcctgatgtttcttacaatcatttcaaggctgcctggtcaggctattagctcagttcaagggaagagccatatgtctttctttttagtactccccattgtgcctggcatgatgctggctttgggtgggtttgataaaagtacatgataaagagacttgattgatggtggggttggttcatggtggggttggttgatggtgaggtttgctggtggtaaagttgggtgaagataggggtgggttgacagtaggttggtttgaaggtaagattggctgaaaataaagttgggtggatattggttgggtgatga

SEQ ID NO: 1689 - DNA, 110 bp, Homo sapiens
tctctctttctcaatctctctgttaccctttgtcagtctcttccctcccccagtctctcttcacaatcccccttcctaacacacacacacacacacacacacacacagaa

SEQ ID NO: 1690 - DNA, 502 bp, Homo sapiens
gggagcagaggcagctgcctttattgggggccatgggctggctgattcagtcaaaggccacacatttgatcttgaagtcaccgtcagctgccatgtagttgatggcctccaggttgaggcggttggggaacttgaattcgtatccatctggcagcttgacggtcaggttggcctggtcgaaggtgatgcacacctctgcaacacttccaggctggaagggaaagacagcctcccgctgctcggtcccccaggccccgccgtccttgctgttgcacacgatggtgttggcgtcgccgtgggcgttgaagcgagggttgaagtgcaggcacaggttgttgctgtctttgcccaggttcagcacgaagctcttagcgtcaggagccacctcgcctcgcactcgaaggcactctccaggtttgagattcaggttgctggcgaccagaccacaagccatgattgagtccaggaggatgttcccgggcaggcgcaccagctgtcagaa

SEQ ID NO: 1691 - DNA, 300 bp, Homo sapiens
tcactctttacccttatataatttttaacaatctaagaaaagaaggaatcagaaaaaaaaacacaaatattttttatttctcccattctttaaaaaaactaccagaaattgccccctttaaatttcaaaattttcctaattttactgtgccagcccgactctcatacctcactgattatatcattcccacacctgatgctccaacaacccagggtatacttttagctcagtcctataaaaggcttcataacctgcactgatctggattcgacgcagctgcctctgctccctctgaaaaaa

SEQ ID NO: 1692 - DNA, 295 bp, Homo sapiens
ataatctaacatatgtgtaattggaattgtagatgtagacgtgagaaaataagacagaaaaaagtttgaagacataaagtctaaggatttaaaaagaaagaaagaaagatattcaattacagacccaagaagctcagacaatcccaagcaagataaatatcaaacacacatacccctagaaacatttagacacattatcatcacactgccaaaaatcaaatataaaagcaaaatcatgaaggcagcaaaaggaaaaatatacactatgtacagagaagaaaaaatcagaattaca

SEQ ID NO: 1693 - DNA, 366 bp, Homo sapiens
ctgggattacaagcatgagccaccgtgcttggccctaaagtgcttcttaaacatactggattatacgtttactaggacacttagaggaaaagacttttacatcttggttattcccagtgacctgaaaataaacagactgttcattaacctcctggccaccaaccagcctagtaagtgctatataactgggtgatttgcaagagaataaaattggaatttccttcttcctttaaatatgcagcaagaattagttgaaaacacatatcagatcttctgtgttctgacaagagagtaaagagataagattaactgctaaaaatgtctctccactttatctttaggtttaataatttagagtttgaactg

SEQ ID NO: 1694 - DNA, 434 bp, Homo sapiens
tatttggccttggacaaaaacctagccactctctgcctccgtctcttcaactcttagtggaagaagtaatagtccttacttcaaagagctgtttatgaatgaagtgagtaaatactcagctagccctagaccacatacaggaaagggtccatctctgttagctgttattatttataacatggcatgactgttagtatttgcatttgcattagtgctggcatggtgtcagcattgttggtgttagtgttcatattaatattagttttagtttaagtgttagtgttggtattggtgtttgtattagtgttggtgttagtattattgttagtgttggtgttggagttagtgttagtgttgggacatagcatttgcgttggtgtcagagatggtgttggcagtgacattagagcttgccttagattggtgttagtgtc

SEQ ID NO: 1695 - DNA, 397 bp, Homo sapiens
gggttgtcggcaacaccaggacctaagagaacaccatggaacagtttctcgctggatccttcacagggagcactgccctgctgacaccctgatttcagacgtgtggcctccaggaggctgaggaataaaattgttctaagccacccactgtgtagtaatttattacagtggccctagggagctattcgcgggggtgaaaggcagtgggctgatgcaatttctatacttcagccaaagcaacgcacaacaggaagacagaaatgacgcgacacatctcagtgatgcagactacgtggatccacagtgatggaggagatgttctcaggagtacctagaggtgacatcagtgatgcgggctacgcagatccacagtgacggaggaggcgctctctctcgg

SEQ ID NO: 1696 - DNA, 175 bp, Homo sapiens
gttggatgtgagtgtgtttactagatcccatcagcgttggatgtgagtgtgtttactagatcccatcagtgttggatgtgagtgtgtttactggagtccatcagcgttggatgtgagtgtgtttactggtgtccatcagcgttggatgtgtgtttactagatcccatcagcgttg

SEQ ID NO: 1697 - DNA, 329 bp, Homo sapiens
tgtgtatcgggtgctgccttagctgagtatgtcttctgtctcatgtgtaccaggtgctgccttagctgagtatgtcttctgtcttctgtgtattgggtgctgccttagctgagtacgtcttctttcttctgtgtatcgggtgctgccttagctgagtatgtcttctgtcttctgtgtatcaggcgcagccttaggtgagtatgtcttctgtcttctgtgtcccaggcgcagccttagctgagtatgtcttctttcttctgtgtatcgggtgctgccttagctgaggatggtccactgtcactgtttctctgctgttgcaaatgcatgga

SEQ ID NO: 1698 - DNA, 175 bp, Homo sapiens
gttggatgtgagtgtgtttactagatcccatcagcgttggatgtgagtgtgtttactagatcccatcagtgttggatgtgagtgtgtttactggagtccatcagcgttggatgcgagtgtgtttactggagtccatcagcgtcggatgtgtgtttactagatcccatcagcgttg

SEQ ID NO: 1699 - DNA, 667 bp, Homo sapiens
aaaaaaaagcagtcaaaatgtaagggagctggaaagcagtctgcatgtggaacaactcaagattaaagctaagcattctcagcatcatagcaagtgtatttaagggggaaatttccagttattctcaaattgttaaaggctttcagaaaaatctaatgttttaatggtcacaatgatctttacctctacaggtagacactaccttgttacagatagggaactgttccatagagttaaatttgcaatcctgagtaaccatttttttaagtcatttattaatgaagactgatacatagaatgtttaagaaattatatttaagtattttccacaattgatttgtgtgttgtggcaacattataaggaaatgtttcttaaacagtttcagcacaaatttttgtaccaagttttaattcaataaaatttgctgtatatgttgaacagagctgttaagacttccttttactttctcttcaccttgtgacttggctgttcctcctgctgttcctctctgccgtccacggccaaataattccccctctgctggtggcggctgaggcctaagctgaatataaccaggttgctgactctgtagttacatgcaaataaagaacactcttttcgtcgagcggtcagacaccagagaaaatttctagtcttaagtctcag

SEQ ID NO: 1700 - DNA, 788 bp, Homo sapiens
ccagcactgatgataatattaacaccaacacaaatcctaatataaacactaatagcaacaccaatactaacaccaacaccaatccagcactgatgataatattaacactaacatgaatcctaatataaacactaacaccgacaccaatactaacaccaacaccaatccagcactgatgataatattaacactaacactcatcctaatataaacactaacaccgacaccaatactaacaccaacaccaatccagcactgataatattaacactaacactcatcctaatataaacactaacagcaacaccaatactaacaccaacaccaatccagcactgatgataatattaacaccaacacaaatcctagtataaacactaatagcaacaccaatactaacaccaacaccaatccagcactgatgataatattaacactaacatgaatcctaatataaacactaacaccgacaccaatactaacaccaacaccaatccagcactgatggtaatattaacaccaacacgaatcctaatataaacactaatagcaacaccaatattaacaccaagaccagttcagcactgataataatattaacactaacacgaatcctaatataaacactaacaccgacaccaatactaacaccaacaccaatccagcactgatgataatataaacactaacagcaacaccaatactaacaccaacaccaatccagcactgataataataataacaccaacacgaaatctaatacaatcattaaaccccaaaaaaaaaaa

SEQ ID NO: 1701 - DNA, 728 bp, Homo sapiens
ttttttttttgactaagcaaaatttgtacttgtttaataagaaaatcacttctttaaaaaaatagttctttacatgctgaggttcatctatgcaatgcaagagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtccccctcactgccttccaggggactgggcaccttggcgcccgtgccacctgccgtgagagcggtggcactgaagttgtggatgggcaaggtgctcagccactgggccatggagcgttcgtcccgctcggtgccgatgatggtggggtagatgtgctcctctttgaaggctgcgacctttccttcctcctgcgcccagtccagcggctcatgcagcccatcgttgccaaagcgctggttgtacttctcgaagtgcaccctctccaggaccaggccgagtccgggcgccttgggcacgtccaccttctctgtgccccagctgcgctccagcacgctctcaggggcataacccttcacaatggccaccaccaggccgaccatcttccggatctgatgcatcatgaagctctggcccttcaccctgatcaccgg

SEQ ID NO: 1702 - DNA, 395 bp, Homo sapiens
ttttttttgtttttaatcaactttagacattatctaaggactctcagctatgcagactgtcactaccaccctttccaggtctccttaaattgttgatggccatatacttactttaaattccttaactggtgagatatatacatgtatataacaaacagcaatctctacttcttgacccatcaatgctaaattttatcttgtgatggctacgtgacagatgggaatataagtgcttttgatatattttctgccttccttttctttcttcttcaggcagcttacctttgggttgatcacacaaagtttaataagatttattgtttggcatcctggatccgaaactttctgcttaaatatacattgattctaaaagttgaaaattagtataacatgag

SEQ ID NO: 1703 - DNA, 607 bp, Homo sapiens
tgtgtatcgggtgctgccttagctgagtatgtcttctgtctcatgtgtaccaggtgctgccttagctgagtatgtcttctgtcttctgtgtattgggtgctgccttagctgagtacgtcttctttcttctgtgtatcgggtgctgccttagctgagtatgtcttctgtcttctgtgtatcaggtgcagccttaggtgagtatgtcttctgtcttctgtgtcccaggtgcagccttagctgagtatgtcttccttcttctgtgtatcgggtgctgccttagctgagtatgtcttctgtcttctgtgtaccaggtgcagccttacctaagtatgtcttctgtcttctgtgtatccggtgcagccttagctgagtacgtcttctttcttctgtgtatcgggtgctgccttagctgagtatgtcttctgtcttctgtgtaccaggtgctaccttagctgagtatctcttctgtcttctgtgtagcaggtgctgcctcagctgagtatgtcttctttcttctgtgtattgggtgctgccttagctggtatctcttctgtcttctttgcaccaggttctgtcttagctgagtatgtgttctgtcttgtgtgta

SEQ ID NO: 1704 - DNA, 673 bp, Homo sapiens
gcaatgctgtcccacagacctttctgcagtaatagggacgttctctagcatatgaccatctggttctgagtcataccttctttgaaaccccacactccatcttccttagggacggttggaggatgacagtttccagggactccagataaatgtgttccaaatatgagaaagttgggcaatgctaagtgttggcaagaacgtagagaaacggtagctcttctgcgttgctgttgtaactggaaaaacttgctcgaatgaagtgcatgtgtcccctatggccccgcaatccacttctgagatgtgtcccagaacaattctcacagaggaccagagggcacatgggcaagaattttcactgcagcatcgtgtgtggagcagagttttggagacaacccggacccctttgctggggagcaggtgaatgaaacatggcggatgaacactatgggatactacgcagcagctagaagcaactaacctgaaatgcacacaggaatgtgaatcagcctggggaagcacagggccatatgagaaaaggaggaaacagaacaaggtccaaggtgcctctcaagtccagaattctagaacaggtcattcctttcaaagtagaacttaaggaagagtttaacttgcaaaaaaaaaaaaaaaaagaaaaaaaaaggaaaaaaaaaaa

SEQ ID NO: 1705 - DNA, 354 bp, Homo sapiens
ttcaggcagcacctgtatttccctagggactctgtttataatcattcatagatagttatggataaagttagaatatctttccctcttttgcttaatatttattaaggacttactatgtgttatatatctgcgctatgtgttttacataaaatacatcatcacaatgaccttcttttgcagatgaagaaacaaaagctctgagaggtcttcacgaacttgtctataattacagaggtaataacgattggttggaaatgaaaccaagggctacctcctgtccccaaagctcatgctcttaaccccttcaccatgagtttctggttctattcctagactctaagcatcatatactcc

SEQ ID NO: 1706 - DNA, 637 bp, Homo sapiens
tgtccaaaatctttatgaatagaaacaatgctaactgtaatttccaacatctttttccttctcagaattctgtactggttaacttggtcagaacgcagagttttggatagatgcgtcaaatccaaatacactttggggcaaatgaaacattccgcttggtgtagatgaatgtctgcattaagatcctcctgtatgtcttcatcagttaaggttctttggttgcaagcaagagaattctatataaagttgtttaagaagtccaacatgagaatataggactactacattatggaatctaaggtggggacataggggcactccaaaaacaactaaaatttggagctccaaatgggcagggctctctccctcctcatctctgctcccttcagggagtcacttcatttctctctttctctagcagctccttctgttactctaccttggaataatatgcctgccaaatagggtaacgtgccagcctgccttcattccttcagaaatatatatggattgcctatcatgtgctctgtaatattctgggagctggaactagtataggaagagaaaaaggaaaataacattattgctctgtgaaccttatcttccagtggaagagacagacaatactgaaaaaaaa

SEQ ID NO: 1707 - DNA, 574 bp, Homo sapiens
tcaagaccaagcagatcctctgtgacctagcgaaagcagggcagaaggaatggtgtagggctggtagtttcggggacaggtgaagccatgtggtttccagagcccacaatggaaagaaatctgctcattttctttttgacgggcagtgcctcagcatttttctgtgcctctgaacccatccaactgtgtccaaggcgcgggcctctttgcctctcttcagcttgaatattaagccctcattggagcagatggagctggtatttctgtaacacaggattgccctcaggggaatcttttgctccgcaaatgagaagcagcatctggagaagggtacctgcatgctcttgctgtccacatcttccggccacatcccagctagcagcaagcaccacgacatcatcaaatccatgacatcatcaaccccatgacatcatccacactgcatcaccaacaccaggacatcagcaccatgacatcatcaacactgtgacatcatcaacaccacatcaataacatcacgacatcagcaccatgacgtcatcaacacaatgacatcaccatgacaccatcaaca

SEQ ID NO: 1708 - DNA, 546 bp, Homo sapiens
cacgaggtgtgttttattttcattattcatacaaataattttctataatatcccggggcaaaccggagaatttggcagtccgattgggggggggggaacagaagttctgctgcttggaggcaaagttcatactagttcattttccgggctctgtgaagacacagaccactctgctccctgaaagtgtgcctcacgaccacgaacggaccttcagtggccctttaagagtgccaagagacacagctccagacaggctggtctccctgagaaggctctgtcctgaccatcagagagcaatgtggatgctgggatgtggggtgggtaacagtgtcctgcccctcctttctggaccccttagtatccttcaaaggaggaaggggtagagttggaggctgccctgggcttcaggatcccccttcccctgaagccgtccagggttgactattcctggaagagaaagaggttgagaaaaggggttaagtgacacaagtaagtctagcttttcctttttttctttcttttttggtttttgagacagagtcttgc

SEQ ID NO: 1709 - DNA, 156 bp, Homo sapiens
cacacacgctgcaccgctgacaacacaggacagctgcctataaaactagacttctgacgctgggctccagcttcattctcacaggtcatcatcctcatccgggagagcagttgtctgagcaacctctaagtcgtgctcatactgtgctgccaaagc

SEQ ID NO: 1710 - DNA, 400 bp, Homo sapiens
cttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaatgcagttgattccttgagtttcatatataagactgctgcagtcacatcacaatattcagtggtgaaatcttgtttgttactgtcattcccattcctttacgtttagaatcagaataaagttgtatttcaaa

SEQ ID NO: 1711 - DNA, 454 bp, Homo sapiens
tgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttgtggaacgcagttgattccttgagtttcatgtataagactgctgcagtcacatcacaatattcagtggtgaaatcttgtttgttactgtcattcccattccttttcgtttagaatcagaataaagttgtatttcaaatatctaaaaaaaaaa

SEQ ID NO: 1712 - DNA, 175 bp, Homo sapiens
gttggatgtgagtgtgtttactagatcccatcagcgttggatgtgagcgtgtttactagatcccatcagtgttggatgtgagtgtgtttactggagtccatcagcgttggatgtgagtgtgtttactggagtccatcagcgttggatgtgtgtttactagatcccatcagcgttg

SEQ ID NO: 1713 - DNA, 513 bp, Homo sapiens
  misc_feature (1)...(513): n = A,T,C or G
cttgtcttggtttattcaggctgtattgagattgggaggatgggcaaaaacctgggggtggtgctggatgctctggggaggtgctgggtgctctggggatgatgctgggtgctgtggggaggttctgagtgctctggggaggtgctgggtactctgaggtgctcctgggtgctctgggtcatgctgggtgttatgcctgatgctgggtactctaggaaggtgctgggtactctaggaaggtactgggtactctggaacagtgctttggggaggtgctgggtactgtgcggtggtgctaggtgctctggggcggtgctgggtgctgtggggaggtgctgggtgctctagggaggtgctgggtactctaggaaggagctgggtgctctggggaggccctgggtgctgggtgctcggaggaagccctgngtgctgaatgctctggggaggccctgngtgcttcanggatgtgctgggtgctctggagagtctgaggagacgctggggtgtcaggga

SEQ ID NO: 1714 - DNA, 535 bp, Homo sapiens
gtgtatttattattcacagttaatcactacctaccaaatgctacccgcagagttaaaggattaagtacataggtctttatttaaacactgatttttttttaaatatatacacacaaaacttagttcagcaaggcttcatgatatacaccaattccataataaaacaaatgctatgtcccaacactaacactaactccaacaccaacactaacaataatactaacaccaacactaatacaaacaccaataccaacactaacacttaaactaaaactaatattaatatgaacactaacaccaacaatgctgacaccatgccagcactaatgcaaatgcaaatactaacagtcatgccatgttataaataataacagctaacagagatggaccctttcctgtatgtggtctagggctagctgagtatttactcacttcattcataaacagctctttgaagtaaggactattacttcttccactaagagttgaagagacggaggcagagagtggctaggtttttgtccaaagccaaata

SEQ ID NO: 1715 - DNA, 578 bp, Homo sapiens
tttttccatctttttctttaataagggtaacacatgaacagtccacattgaaagatatccaaacaacacagaaatacatagagctcgttaagagttcctttgccctttctccccattcatcagctccccacagctaccaaatttggaattcatttttctgggtttctttccatacatcagaacatgcattctcagtgagggcgatatctccaacaagggagtgaaaattagttattggaagaagggtgaaaaaacttaggcattacagtgatttgtggcctcccgaagatcccagttcctgaacagatgtacagtgtggtatatctgtgtacagctgtagtattaaaattccatggggaggcaattaggagagaaatttatacagatgttccttagcggggccgtggaaaaataaagatcgggaaacaacagtagaatggtggattggggatttataaccttattatttggtgtttgatgaagcacttcttcagtttttcttgaacttctctcacaagctgaaatagatcccacctgttctagtataggagctttggttcataaggttaaggacccac

SEQ ID NO: 1716 - DNA, 399 bp, Homo sapiens
aaaaaagcctcaaatcaataatctaataacttgccacattaagaaactggggaaaatagagcaaaatatattagaaaagaaaaaagagcctcaagtcaataatctagtaagttgccatgttacgcaactggggaagatagagcataataaacctaaatcaagcagaagggaaaaaataagttttattacattattatatgttgcaaatgatttctggggaagacaattgttagagaaactaagccatctcaacatctttcctgcttagagatcttcggtaacatataatcattcaccaaaaagagaatggttactaatgttcttccccatttgcttactttgcatttgtgcccactctccacccctgctcccctgagctgaaataaaaatacaataaac

SEQ ID NO: 1717 - DNA, 592 bp, Homo sapiens
aaaagtgacattgctttattactattggcaggtggggcctgcatgaggtggttagtgtttatattaggattcatgttagtgttaatattattatcgtgctggattggtgttggtgttagtatcggtgttgctgttagtgtttatattaggatgagtgttggtgttaatattatcatcagtgctggattggtgttggtgttagtattggtgtcggtgttagtgtttatattaggattcatgttagtgttaatattatcatcagtgctggattggtgttggtgttagtattggtgttgctattagtgtttatattaggatttgtgttggtgttaatattatcatcagtgctggattggtgttggtgttagtattggtgttgctgttagtgtttatattaggatgagtgttagtgttaatattatcagtgctggattggtgttggtgttagtataggtgtcggtgttagtgtttatattaagatgagtgttagtggtaatattaatattagtgttggattggtgttggtgtaagattggtgtttggggtagtgtttataattaagttcatgttaaggttaaaattattaatagat

SEQ ID NO: 1718 - DNA, 540 bp, Homo sapiens
tttttttttttttatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacgttcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgctcatactgcgctgccaaagctgggtccatgacaacttctggtggggcgagagcaggcatggcaaaaaattccaagttagggtctccaatgagcttcctagcaagccagaggaagggcttt

SEQ ID NO: 1719 - DNA, 519 bp, Homo sapiens
aaaagtgacattgctttattactattggcaggtggggcctgcatgaggtggttagtgtttatattaggattcatgttagtgttaatattattatcgtgctggattggtgttggtgttagtatcggtgttgctgttagtgtttatattaggatgagtgttggtgttaatattatcatcagtgctggattggtgttggtgttagtattggtgtcggtgttagtgtttatattaggattcatgttagtgttaatattatcatcagtgctggattggtgttggtgttagtattggtgttgctattagtgtttatattaggatttgtgttggtgttaatattatcatcagtgctggattggtgttggtgttagtattggtgttgctgttagtgtttatattaggatgagtgttagtgttaatattatcagtgctggattggtgttggtgttagtattggtgtcggtgttagtgtttatattaggatgagtgttagtggtaatattatgattaatgataaattgg

SEQ ID NO: 1720 - DNA, 503 bp, Homo sapiens
ttccaggcaaagtagaagcaatatattttgcaacaattattctttcaatgaaggacttgtaaattctctcccacaccacgttagacaggtaagtgacgtcacttcgaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttagaaactggttctgaatacagcgtaacatacacagcaattcagatcttaagaaactcaactgttgccagttaatacagtaagtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaaatagctcaag

SEQ ID NO: 1721 - DNA, 748 bp, Homo sapiens
  misc_feature (1)...(748): n = A,T,C or G
tttttttttacagtgagatatggctatgggaagcaggtgatactatttgtttaagaaactgggatgccaactaacacgtggagttccccaagactttgcaatctccatttgtgagtttctgtaaaaaagggaacccagctagaggattcacagagaccttgaatgacaagcgacatactcgaaatctgcagctctcctcccggagggcccagcgtgccaggagacacgctgcagtaaggcacttaccaagctcctttggatagagggaaagaagaaatcaatccaggcaacatgcaagtttcagtgaagtcagacattttatgggaatttaaagtcttgcctgttctcagtgcaccccagtcagttactgacatgtcagcctcagaaaccgcacatggcctcaggaaggtcaggccctcctgctggtgggcacgtcattggctcttgatcgctgatggtctcgatgatggtcatatttcacagaaataatgaggaaaagcaggagggtagctccttgaatagcagccagaaggaaaaagtaatagttcaaatagcagccgttaatattaccaaagtctgtgtgactgctcatccatccgatggctntgatagacaccagtgccagcagtccagaacccacgaacgacccgacgccagagaagaaaaagaacaggcccattatggcactctgcatggacttgggggcaactgagtatgcaaattccaggcctgcgatacttgcagctga

SEQ ID NO: 1722 - DNA, 431 bp, Homo sapiens
ggactattcatccaaccaaaaggggagatgtaaataattatagcagtgcagagtaggtcaatagacaccttggagaactcactctgttcatgcaaacctggatatatctgcatagtcttcctggagatggtgacgttgaagctgagtgttgaaggatgaagatgagctccggaaacaagccacaggggaaggatggaaagagcattcaagcctaaggaaataatacatgagaacaagtaagcaatgagcagagtgaatgggaaactgcaagtcattcatcatagtcagaagtctgtgtgctgttccctcttggagcctgaagggcctgtcgaacagtgtcttctccagggaatgtacctaataagtgtgtgttaagtgaatgagctaatgagtgaacattattggcaagtgttattataggtgatagagga

SEQ ID NO: 1723 - DNA, 708 bp, Homo sapiens
cacattgaagtatgaagcacggggggggtctatggaatacaattcaatgagtaagatcagggcgctagaggttgcaaatcacttgatatttaccatctcgctttgttttcacagcaagtctgccgagtccgtagtcttgtgactagttgacagatggaaacagtgaaggcccagagagattcagtcacttgctcaaggccacaggctggtaagttatggaaccgggattcacattcacacacgaatccacgctcatgaagattctgcctggcatcacgaagtacagtgtgagcgtcagcaccatttgctaggcttccctccatgcctgtatcattttaatgtctgtagtagagtcaaactaaggtgatatagatgaaaaccaaggaattcacaaagctaggcaaatccacaaagcagtatatcaaattaagacaaaagtggattcaattgagaaaaacagagttaggtgttcctggcatgcaaacttttttttttaagttaaatagttgacaagaaggatattacctgccacttctcttctaagttattttatttgacatgaagctctctaaagggcacagaggttgagttgtgtcattaagctatgcattcttcaagtgtcagattttcagatgccatagcttaacctttgcaatgctatagaaccttgttcccagtcagctaagttcttttttaactttcttttct

SEQ ID NO: 1724 - DNA, 455 bp, Homo sapiens
tttagatatttgaaatacaactttattctgattctaaacgaaaaggaatgggaatgacagtaacaaacaagattccaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctctaagtcgtgcccatactgtgctgccaaagctgggtccatgacaacttctgg

SEQ ID NO: 1725 - DNA, 337 bp, Homo sapiens
gtttctgtgaatggcagctgtccccttactgacagattcagctcgtctaactctgaatccaggctcttcccatcaagtgcagagcagaatccacaactacttggtcaggccgacttgaaggactttggactacagtgagtaacttgaaggggatttaatagaggaaattgctttatagttttttgtttgtttgtttgtttgtttgtcattggtgttgaagaaacaggcaatgggatttagggatgacttctagaaaaaccccaaagaagaggcccccccagggagctggtgccttggcttccataaggaaacaggaaaactgggaaacctttctcac

SEQ ID NO: 1726 - DNA, 579 bp, Homo sapiens
ctcacaccatcatgtacacgacacaccttcatgtacatgtgcgttcgcacactgtcatatacacatgcactcacagtcatgtacacatggcacacacaccatcatgtacagagtcatattgtcatgtacacatggcacacacaccatcatgtacacaatcatattgtcatgtacacgtggcacacacaccatcatgtacacatgcactcacacaccccgtcatgtacacatgcactcacacaccatcatgtacacatggcacgaggtcatgtacatgtgcactcacaccattttacacgtgcactcacacacactatcatgtacatgtgcactcacacaccatcgtgtacacagtcatgcacacgtgcactcacacaccatcatgtacacatggcacactgtcatgtacacatgcacacacacacaccatgtacacacagaacacactatcatgcacacgtggcacacacactgtcatgtacatgtaaacaacacaccatgtacaaacatccacgcatcatgtacacgtgcactcacaccatcatggacacacgtgtgctcacacaccatcatggacac

SEQ ID NO: 1727 - DNA, 258 bp, Homo sapiens
cacactaacacccagggagaaacagttcagacaagagggaaagcactggcagaacctgaggtgagagtctgcttgtacatttatgggacatggcccatgtgccatgaacaaggggaagtaataatgatttctctaccttcctgatggctcatgtttgcctgacataaatattgacatttccttctatattccccaagtaaataaatagagctgcgttctgccattgactgtactctaaagagtttctcacaatctggc

SEQ ID NO: 1728 - DNA, 240 bp, Homo sapiens
gttggtttctgttccggagaatgtttccagcaccccttttttcaggtaatattccaggactggctttgtttggtcttcataagcctttagtctcttgataaccgtctctggtttatcatcctcacgctgaatgagaggctccccagtcaggtcatcaatgcccacagttttgggagggttgaattcaatgttatagactcggccactggcgggatgaatccagcgagcagtaaggcgttg

SEQ ID NO: 1729 - DNA, 336 bp, Homo sapiens
caggaagttgagggctccctcatatgtcaggaatttatggagtgatccaagcgtcttaagctctctggaattattttattgatttacatctctggagaatggagcagcctgactacgtttcctgggggaggttttcatctcggctttcaattttcacttgttaatgatctgtcatttgtagctaagtggagatacaagaaataaaatacttcattcaacaaaatagttagggtgcgggtcccatgagccaggtgccattcggggactgggagtatagcagaggacacggtagtcccagcccccgagctgcccagactcatctgaatgagcccagcc

SEQ ID NO: 1730 - DNA, 344 bp, Homo sapiens
tctggagtccctggaaactgtcatcctccaaccgtccctaaggaagatggagtgtggggtttcaaagaaggtatgactcagaaccagatggtcatatgctagagaacgtccctattactgcagaaaggtctgtgggacagcattgctgcaaagctctacccggagcactttgatgattttgctcattcacagagcatcactcacccggatgaccaaggaccgcctagctgagctttgtccttccctgtctgctccctgcatttgagtcccaacacagcagccagaggatgcttttaaactcacatcaggacacttgtctgctccagacctcaatgattcctcac

SEQ ID NO: 1731 - DNA, 622 bp, Homo sapiens
tccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctattagaactattacttttttcttctggctgctattcaaggagctaccctcctgctttgcctgattatttctgtgaaatatgaccatcatcgataccatcagcgatcaagagccaatggggtgcctaccaggctgaccaggaatttcggattctagtactaactagtcgaccc

SEQ ID NO: 1732 - DNA, 344 bp, Homo sapiens
gtgaggaatcattgaggtctggagcagacaagtgtcctgatgtgagtttaaaagcatcctctggctgctgtgttgggactcaaatgcagggagcagacagggaaggacaaagctcagctaggcggtccttggtcatccgggtgagtgatgctctgtgaatgagcaaaatcatcaaagtgctccgggtagagctttgcagcaatgctgtcccacagacctttctgcagtaatagggacgttctctagcatatgaccatctggttctgagtcataccttctttgaaaccccacactccatcttccttagggacggttggaggatgacagtttccagggactccaga

SEQ ID NO: 1733 - DNA, 237 bp, Homo sapiens
ctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattatcccaatagacctaattcatttttaaatgtggaaaatatgcaagataaattaaatgcctagttaaaaaaaaaaaagtttca

SEQ ID NO: 1734 - DNA, 346 bp, Homo sapiens
tttggccttggacaaaaacctagccactctctgcctccgtctcttcaactcttagtggaagaagtaatagtccttacttcaaagagctgtttatgaatgaagtgagtaaatactcagctagccctagaccacatacaggaaagggtccatctctgttagctgttattatttataacatggcatgactgttagtatttgcatttgcattagtgctggcatggtgtcagcattgttggtgttagtgttcatattaatattagttttagtctaagtgttagtgttggtattggtgtttgtattagtgttggtgttagtattattgttagtgttggtgttggagttagtg

SEQ ID NO: 1735 - DNA, 742 bp, Homo sapiens
ttgtgtcttaaagatagatgctctcagaaaaaaaaaaaaaaagaaaagagagacatcctcaaggtgaattaaaaggcacattcctcagaaacctgcagcacaggcagaaacgcaagcagagctggaaatgcttctggaccctgcatcttaggggaatggcattggaagcgatcttccagctggctcaccagagctggtgagtgcagcgtgtgcctctctgggctgattgtgcctcctgagcttcccacgtggccgtctgaaatgtgctgtgtgtccctctttgcttccttcccagggtgggtggacagagatgttgctgaatctccatttcatagggaggggccctggtgccatcaaagccaaaatagcctgtgtctcgtgcccacacgcctacagtgccagcctgatgaccacacaattttcatcactgtccttcccactagagtgaatgttgctgacggtcatctctttggctttgcagctgtggccagggccaggcgaagggaggagcaaagagtccttccatgtgacacaggccatctggacgactgtcttttacaccttattgactgcaattcacagcaagaaatagagtattcgacattactccctaaaaggcacacagatgcacatgggcacacacacatgcaaggcagttggaccaaagcctaacctcagaaaacaaggcttacactgctgcattcacatgtaacctattttagcattttccatttaatcccac

SEQ ID NO: 1736 - DNA, 179 bp, Homo sapiens
gagcgttttcatcaccaagcctcctgatggcagtgccttcaccgatatgttcaagatactgacgtattcctgctgttcccagaagcgaagtggagagcgccagagtaatggatgcagacaacatatgctttacagagtcttcatttgaggattccagaaatttcaaatattacaaccac

SEQ ID NO: 1737 - DNA, 599 bp, Homo sapiens
tgtgctgagttaggtgtttccctgagttatcaaagaaaatgcctcctaagcagctttgaccatggtcctctttttgtttcttctttatagtttaagtcagaggtaatctgctacttgtcgacatcagccctcttggaaaacgaatcaacactgcttagtttgaaatggccttaagtaatctgttcacatttcagctggtccctgatacatttcttggtagatggaattgatcatgtactgaagcaaatgtggtgccaccaagtgtgctcaaggttcaccttactctgtttatactccacaacacctggacaaggtaagaccccaggaactgaggcccagtgagcttcagtgaccctcccaagttgcataagtggtgaaagtgtcacgacaggtgcccagagctgcaactctgtgactctgggctcttcctcataaaccccatgtggtctccagcaggcaaacacagcccttttgttttgaaaatgccatttctcctgataattattagggtgtaaagtgcttggaagggtcacagcagtgtttaatggcctttggatgtcactgtaatttgcagtgacaaataagacttgcagattttg

SEQ ID NO: 1738 - DNA, 258 bp, Homo sapiens
cacactaacacccagggagaaacagttcagacaaaagggaaagcactggcagaacctgaggtgagagtctgcttgtacatttatgggacatggcccatgtgccatgaacaaggggaagtaataatgatttctctaccttcctgatggctcatgtttgcctgacataaatattgacatttccttctatattccccaagtaaataaatagagctgcgttctgccattgtctgtactctaaagagtttctcacaatctggc

SEQ ID NO: 1739 - DNA, 800 bp, Homo sapiens
ctttttgattgggttccgtggctgtaattcttacttgaaggagagtgacatgttcgcatcttgaagcaactcagtggtctgggagagattttgtattaattttaacatttttgaaaggatcatttttccctgaataatacttttttaaaaaatatgggaagaaggcaatttgagcacaagactctcagttttcccctatgtggactcaaaagcaataactaatcgaatacggtaataggcaaaaaaaaaaaaaatctacatccatgctgaagataaggtacaatctgcatgccatagactgcaagaattactgggactcacaagggactcaaatacctcacatagaaaacagaatgattagggcagccagataaaacacaaacacctaattatgttttgatttccaataaacagaaatattccatatggcatgcttataattaacaataaatatttttaaatggtgtttttctgaaattcaaatgtagctagacatcttgtgttttatttcccaaatctggcaatcctcagcatggtattgtcatagaaagaaaatagttgtccgctgagtagatagctgtaagatatctgatatctaggcagctgacaaatctaccctgatatctgcaagagcaaaggccatgggccatgtgggtgctcccgcacctgacaatattcccaatgctgggaggcaaccagctttgccatcagctgaatcagagacccaagctaaggggcgccgggctgcacaaaaagccctaaacatcaaggcgtcttgctgatgctgttcttccctaacg

SEQ ID NO: 1740 - DNA, 499 bp, Homo sapiens
ggaaagttgctgccattaaacttctgataatgtttacagccagcagcgcctgggtttttgtgaccatgttagacaaacaaccagaggggtttctggaaacggtttttataatgtctatctagattaagaatttagtaacgtcatatatttatatcaacagactatttacacgtttcgtttgcttttaaaaaaacaaaccaaaaaagaaattacacttctgcataataaggcaaaaaaacaaagttttgtacattattattttaatataatctgtaacttcggttccaagtaccaaggggggccagggctggcctgagtgggggcctcacagtgcgctggacaaagtgaccggtttttctccataaataagacaaagaaaccctggggatctggagagggatctgaggccattaaactgcaaatcccaaccgaaaacgaagaagcaaaagtttcttttttggttcttttaaacgtctaaagagcataaaattaagaaaaa

SEQ ID NO: 1741 - DNA, 334 bp, Homo sapiens
aaaaagctatcaaatatcagagcaaggcaagaaggaaaaagtggataattattgctgtgtcagtggttctggttgccataatcgctctaattattggcttgtcagttggcaaatgatggtgtggataacgtcagtgtgcatgcctctctgccagggtgggaaaattgatgttcattattatttgtgtaattgttttgcttgtgatccttggaattatcctagcaacaacattgtcatagcaaccatatcccaagagccatttattcttgagactcagaccacatctgcaaccaaatcagcatcctgtcatttcgtgaatgaatctcagacgctg

SEQ ID NO: 1742 - DNA, 369 bp, Homo sapiens
gcccttcctctggctcgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgggaatgaagctggagcccagcgtcagaagtctagttttataggcagctgtcctgtgatgtcagcggtgcagcgtgtgtgccacctcattattatctagctaagcggaacatgtgcttcatctgcgggatgctgaaggagatgagtgggcttcggagtgaatgtggcagtttaaaaaataacttcattgtttggac

SEQ ID NO: 1743 - DNA, 432 bp, Homo sapiens
ctttctataccttttaaggtaagcaatcatctcaagattatcagacatctaaagaaaactttggtaaactggactatagtaatcgtatgagaaaaaaaatagctcaagattcctaactgctacaagaatagtgttgatgggatcaaactcctaattatcctaatagacctaattcatttttaaatgtggaaaatatgcaagataaattaaatgcttagttaaaaaaaaaaaaaaagtttcaccaactgttctccattactgagaagcccccacactgccccactgtgcatattcctagtatttcatccacgtcctgctctgctgtgctgccctacaaaaaaaccctcccgggggggaaaaaaaaacaaaaaaacggtgtagtgtgaactgctgaagaacttaaatgttcaagacatctttaaagtctaggag

SEQ ID NO: 1744 - DNA, 376 bp, Homo sapiens
tcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtg

SEQ ID NO: 1745 - DNA, 391 bp, Homo sapiens
ctgactagaaagctagccaggtccccacagggttagacttcctggaacagaaacgccaggaagttgagggctccctcatatgtcgggaatttatggagtgatccaagcgtcttaagctctctggaattattttattgatttacatctctggagaatggagcagcctgactacgtttcctgggggaggttttcatctcggctttcaattttctcttgtcaatgatctgtcatttgtagctaagtggagatacaagaaataaaatacttcattcaacaaaatagttagggtgcgggtcccatgagccaggtgccattcggggactgggagtatagcagaggacacggtagtcccagcccccgagctgcccagactcatctgaatgagcccagc

SEQ ID NO: 1746 - DNA, 253 bp, Homo sapiens
ctccattctccagagatggagcagcctgactacgtttcctgggggaggttttcatctcggctttcaattttcacttgttaatgatctgtcatttgtagctaagtggagatacaagaaataaaatacttcattcaacaaaatagttagggtgcgggtcccatgagccaggtgccattcggggactgggagtatagcagaggacacggtagtcccagcccccgagctgcccagactcatctgaatgagcccagcc

SEQ ID NO: 1747 - DNA, 258 bp, Homo sapiens
ctgccctacaaaaaaaccctcccgggggggaaaaaaaaacaaaaaaacggtgtagtgtgaactgctggagaacttaaatgttcaagacatccttaaagtctaggagtacctgaaaactgtgggtaaacatggaccattttccttgcgtatcaacttcacactaagcatctaacattcaaacaaaaaagtgcaaaatttgtaattatttttaacagcgagaattcccaacctcctgccatccactgatgttccatcctg

SEQ ID NO: 1748 - DNA, 511 bp, Homo sapiens
ccctgtcgccagcctagcctaacacttgaagtcttttctgatcgtaccaggcacatttccaccagttaacatgcatcagcttgtttaactgcaaccctgtaactattcccatttgccggatgaggatgctgaagaaaaaaagccgcctgtaaataacttgcccaaggttcacacagtgagcagctggaccaggattcaagcccagcggcttggctttgttgtggaatctgtaccctgggccattacctggagggcagctttctgggcctcagttctcctgtctgtaaaacggggatgttactaaatagttcatttgttttcgggttgttgagattataaaatgagctaacatgcaaggtttgtactgtctacatagctgccatgatgatatcgattcctgcttttattattatgaattctcagagtaatttctcccgcctcctgggcccagcctggctggtttgaggcccagacgctagaggcttatctttgtcccttgcctggcaaccgg

SEQ ID NO: 1749 - DNA, 608 bp, Homo sapiens
ctcacaccatcatgtacacgacacaccttcgtgtacatgtgcattcacactgtgatatacacatgcgctcacagtgatgtgcacatggggcacacaccatcatgtgcagaatcatattgtgatgtgcacatggggcacacaccatcatgtgcacaatcatattgtgatgtgcacgtggggcacacaccatcatgtgcacatgcgctctcacaccccgtgatgtgcacatgcgctcacacaccatcatgtgcacatggggcgaggtgatgtgcatgtgcactcacaccatatacacgtgcgctcacacacactataatgtgtatgtgcactcacacaccatagtgtgcacagtgatgcgcacgtgcgctctcacaccatcatgtgcacatggggcactgtgatgtgcacatgcgcacacacacaccatgtgcacacagaacacactatcatgcgcacgtggcgcacacactgtgatgtgcatgtgtacaacacataatgtgcacacatacacgcatcatgtgcacgtgcgctctcaccatcatggagacacgtgtgctcacacaccatcatggacacgctgaccacgagttcggattctattagtagta

SEQ ID NO: 1750 - DNA, 325 bp, Homo sapiens
tgatggtggaattggctggtagattggttgatgatgggttggttgatggcaaggttggttcatggtcggtttggttgatgttcaggttggttgatggtgaagttggttgatgggttggtttatgatgcatttggttaatgggttggttaatggttaggttagttggtagtgggttggttgaaggtgagtttatgatgagtttggttgatgatgcgtcagttgatagtagagttggttgatagtggattacttgaaggtaaggttggttgatggtaggtttggctgatggtggaattggctggtaggttggatgatgatgggttgg

SEQ ID NO: 1751 - DNA, 611 bp, Homo sapiens
tccagacctcaatgattcctcactgcactcaaagtaagcaccaaagtcttttcagtggcccacaggggtttgcacagtatggctcccctgttccttctctgactttgcttggtgccctctgcacccccctgcacccctctgcagctccatgcaccttcttcctctcccttgcacacactagggcttctggcatttgcacttgatattccccgctgcctggaccctcctctgccaggaggcttgctcaaatctctaggacacagtgagaactttcttcaaatctctaggacacagtgagaactttcttcaaatctctaggacacagtgagaactttcttcaaatctctaggacacagtgagaactttcttcaaatctctaggacacagtgagaactttcttcaaatctctaggacacagtgagaactttcttcaaatccctaggacacagtgagaactttcttcaaatctctaggacacagtgagaactttcttcaaatctctaggacacagtgagaactttcttcaaatctctaggacacagtgagaactttcttcaaatctctaggacacagtgagaactttcttcaaatctctaggacacagtgagaac

SEQ ID NO: 1752 - DNA, 269 bp, Homo sapiens
ttacctgtccatgtggcttgaccttctcacagcttggtgggctcagagcagtcatgattacattctgaattaatagttgaatgcgtaaagtaaatgcaggcaccaagtaacctgcaggcttccaaaaatgaatattttaaggaattaggctgaagcttcaaggcttcttaggctgcagtctcagaagtcccagcatgtcacccccattatactctattcgtcaagcagttttctgaggccaccccaagtttcagggcagacgctacgtg

SEQ ID NO: 1753 - DNA, 194 bp, Homo sapiens
ctgggctccagcttcattctcacaggtcatcatcctcatccgggagagcagttgtctgagcaacctctaagtcgtgctcatactgtgctgccaaagctgggtccatgacaacttctggtggggcgagagcaggcatggcaacaaattccaagttagggtctccaatgagcttcctagcaagccagaggaagggc

SEQ ID NO: 1754 - DNA, 470 bp, Homo sapiens
ctttcccacagacaatcaagatggtggtgggtgcagagacaggctccccactgcagagagagatgtctgatgagggctgtcctggtccccatccctaaggcagaaccctgggaagggggcgtggcctctggccagggtggcgggggcaaaaatctgaggctctcccctgcttgcccgaggtccccagggagggaaggagaggaaggagatgtctgcagagtcaaattcgcttttccaggaaccagaaagggtgacggtcattgtagcaaaaaatagccagggccatctgggctcccaacagggcttcctggtcagaggcagggggtcccctgagcctctcattttttattatgtgactcgactgaggcctgcacaggagtggaaccccaggttcctgaacagatgaacccctcacctggcccacagctacctgagcaggaaggggaggtggccccatctttttatcttcg

SEQ ID NO: 1755 - DNA, 419 bp, Homo sapiens
ctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattag

SEQ ID NO: 1756 - DNA, 724 bp, Homo sapiens
tcctctttaggaagtatgttggattcaggattcttaattcccatttaaagtcaggacaattgagataactgtatcagctaacatttactgggtgttatgttatacttgctaataataatcatagctaacatttactgagtgataatttttcttaattgaaaatagcagcatttactgagtgccacatattttccaagtactgcctgaagagccttggatctgtcctctaatttattgttacagccctgaggaggaggaactattaacccccattttgtggatgaggaattcgaaatctaagagagatcaagtaatttgcctaggagcacagctggtgaatgttggagaaagtatgaagcggtaaatattacttaaatcacatagcaaatatagctgtgactgcaattctagggtgtgtgtctctgtgtgtccacgtgtatttggagtagatcggataaactttggtcttgggtaaactgaggcatgtctggcgaaggggctgactcttttctatcccattgagaacatcctcctggtgctggggtgggggtatatgtgggatggtgtaattgcgcagcgtaccttgtaattaactccgtagctttcactgacgttcgaaaggattaaaagagaataatgtggtcagccgcttaatatggagggcacagtgggtggtgctgcttctcttttccatacctctgtcaactttattctcttttggggg

SEQ ID NO: 1757 - DNA, 469 bp, Homo sapiens
cgagtgacgacctaaagcaggtttgatttgaaaagaaacaacacatctatatcccagctccacccttcagtcttaagagacagtgaaaccagccctaagaacactatctcttccaagagcaaggccagggtccgcacgaagtcaagtggccaccaactgacgggcaactttgctcactacctcaatctgtcaaactcgtcggattatcaccgggaaatcaaacgtcatgccggcaaagtacgggcgctccactgagggctctgggggcataacaggttaaggctaactcacaggaccaagagacacttctagccactgtctcagtgagcggcggttcgggagaataaaggcacgcctcccagggtaccctcccagtacaccgagcagtgagagcgcggcaagtagaaaagcagcgcacgaccccatggcatcgccgggcggcaggcccagatgcactcaggaaaagacc

SEQ ID NO: 1758 - DNA, 551 bp, Homo sapiens
tatttggccttggacaaaaacctagccactctctgcctccgtctcttcaactcttagtggaagaagtaatagtccttacttcaaagagctgtttatgaatgaagtgagtaaatactcagctagccctagaccacatacaggaaagggtccatctctgttagctgttattatttataacatggcatgactgttagtatttgcatttgcattagtgctggcatggtgtcagcattgttggtgttagtgttcatattaatattagttttagtttaagtgttagtgttggtattggtgtttgtattagtgttggtgttagtattattgttagtgttggtgttggagttagtgttagtgttgggacatagcatttgtgttggtgttagtgttggtgttggcagtgacattagtgttagtattagattggtgttagtgttggtattgttgttagtattgatgtgggtgttagacttagtgttgggacatagtattactgttagtagttatggtgtaagtgttagtatttggattggtacctgggtaaatattagtgt

SEQ ID NO: 1759 - DNA, 307 bp, Homo sapiens
gcacaacaagcgtcctgggtcccctcagcaatcaatccgaactctgctcgggggcgtcctgggtcccctcagcattccggactctgctcgggggcgtcctgggtctcctcagcaagccggactctgctcgggggcgtcctgggtcccctcagcaagcggactctgctcgggggcgtcctgggtcccctcagcaagctggactctgctcgggggtgtcctgggtcccctcagcaagccggactctgctcgggggcgcgacagcccagggccacgggtggctctcgatggcttctgctttcaacagacc

SEQ ID NO: 1760 - DNA, 704 bp, Homo sapiens
cactatctttgtcatctccagggctgctgatgagatgacacagagctgcagcgacttggggtttagtcttgtcatcttcagctggttggaaagctcaacctttgtatttatccagatgtctctcagtgtatagagtactttttgtatctctagaggacttgggatgttttctggagcaacatggtcgtatctgctttttgaggtttggaaacttgggtgcatcttggagagtgttggggccccatgctcctgtggcacagggccaagcctgtttctgtccttgagaggtggccctggtatgtcctctggtagacccatggttgccagccattgggatttcaggagaaactcatgtgaattttagatgttggagaaacctggttcagatgagaacagatacctgagcactcagtgtgtgagctggggacagcccacggccatgacctatttccaaacccatgtggattgagtacagaagtcctcaggagtagactggatttttagagacagagtggggagcaggagtagagaagttggagaaactttcttgggcgtttgtgtggcggttccttgtcaagtgccaaggtaaggcctgcaggtttcttcttcggctctttgatcagcatcagtgtggttttattggcttggtttggtgaagtgtgttaacttttccaaatttttgaaagattgatctttgctatgtg

SEQ ID NO: 1761 - DNA, 710 bp, Homo sapiens
cccagatacacgtacagtaacaatacaaaaatgtgactggtcaaacagccctagttcacgtttaacactttcaattatttttaattacactatttctgttcaaaaaaatgttttccttacatacaaccatgatcagtctttagtctcaatcgtaccaaaataaagctatatataagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtactttttgaagcagcagatgaaatgtgtttactaccagcctaaatcaaagaacatggcaagagcaagattgttctcaggaaggaaaccataaatatggcatttatgtaaaatccttgcagcatctgaccatgcttttatctttaaaaaaaaaaaaaatcctcactttcttaagtataagtaacagtttattaatttttttttttttacagtgagatatggctatgggaagcaggtgatactatttgtttaagaaactgggatgccaactaacacgtggagttccccaagactttgcaatctccatttgtgagtttctgtaaaaaagggaacccagctagaggattcacagagaccctgaatgacaagcgacatactcgaaatctgcagctcttcctccc

SEQ ID NO: 1762 - DNA, 336 bp, Homo sapiens
cctgttgtccagcagaaggctctgtccgggatcgggaagtggcaatgcgttcctcaaaccacagacagtcgtgtttccagagacggctgccgccgtgtccccacgtgctcctccaaacctcagaacccgggacctgcacccctccccacatctggagatggcccctgccctggctcgaagctgggtgggctgtggctcacctgtaaccaagaatccttctcactcgcgaggatggggtgggctgttactaagttccaggtggctcgttaggcagccgggagccgggacactcggatcccccgggcatgggggcctctctgggaggccaggacagag

SEQ ID NO: 1763 - DNA, 618 bp, Homo sapiens
gtgagtctatgaatgaacgccctcctgcttgctgactttgagcactggtgtggatgatggtgagtctatgaatgaacgccctcctgcttgctgactttgagcactggtgtggatgatggtgagtgtatgaatgaacgccctcctgcttgctgagtttgagcaccggtgtggatgacggtggatctatgaatgaacacccttctcctcaccgactctgaacgctggtgtggaagatggtgggtctatgaatgaaggcccacctgctctctgactttgggcactgttgtggatgatggtgagtctatgaatgaacgccctcctgcttgctgactttgagcaccggtgtggatgatggtgagtctatgaatgaacgccctcctgcttgctgactttgagcactggtgtggatgatggtgagtgtatgaatgaacgccctcctgcttgctgactttgagcactggtgtggatgatggtgagtgtatgaatgaacgccctcctgcttgctgactttgagtactggtgtggatgatggtgagtctatgaatgaatgccctcctgcttgctgactttgagtactggtgtggatgatggtgagtctaagaatgaacgccctcctgc

SEQ ID NO: 1764 - DNA, 198 bp, Homo sapiens
ctcggctttcaattttcacttgttaatgatctgtcatttgtagctaggtggagatacaagaaataaaatacttcattcaacaaaatagttagggtgcgggtcccataagccaggtgccattcggggactgggagtatagcagaggacacggtagtcccggcccccgagctgcccagactcatctggatgagcccagcc

SEQ ID NO: 1765 - DNA, 692 bp, Homo sapiens
  misc_feature (1)...(692): n = A,T,C or G
gcttcacatcagaccttttctgccttcttctatggaaaatgaatgcataaaataggaatcagaggactgggtgtggatttaggtctactgaacacatactggctggatccattaccatcattatcaccacgactaccgccagcatcaccatcagctcctccatcaccacgactaccgctggcatcaccaccatcttctccatcacgactaccgccagcatcaccatcagctcctccatcaccatgactaccactggcatcaccaccatcttctccatcacgactaccgccagcatcaccatcagctcctccatcaccatgactatcactggcatcaccaccatcttctccattaccatgactaccgctggcatcaccaccatcttctccatcacgactaccgccggcatcaccaccatctcctccatcaccacgactaccactggcatcaccacaatcttctccatcaccatgactacagtcatcaccatctcttccatcacaactactgcttcatcacacctcctccatcaccacaactaccgccggcatcatcaccatctcctctgttgccacgactacctaccaccaaaatcatcaccatctnctccatcaacacgactaccgccagcatcaccaccatcttctccatcaccatgactatcaatcatcaccatcatcttctccattgnc

SEQ ID NO: 1766 - DNA, 730 bp, Homo sapiens
caaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagccggcccaggcgtctaaggagtcaaaagagaaacagcttcaagcagaacgtaaaaggaaagcggcgttatttttacagaccctcaaaaatcctctgccggaagcaaaagctgggaaaattgaggctgaccaggaatttcggattctagtagtagtagtcgacccgggaaatttcgaccggt

SEQ ID NO: 1767 - DNA, 2732 bp, Homo sapiens
ccgtcgtaccggtatcgaattcccgggtcgacccacgcgtccggtttttaaagagcattccaggtaattccaaggcaagtggttcaggtacttagaaaattctacagcagaatatacttggaaaaactcaagtttttccacatacttggaaaaactctctagcatttgttggaatttagtgtaattaagtgaaacctacctagcaactgtagtaattaaaagcgtggggtgtgctttttgttgagatccgtgaatgtttctgtaaacacaattttgattgtgttgcgcttcttaaaggttgtgatgacaacggtaattttaaccacttgaccgtatatcgttttcatccttgaagactgtcatatattttcaagtgtctttcctccctggttattttaggttaaagatcgaggtccggaagccacctaggagattttttaattggttttattggagcattaacctgggagcgatcctgtcgttaggtggcattgcctatattcagcagaacgtcagctttgtcactgggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccaaaaaaaaaaaaaaaaaaaaaaaagccgctaaatataagtaacagtttattaatttttttttacagtgagatatggctatgggaagcaggtgatactatttgtttaagaaactgggatgccaactaacacgtggagttccc

SEQ ID NO: 1768 - DNA, 795 bp, Homo sapiens
  misc_feature (1)...(795): n = A,T,C or G
cattcctgtaatcctatnnctttgntaggctgaggcgggagnatcgcttgatcccannagtttcaaaccanccgagaccgttccccagcacancccaccccactcagccgctcagcctccctcagttacccanaccgcacagacgtctcaactncagcaaccttggcangcagcagcaaccagtttggcagctctgtcctgggccattacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaa

SEQ ID NO: 1769 - DNA, 586 bp, Homo sapiens
ttttaagtctgtggtttttattttctgtttggttgatttgttttggtagactttttaatacttgttgcacaatagttctaaacaaactaattcatttgctttaacgaagtcagaccttatgcagtcagaccttctacatgcttctgtttgtccctaagaatgacttcctgttcctgggtggggtgtccctgggcttccatgggatgaggtgagacatgagggtgagagtgggcatcggagtggcctttggcatgacaacctctgctctccctgcagaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaaggtgagtgcctcactgccctgtctgggcagtgctatcttctgctcaggaatcagctactactttcatccaccaaacccagcatggtgggcccaaacccgagatgcctttttcttctggagatggggtct

SEQ ID NO: 1770 - DNA, 994 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggccttcctctgtggccagagcgttttcatcaccaagcctcctgatggcagtgccttcaccgatatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccag

SEQ ID NO: 1771 - DNA, 668 bp, Homo sapiens
  misc_feature (1)...(668): n = A,T,C or G
ctttttctttcctcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtccctttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctgggcacagcccagcgagcagctgcttgcagccaccgctccttacggggacgtcctttgacagacaagcaccttcttcacgcccgtccagctcagtcttcgtgaggcagctgaatctgtaccccaagcttccctttctttaacttggtggtgtactttcgttttcttttcctaacagcaccttttctgatacgaaaaagacaagatagatagtaagttacttttaaaaataaacatantancttttgatcaat

SEQ ID NO: 1772 - DNA, 438 bp, Homo sapiens
  misc_feature (1)...(438): n = A,T,C or G
taaattcccnataaaatgtctgacttcactgaaacttgcatgttgcctggattgatttcttctttccctctatccaaaggagcttgctaagtaagaaagaaggggggcgggggggnnanaaaatttttttttaaaaccccccggggggggganaaaaatttttgaaaggnaaaaatttaaaagggcccccccctttggntnttccccttggaaaaccntgaacnagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttattt

SEQ ID NO: 1773 - DNA, 684 bp, Homo sapiens
  misc_feature (1)...(684): n = A,T,C or G
cagccagacgtcagcttgtcnactggtnatgcgatcccactgtnctgcgtcggcctgctttntgtggtcttcctctgtggccagagcgtnttcatcaccaagcctcctgatggcagtgccttcaccgacatgttcaagatactgacgtattcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatacgaaatccaaaaaaaaaaaaaatcctcactttcttaaatataagtaacagtttattaattttt

SEQ ID NO: 1774 - DNA, 1377 bp, Homo sapiens
  misc_feature (1)...(1377): n = A,T,C or G
gntcgaggtccggaagccactaggagattttttaattggttttattggagcattaacctgggagcgatcctgtcgttaggtggcattgcctatattcagcagaacgttagctttgtcactggttatgcgatccccactgtctgcntcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatctcccctgaagaggatcgccgtgggcatgttctttgtcatgtgctcggcctttgctgcaggattttggagagtaaaaggctgaacctgttaaagagaaaacattaatcagacatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagatagtaagttacttttaaaaataaacatattacttgtgtttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaaaaa

SEQ ID NO: 1775 - DNA, 465 bp, Homo sapiens
taggtccggaagcccctaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttctaatattacaaccac

SEQ ID NO: 1776 - DNA, 205 bp, Homo sapiens
gtgccttcaccgatatgctcaagatactgacgtattcctgctgttcccagaagcgaagtggagagcgccagagtaatgggtaagcacttagttctcatcttgggctgtttgaaaggactttatcgatctctttattaacatcctagcttcggtttgttgtgtgcttattgtgtgctgggcctgggctgagtgagaatcccgtagg

SEQ ID NO: 1777 - DNA, 403 bp, Homo sapiens
  misc_feature (1)...(403): n = A,T,C or G
tctcccccgcaaggacccgctgacccgctggatggagagcaaaggagacccctcccgagccgcnnnnccccccccccccccctttttttgtttttaaaaaaaaccccctttttggggnccnccccaaaagggagcccgggttgtttggtttttccccttttcccaaccttgggggggnactaacccagaactgggacctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaa

SEQ ID NO: 1778 - DNA, 336 bp, Homo sapiens
  misc_feature (1)...(336): n = A,T,C or G
naacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacaaaaatgtgactggtcaaacagctcaagttcacatttaacactttcaattatttttaattacactatttcttgctgaccggaattcggattc

SEQ ID NO: 1779 - DNA, 275 bp, Homo sapiens; identical to SEQ ID NO: 1232

SEQ ID NO: 1780 - DNA, 747 bp, Homo sapiens
cttggcgtttggcttccgaatattcatcctctcggcagctttgacctgatccatgatgaaaagcgagtcgatgagaaccaagtccttgcgactctccctgtcgcctggacagtcatcggcatcttcctctccgcttgtgtcctccccatcaggcttcggccggggccactgagaactcggcaggaaggcgccttcgtacagcttcatcaggtccaggaggggcagctcagcttccttggctaaattagaaagttctgtttggtggtccacaacgccttcatttgcttcctcctcttcaattgtttcctcttcatcgtccacttcgtcatcagtcaaagatatgctagcttttctttttcttccagacattcctgaatccagagaactttcctgtaatgcgtcaaatcctttaggtctcaattctttccctctcctggaaactttctgtaaatttaaggccttcttccttttttcttctaattctactcgtagttttatttccacaacctgttcaatattcgaccaaaagcactctatctcccgggccgtggaggcggctatccgcctcagtctgctctgctcttccttcttcccccttttttcacggagctgcttctcctccagcagatagtcccagtgggacttggggcgtggggcctcctgcagctttggcagacgcctctgggaccacagacctgctttcctcagctccgcaatgcgctgatgcacctggttctccagagttat

SEQ ID NO: 1781 - DNA, 609 bp, Homo sapiens
tcaaatcctttaggtctcaattctttccctctcctggaaactttctgtaaatttaaggccttcttccttttttcttctaattctactcgtagttttatttccacaacctgttcaatattcgaccaaaagcactctatctcccgggccgtggaggcggctatccgcctcagtctgctctgctcttccttcttccccctttcttcacggagctgcttctcctcgtgatggcgcaccacagttctaacgagcttcttcgcagcagccaccttccacctcctctcctgggcaaagtctgtggccatccactgcatctcctccagcagatagtcccagtgggacttggggcgtggggcctcctgcagctttggcagacgcctctgggaccacagacctgctttcctcagctccgcaatgcgctgatgcacctggttctccagagttatttgttctgtcagcgtatcctgagaactgtcttgggacgaggtggcattctgagcaggactctgtggtttggtgggggcagatgccaccacccctggggtccgggaagtgactggaagatagtgccttattggtggcttaaggaaggtctatttactggagaaggat

SEQ ID NO: 1782 - DNA, 1564 bp, Homo sapiens
  misc_feature (1)...(1564): n = A,T,C or G
cccgccccgcggngagggatttgaaaaccccntttgnacctgatcggacctctaggccagaatccagcacgaggagaacatgaatgttgacctgcagggcgtgggccctgggctccagggaagcccacaggtcacgctggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctcaagcacccgggtacgcccatcacagtccgagagcggagaccctcccagccccacacacagtcagggggcaccatccaccacctgggaccccagagccctgcagccgcaagggtcgggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaaggactgccgtgcccccaggcctttccaagcctcccactcacgtctgtgggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctgaaaaaaaaaaaaaaaaaaaaaaaaaacaatgcgggcgcgagcttcagtt

SEQ ID NO: 1783 - DNA, 816 bp, Homo sapiens
ctctgaaggaggtcttcaaggagtatttgattgaattgtttttcttgcaacactttcaagggaacatgatggatttcttagctttcaagaagaaacattatgccccgttacaagcatatcttaggcagaatgatttggacattgaagaagaggaggaggagaggaagaggaggaagaaaaatctgaggttatcaatgacgagcagcaagccctcgcagggagcctggtagcaggggccggaagcacagtagagacggacctgtttaagaggcggcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcatagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggggcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctc

SEQ ID NO: 1784 - DNA, 433 bp, Homo sapiens
ggctgaggccgccagctgcatgggatgtgcaggcggtgatcaactttgcaaagcttaaacattattttcccttcttcctcccttccctttgaatattccctctcaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctg

SEQ ID NO: 1785 - DNA, 365 bp, Homo sapiens
  misc_feature (1)...(365): n = A,T,C or G
ggtcctgctcctgacaagggccttccggcactggagnttttgtgttagtggccagaaagcacggcaggcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctg

SEQ ID NO: 1786 - DNA, 2568 bp, Homo sapiens
  misc_feature (1)...(2568): n = A,T,C or G
ccgccccgtnccggccccgcccctgctctcgcgccggcgtcggctgcgtctccggcgtttgaattgcgcttccgccatctttccagcctcagtcggacgggcgcggagacgtttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctggaaaaaaaaaaaaaaaaaaaaaaaaaaccgctccga

SEQ ID NO: 1787 - DNA, 1634 bp, Homo sapiens
  misc_feature (1)...(1634): n = A,T,C or G
attagaaaaacaantnttagacgccacgcttggcacgaggcaagaatttcccccaaaagaatcctttaaccaaaaagttgtggtttcttgccttgctaactgtaccatagttattcctgcaggtgaatatataggctttatctgggttatttatttatttaatttttttttgagacagggtttcgctctgttgcccaacctggagtgcagcttccgcctcctaagctcaagccatcctcttacctcagcatcctgagtagcttggactataggcacgtgccactatgcctgactaatttttgtatttttttgtagagatggggattcaccatgttgcccatgctggtctggaactcatgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatctcatttagcattaattacttcagatacttttttgggatgaggggagtattaatggtgaagtatatcanggagatttgatagggtcagctcatctctcttaggaggaattgtgtattaacatttttagaattgacagagaccttgaaagtgaggggagagatacaggtgactcgttgaggtctaagactataactagttggatcctaatctcttggtcttagcattcttcacttgtgcagtaaactgagtgtactaattcccacaaatgtttcttcagcccagtgtgcccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaaaaaaaaaaaaaaaaaaaaaaaaattcctgcggcagcaggggaattca

SEQ ID NO: 1788 - DNA, 883 bp, Homo sapiens
tttaacccccttggtttttggtttcatcccctttggtcaccaccaacgggggcctattaaattcatgtttgggaacacacccgccggggaaattcgggtggatcgagagtggcttttaattcccagccccggtggccatcatatgtttggtttaaccatcgagattaccttacaggatgtccctaactggcatagagatctggtacgagtgtggaaaacatccccattgtgttgtgtggcaacaaagtgatatttaagaacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaa

SEQ ID NO: 1789 - DNA, 1012 bp, Homo sapiens
  misc_feature (1)...(1012): n = A,T,C or G
ggaaggaacgccgcgatgntcgcgagggagagccccaggtccagttcaaacttgtattggttggtgatggtggtactggaaaaacgaccttcgtgaaacgtcatttgactggtgaatttgagaagaagtatagttaccaccttggttgttaagttcatccctaagtgtccacccacaaaaggacctattaggttccatgtatgggcccagccggcccaggagaaatcgttggactgagagatgggctatatatcccaagcccagtgtgcccatcatatgttttgatgtacctcagaggttacttcaaagattgtgcctaactgcatagagatctgtacgaagtgtgtgaaacatcccacattgtgtggtgtgcaacaaagtggatataaggacaggaaagtgaaggcgaaatccattgtcttccaccgaagaagaatcttcagtactacgacatttctgccaaaagtaactacaactttgaanagcccttcctctggcttgctaggaagctcattggagaccctaacttggaatttgttgccatgcctgctctcgccccaccagaagttgtcatggacccagctttggcagcacagtatgagcacgacttagaagttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatct

SEQ ID NO: 1790 - DNA, 1010 bp, Homo sapiens
  misc_feature (1)...(1010): n = A,T,C or G
ccagcctcagtcggacgggcgcggagaccttctggaaggaacgccgcgatgntgcgcagggagagccccaggtccagttcaaacttgtattggttggtgatggtggtactggaaaaacgaccttcgtgaaacgtcatttgactggtgaatttgaattcggcacgaggtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcggccacgggttacatcctcattactaatctggctagnaaactcaaactacggacgnactcacaagncggatcanaantcctctcncaaagggcttnaaactctactcccactnaataggtttttggtgccttctaggaaagccnnngnnaaacctnggcttaccccccancnnnttaaccctacntgggggggancccnnctggngntggaaancaacgggncntccntggncaaantnntancncgncccnannttannggggnctaanagncc

SEQ ID NO: 1791 - DNA, 532 bp, Homo sapiens
tgtcatggacccagctttggcagcacagtatgagcacgacttagaggttgctcaaacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaagagatgagtgggcttcggagtgaatggggcagtttaaaaaaataacttcattgtttggacctgcatatatagctgttttggaaccgcagtgattccttgagtttcatatataagactggtgcagtcacatcacaatattcagtggtgaaaacttgtttggcgctgaccaggaattccggaatctaggagaaatagacgaccccggaattccgggacccggtcctgcaggcgaacaagcttttccctatagcgaggtcgaaattaaacctttggccgtactcatgggcaataggtggcttccctgtg

SEQ ID NO: 1792 - DNA, 723 bp, Homo sapiens
gtttgtgtgtcgtgttcgaatgtggtgggatatcgttatcgcacagcaatctcctacagccatcagctatgcccgttataatgccactctctatagggactcatggtacgcatacatggtacgctcgcaggttccggtgtggaattctagggttagaatctgcatttatggtcagcaatattcgtcagcgaattctggttggtactgtccattcccatcccttttggttaagattaaaaataaggtggaatttcaaaattttaaccaattgacttattccctgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccacctacatattggctaggtagggtcacctagggaagcacttgctcaaaatctgtgacctgtcagaataaaaatgtggtttgtacatatcaaatagatattttaagggtaatattttctttaacagcaagaattcccaacctcctgccatccactgatgttccatcctgtttgaggttctacattaaaacatgattactc

SEQ ID NO: 1793 - DNA, 476 bp, Homo sapiens
cagtatgagcacgacttagaggttgctcagacaactgctctcccgggtgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcaacgactgaatagggtccgtaactgtcattgaggattcatagtactcggagtagacgacccgtgaatgtcggagcggaccctggaagtgtagcccgtttccctatggcgagccagatttacccttggcgatatcct

SEQ ID NO: 1794 - DNA, 535 bp, Homo sapiens
  misc_feature (1)...(535): n = A,T,C or G
tacgagtgtgtgaaaacatccccattgtgttgtgtggcaacaaagtggatatnaaggacaggaaagtgaaggcgaaatccattgtnttccaccgaaagaagaatcttcagtactacgacatttctnccaaaagtaactacaactttgaaaagcccttcctctggcttgctaggaagctcattggagaccctaacttggaattttttgccatgcctgctctcgccccaccagaagttgtcatggacccagctttggcagcacagtatgagcacgacttagaggttgctcagacaactngntctcccgggntgngggnttgatgacctgttnagantnaaagctggagccnagcgtccagaaagtcctangtttttatnaggcagntggtccctgttganngtccaggnggttncagcngtngttgttccnaccttcatttaattantcctnggcttaaggcggggaaccnttgttgnttttcnatcttnttnggggattcttnnaaaggnngngtttnngntgggnttttngggng

SEQ ID NO: 1795 - DNA, 474 bp, Homo sapiens
attaggagtttgatcccatcaccactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagttgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtaaattctctcccacaccacgttagacaggtaagtgacgtcacttccaaatttcaactgttacatagaagatccagaatgtcaac

SEQ ID NO: 1796 - DNA, 431 bp, Homo sapiens
aatctgtgacctgtcagaataaaaatgtggtttgtacatatcaaatagatattttaagggtaatattttcttttatggcaaaagtaatcatgttttaatgtagagcctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcagcacagcacagcacagcagtgtgggggcttctcagtaatggagaacagt

SEQ ID NO: 1797 - DNA, 539 bp, Homo sapiens
gataatcttgagatgattgcttaccttaaaaggtatagaaaggatcacttaaatatatggaaaaatgaaataagggtgaagctgaataaagttctgcttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggaatatatgttgtttgcaacaattattctttcaataaaggacttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatatgggaaaatgaaataagggtgaagctgaataaagttctacttactgtattaactggcaacagttgagtttc

SEQ ID NO: 1798 - DNA, 456 bp, Homo sapiens; identical to SEQ ID NO: 1341

SEQ ID NO: 1799 - DNA, 352 bp, Homo sapiens
ttggctaggtagggtcacctaggaaagcacttgctcaaaatctgtgacctgtcagaataaaaatgtggtttgtacatatcaaatagatattttaagggtaatattttcttttatggcaaaagtaatcatgttttaatatagaacttcaaacaggatgggacatcagtggatggcaggaggttgggaattcttgctgttaaaaataattacaaattttacacttttttgtttgaatgttagatgcttagtgtgaactgctgaagaacttaaatgttcaagacatctttaaagtctaggagtacctgaaaactgtgggtaaacatggaccattttccttgcgtatcaacttcac

SEQ ID NO: 1800 - DNA, 362 bp, Homo sapiens
gtttatttttgtacatttgagccatgtcacacaaactgatgatgacaggtcagcagtattctatttggttagaagggttacatggtgtaaatattagtgcagttaagctaaagcagtgtttgctccaccttcgtattggctaggtagggtcacctagggaagcacttgctcaaaatctgtgacctgtcagaataataatagggagaaattaacccaatagatttcaaattaagtgataaaggcaaggcaattcaaatattaacatggcataaaacttccctactttagtggtttccaaatgctatttataaacaagggatgagttcacttgcttagatatttgaaatacaactttattctga

SEQ ID NO: 1801 - DNA, 285 bp, Homo sapiens
gaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagtttttccccataattgggatgaaacctttcattcaggtattttgaattgaaggtgtatgtgttgtttgttacatagaagatccagaatgtcaacaccacttgcaatctccacaaggttacaa

SEQ ID NO: 1802 - DNA, 238 bp, Homo sapiens
aatgaattaggtctattaggataattaggagtttgatcccatcaacactattcttgtagcagttaggaatcttgagctatttttttctcatacgattactatggtccatgtttacccacagttttcaggtactcctagactttaaagatgtcttgaacatttaagttcttcagcagttcacactacaccgtttttttgtttttttttcccccccgggagggtttttttgtaaggctag

SEQ ID NO: 1803 - DNA, 2743 bp, Homo sapiens
cgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccccaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttaaaagggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacagaaaaaaaaaaaaaaaaaaaaaaa

SEQ ID NO: 1804 - DNA, 944 bp, Homo sapiens
  misc_feature (1)...(944): n = A,T,C or G
tcctgcgcctcggctaaggacgacaaacactccacctccacggagcacacacacaacacacgcacaccctcagagacagatggagagtaacatacacgacagtcagcacaggtaaatacgcgcgctactcatgcgcagtggatacagaatatgcaccacacagagcacctcgaatgggaacttacgagggggagctcctggacacgacgacggacacggaggagatatgtggcatcatcataatggtaaggcatgggggccgatgttctgctacgcggaggctagcttcgacaaaccccccatnnggggancccatacactcggnnnnnncnnaaaacaatatgattgtcctcggccggggcacgaatcccnctntctctngggatagcagagccgctctaagttgctccatatcattggagtatagggtgctggtgtttggtttcttcatgcgttactggactcagatttaagcggtacaaagngaaacgctctggccgtcacacgtaggacgcaggaaggtcactcgtggtgaggctgacatgctcacacagtacaacagtagagggggaagatcctaagacaggggaactccagagatgagtggcggagcgcttcagttcagctttaaaggccaggacggcgcacacgtggctggcgcgctcgttccagtggcggcacgtccttgggcggctctaatgtctgcagctcaagggctggcgctgtgttaagtataaaaatgggtgtgatttttatgttttgttgtaaagtgattgttggtcttctgttgacattcggggtgatcctgttctgcgctgtgtacaatgtgagatcggtgcgttctcgtgatgttttgcggtggctgtgggggttgtacgcgggaccagctcgcgtaatgcattgcctgtagcaatgtaagaaaaggcctgtttctttaaaaaaaa

SEQ ID NO: 1805 - DNA, 1385 bp, Homo sapiens
gggagagacgtgtgtggttcctcgccgtgcagagagcaccagctctgcagcggcttccccaagtgacaattcagctagagctggaaccttccgccagggttcctctttgccttttggctgatgtgggggagtggtggggagagagcctgtttgccgcccctgtgtgagcagagccctgacaccatccgtctgtcttggcagtggaggagtgtctggacgagaacagcacgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctgcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcattgagtttagggttctggtgtttggtttcttcattctttactgcactcagatttaagccttacaaagggaacactctggccgtcacacgtaggacgcatgaaggtcactcgtgtgaggctgaccccccccccttcatcacaccaggttagagaggggaaaaatcccttaaggacagaggaactccccagagatgaagtgtctggagcgggcttccaggttccaagctttaaaaggcccaggacgcgcgcacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttcaaaaaaaccccgaattcaaaaaaaaaa

SEQ ID NO: 1806 - DNA, 507 bp, Homo sapiens
gagacatagtcactgcaagacgcagagtccacagatgtagttttgtttctgtgtttggatcttactgtaactgctgtaggttatgagaaacccagacctgaatgtccctccactgcacctgcagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacggtagggctggggcctcacctgggagagggggacggcacggtagggctggagcctctgctccctgtgcactgagaacacgcgtctctgcacgtcatgctgttaagtcaggatgggagcttagcttgcaggacgtgaccctagaggacaagagctggcgtctgtgtcagtgagtcattttgtaggatcacagccgtc

SEQ ID NO: 1807 - DNA, 908 bp, Homo sapiens
  misc_feature (1)...(908): n = A,T,C or G
ctcaggaatnnggacgaggncnctntntnnaaggnggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaaggggaaagcctctgggccgtcacacgtaggacgcatgaaggtcactcgtngtgaggcttgacatgctcacacattacaacagtagagagggnaaatcctaagncagaggaactccagagatgagtgtctngngcgcttcaatcagcttttaaaggccaggangggccacacgtggctggcgggctcgttnccagtggcggcangtccttnggcgtctctaaangtcttcaacttcnaagggcttgcactttttttaaattntaaaaatngggtgtaatnttaatnttttnttnantaaaagtgnntttagggccttcnnatttgcnaatccggggtnancccngntccttccgctnnntaccaattttnaganccggtaccgnttnccnnnnnntttttccccncctttnnggattttcaangggncccancttccggaaatcaattcccnttaacaatttattaaaaagncnctttctttaaaaaaaaaaaaaaaaaacctanangggggnccccgaccccaatanccccannggnncgnntacaaaaaaaangccnagnttnaaaancngncnttggaaacnnaggntcccnctaanacntttagaaaaccccantnccannggganaannaagagcccnaccaatanccntcnanaantnnncnnaannnggatnnaaatnnaaggnaatntttnaaanccgnaaattttaaacacnntt

SEQ ID NO: 1808 - DNA, 576 bp, Homo sapiens
aacaacatatctggaaatagatgaccttatttcatattcattacagtcttgtatgttagaagaggtattctatgctggtatacttataagaaagaaagaggagtcttaaaaactcaagcatgttacatactagaatggaattggagcaccagaattaaaatttttccatggggaatttcacagcagtaaggctactcagtcactcattgagttcagagtttgtaatcacccccacatggtgctaaaaacttaaacctccaaagtgttcccaggactctatactggacgagaacagcatgctgatccccatcgctgtgggtggtgcctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaaa

SEQ ID NO: 1809 - DNA, 633 bp, Homo sapiens
aactatcgaaatgacggtgttaattttgctaactgggttaaatattttgctaactggttaaacattaatatttaccaaagtaggattttgagggtgggggtgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgccgtgtacaatccccaagccacggcaaaacatcaggagaacgcaccgatctcacattgtac

SEQ ID NO: 1810 - DNA, 1000 bp, Homo sapiens
acaaggctgacatcagggcagatatagataaaaaatccagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctctgggcttagggtcctgtcgaaggggaggcacactttctggcaaactgttttaaaatctgctttatcaaatgtgaagttcatcttgcaacatttactatgcacaaaggaataactattgaaatgaaggtgttaattttgctaactgggttaaatattttgctaactggttaaatgttaatatgttaccaaagtagagctctaaagaggatgagaaggctccactgatttgacttttaagacttggtgtttggttcttcattcttttactcagatttaagccttacaaagggaatctctggtccagacccttgggcctggcaagggtggctgatggttaggctgcacacttaagaagcaaacgggagcagggaaggcttgccacacaggcacgcacagggtcaacctctggacacttggcttgggctacctggcctgggggggctgaactctggcaatctggctgggtacacaccccccatatttctgtgctctgcaacccgtgaactgccaatttcccaaatagaaaatggcattatttttatttacttttttgtaaagtgatttccagtcttgtgttggcgttcagggtggccctgtctctgcactgtgtacaataatagattcacactgctgacgtgtcttgcagcgtaggtgggttgtacactgggcatcagctcacgtaatgcattgcctgt

SEQ ID NO: 1811 - DNA, 564 bp, Homo sapiens
  misc_feature (1)...(564): n = A,T,C or G
tcntgggcncngtgttaanctncctccccagaagggaancaaaaggtccnaaatattctgaccctcatcacttaagccggaggcacncngcngcgcccntccangcgnccctccttggctctctaattctcaancaaggctgcncttttaaaaaaaananggtgtatcncactgntttnttaaaagtgaaaattggtcttctgttgacaannggggtgatcctgttctgccctgtgtacaatgtgagaacggtccgntctcctgatgatttcccgtggcgtggggantgaacacgggaccagctcacgtaatgcattgcctgtaacaatgtaanagaaacccccntccnttttggggnggnccttgncctnctgccaacaaaaatgggagctcatgagagaaggacctcagggaancggggttgagggtggtctcggtgcagagagnagggtgtcagggaaacggggggtgagggtggtcttggtgccagacgtagggaatggtgttgggagtgtcccgagtgcctgncacagntgtctggttcattcatntggcatgatngga

SEQ ID NO: 1812 - DNA, 515 bp, Homo sapiens
ccataattaggtttggggtcgggtttggttctccatctttactgcctcagattaacctttacaagggaaactcttggccctcccaatttggacccatgaggtcactcgtggtgaagctgaacatgctcacacattacaacagtagagaggaaaatcctaagacagaggaactccagagatgagtgtctggagcgcttcagttcagctttaaaggccaggacgcgcaacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttt

SEQ ID NO: 1813 - DNA, 718 bp, Homo sapiens
gagaagacgacagaagggtctggaaggaactaaccaaaattttcattccccagagatacacaacgccttttatagacaagatcttttgcagttttgttctaatactagaaatgtaggaagtcaggtttattacccaatgaccattcacgtttgatgataaatgtgtgaatctactggggttaaagatcatctttctacgaatctgctccgtgattaaagatcatttttctttttaagaatgcaagttctagccggtttttcctacaaggaatccagttgaatacaattcttcctgacgccagaggtgagaacccacaatctctgcgagccccgccccgcccgcgcgcccagggtattctggagccactagacctctgtgtgtgttgcagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctggtgagtgtcaccgagggcagctgtcgcggggtgtggaggacgtccttcagactccgcctgtggacgtttagtcgcttccgtgtgggctggggcgactcctgttcctctgcaaggagctgtttcttcttgccggtctgacgttctagaggtaactcccc

SEQ ID NO: 1814 - DNA, 428 bp, Homo sapiens
acgtgcttcagactccgcctgtggacgtttagtcgcttccgtgtgggctggggcgacgccacctgttcctctgcaaggagctgtttcttcttgccggtctgagattctagagtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagaataaccatcgaaatgacaaa

SEQ ID NO: 1815 - DNA, 425 bp, Homo sapiens
  misc_feature (1)...(425): n = A,T,C or G
tactgcactcagatttaagccttacaaagggaaagcctctgcccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccaccacgtgnctgggcggcctcgttccagtggcggcacgtccttgggcgtctctaatgtctgcagctcaagggctggcacttttttaaatataaaaatgggtgttatttttatttttnttttttggtaaagttgattttttgggtcttcctgtttgacaattccggggggtggaatccnggtttctgncggcctggtgggtaacaaaatngtggaaggaatttcnggggttggn

SEQ ID NO: 1816 - DNA, 421 bp, Homo sapiens
  misc_feature (1)...(421): n = A,T,C or G
gctgacatgctcacacattacaacagtagagagggaaaatcctaagacagaggaactccagagatgagtgttggagcgcttccaaagagggttnttccaagctttannaaggnccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttaaaaa

SEQ ID NO: 1817 - DNA, 355 bp, Homo sapiens
  misc_feature (1)...(355): n = A,T,C or G
gggtcccaggctttcnaaggtggaangttgccccagtttggcnctntggangaattntntnctngacnagaaccngccatgcttgatccccatcgctgtgggtggtccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctntcgaaggggaggcacactttctggcncttttttaaatataaaaatgggtgttatttttaaaaaaaaaaaaaaaaaaaaaaaaaaaaaaaaaaaaaaaaaaaa

SEQ ID NO: 1818 - DNA, 303 bp, Homo sapiens
aaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggaggtaggacgctgacccttggccctctggtgctagtggttgggtagctgggctgcagtggctgcgggtgacctcactgctctgtgtcctggtgctgggctctgctggaacgcgtgtgcacacagccggcgacgtctctgcagaacg

SEQ ID NO: 1819 - DNA, 287 bp, Homo sapiens
  misc_feature (1)...(287): n = A,T,C or G
tctctnagnggtgggggtgccgctctanattnnntccanatcatntgagtttagggtnctggtgtttggtttctncatncntnactncactcagatntaagccttacaaagggaaagcctctgncagctcacacntaggacgcatgaaggtcactcgtggtgaggctnacatnctcacacattacaacagtananagggaaaatcctaagacagaggaactccagaagatagagtgtctggagcncttcanttcancnttaaagggccagggacagggcacacagtg

SEQ ID NO: 1820 - DNA, 202 bp, Homo sapiens
ttatgcagacggtgacaaggcttctcaacatcaaccccaacacgacctcggccagcgggagctgcggcgcccacctggtgactctggagctgcacagcgagggcaccaccgtcctgctcttccagttcgggatggtgaggctggggcggcacctctctgggggcgcccactgtgtgtccaccacatctttttgtgccctggg

SEQ ID NO: 1821 - DNA, 1344 bp, Homo sapiens
  misc_feature (1)...(1344): n = A,T,C or G
gtctagacagggctgagctgtttgtcgttggaaattgaggctcggccagaggcgggagcccctacagtgccacgatcaggctgaggctcaccacaccgtggaaggggcagggatgggcccaggggtagccttgtagtgtgaggtgtgcccgaccacatgtaggtcaacagccagacgggacgctgcaggggactgtggggaagccgggagaaggcgctgcccaccctgtggggtccccctcgcctggagaccctgcaggcaacccttcagtgcatgcccacgggggtggtggaggcagagtcctgagaggtgggggtgggagcctccgggtcccctgcaggtcctgacccaccagatgggcccatgtgccccctgtagcttgggggccctggaggtggacaccagcacctcctgactaccagggggagggcctggactgaaacccacaccttcaccattcgccactgggccactctgcaggaactgcagcaccccacagatccttcatgcccagcacgccactcactctcacaccctctcgcacacatgcacacacagcacgcacacaccaggctcacgcgctccgcacaggtggcacgccaggggcaagcgtgcacgtagactcagagatgcaaggacagtattggcaattcagaggcacagaaagacgctgaggggcccccagcaaggtccccgccctcaggggctgtgttcccctcccagggcacgcacaccacaggcagcaacgcgggtgggggcactgtgacgccagtggggggagagggagcatggcggggcggcaggcagacgcgggttcatctctcttcctggtgtggtgagcctcagcctgatcgtggcactgtaggggcacccgcctctggccgagcctcaatttccaacgacaaacagctcaaccctgtctagacaaggcctcaggctagtccggcaaagcatcttccagcccgaagggcaaatgcggccttggcccttggggccctgcccagggtgcagatcacactggagtgggctggaaaacccatatggggaggtgcctgcaggcatcaggctccagggctcacagatggggctgacgggccatcccgggggcacaggatcgggtccaccgggaccgcaggggccggcagggnatgcccaagggcccaggagcgagagccggggctgacgggccggcaccagatccaataggganccgccgcggctggcacaggagccccaggagaggccggcagggtgggcccggctgccccaggagtgaagggcgatcgggaatggggagcaacggctggggtttgcagggcttgttggggcccnatgagcggtcgc

SEQ ID NO: 1822 - DNA, 817 bp, Homo sapiens
  misc_feature (1)...(817): n = A,T,C or G
ttttttttttttttttttttttttttttttttttttgttataaaaaatagtggcacggcactttttattttctttaatcagaaaaataagccctgcgcttctgggatggaggccccaggtgagcaccggaggaaggggcccgggtgggtggggagcgagggggcccggaggccaaagcagatgctgcaccagaggctggtcaggacccgggagggcctgcgggggtggggtcctcatgagcaagtgcggggtgctggaggtcagcagctgcctggcctgggagccagggacacccatccccttcctgacacctgaggcggcccagctgggcaagaccaggcctgcaggaccagagcctcctgtcacgtggcgcaggggtccaggtggtcaacgctgctctctggaggaccactggttagagcctgcccagctcccctgaggtctggagacagtcaaagcccccccaaacaccccctcccttttgggcgagtggcgtgccttggactccagaagactcgagtggggctgccttgagaccaggtcctgagggggtggcaacacctgaccacaggtgggggccgtggaaggggcagggatgggcccaggggtagccttgtagtgtgaggtgtgcccgaccacatgtaggtcaacagccagacgggacgctgcangggactgtggggaagccgggagaaggcgctgcccatcctgtggggtccccctcgcctggagaccctgcaggcaacccttcagtgcatgcccacgggggtggtggaggcagagtcctgagaggtgggggtgggagcctccgggtccc

SEQ ID NO: 1823 - DNA, 576 bp, Homo sapiens; identical to SEQ ID NO: 1661

SEQ ID NO: 1824 - DNA, 302 bp, Homo sapiens
tttttttttttttaataggggcacggcactttttattttctttaatcagaaaaataagccctgcgcttctgggatggaggccccaggtgaggatcactggttagagcctgcccagctcccctgaggtctggagacagtcaaagcccccccaaacaccccctcccttttgggcgagtggcgtgccttggactccagaagactcgagtggggctgccttgagaccaggtcctgagggggtggcaacacctgaccacaggtgggggccgtggaaggggcagggatgggcccaggggtagccttgt

SEQ ID NO: 1825 - DNA, 1051 bp, Homo sapiens
  misc_feature (1)...(1051): n = A,T,C or G
ggggaaagcagcccattcctgggtcagagactcccaccccagctcagagggagcaggggcccagcagggacggaccctcattcctcccagggaccccagacctctgttcctctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaaaaaaaaaaaaaaaaacagggcaaggctgatctgttgccgtattagtccgttttcacacagctataaagaatgcctgagactgggtgatgtataaagaaaagaagtttaactgaaaaaaaaaaaaaaaaaaaagatncggcc

SEQ ID NO: 1826 - DNA, 1210 bp, Homo sapiens
  misc_feature (1)...(1210): n = A,T,C or G
acctgggctcagaagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcgcactaccccccactttccccataaaaccagctgagtatttgtgccaggaagactgcgtgcagaaggtgactgtctcagtggagctgggtcatctcaggccttggctccttgaacttttggccgccatgtgcttcccgaagttcctctcttgatgacatgaagaagctgaaggcccgaatgcaccaggccataggaagattttatgataaaatgcaaaatgcagaatcaggacgtggacaggtgatgtctagcctggcagagctggaggacgacttcaaagagggctacctggagacagtggcggcttattatgaggagcagcacccagagctcactcctctacttgaaaaagaaagagattgattacggtgctcccgagcaacaaaattcccccccctccgatgtaaagatcccccccccacgaggagctgggagagcttttgtgcaaggttcatagatggttccagcccatcttgcagcgcctgcagacctgggtgcacggggttctgcctgggtgaagaanaaggtgntgcccctggtccatccagtgcagcccctctggaaacagtttccagagtttctgctgctctctgtcagagctcttcatgtcctctttccagtcctacggaggccccacggggggacaaggaggagctgacacccccagaagtgctctgaacccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccgctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 1827 - DNA, 580 bp, Homo sapiens
tcgaaccgggaagactggaggacaatttaaaaaaaggttaccgggaaccattgccgcttttttgtaggagcccgcacccgaggttcactcctttaacttaaaaaggaagaggagggatttccggttcccaggcaaagaaatccctgttccggaatattaggatcccccaaaccggggagcctggggaaatcttttgtgacaaggtctgggatggttcgaggcaatgctgcaacggtttaaaacctggtgccacgggtttctggcctgggtgaaggaaaaggtggtggccctggtccatgaagtcaaggccctctggaaacagttccagagtttctgctgctctcggtcagggctcttcatgtcctctttccagtcctacggagcccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctgg

SEQ ID NO: 1828 - DNA, 540 bp, Homo sapiens
cccagaccccctcctctctttgaaaaaaaagagatggttccggtcagggcaccaaatcccttgtcccgattgtgaagatccgcaccccagaagcctgggaagagcttttgtgcaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgcagtcgccctggcatcttaataaaacctgcttatactacaaaa

SEQ ID NO: 1829 - DNA, 660 bp, Homo sapiens
ggccacagtgggaagggggcaggcaggagcagcatgaaccccctgtgccctcctctccccaggacgacttcaaagagggctacctggagacagtggcggcttattatgaggagcagcacccagagctcactcctctacttgaaaaagaaagagatggattacgggcgccgagccaccagatcccctgtcccggatgttcgaggatcccggcaaccgaggagcctggggagagcttttgtcacaaggtcatagagatggttccaggccatgctgcagcggctgcagacctggtggcacggggttctggcctgggtgaaaggaagaaggtggtggccctggtccatgcagcccaggccctctggaaacagttccagagtttctgcttgctctctgtcaagagctcttcatgtcctctttccagtcctccggagccccgcgggggggacaaggaagcagctgacaccccagaagtgctctgaaccccaatcctcaaaatgaagaggtactgacgcctgcttttgccctccccgtcacggcgcacccaccctgacccctccctcagctgtcatgtgctccgccctctcccgcaaagtcagtccccctgcctggggttcttcccccatctctgacgtggtcaagtcgcagtgacatcttaatata

SEQ ID NO: 1830 - DNA, 447 bp, Homo sapiens
  misc_feature (1)...(447): n = A,T,C or G
gacactttcttttcctcacacctgttcctcgccagcagncttggtccttgaacttttggccgccatgtgcttcccgaagtcctctctgatgacatgaagaagctgaaggcccgaatgcaccaggccatagaaagattttatgataaaatgcaaaatgcagaatcaggacgtggacaggtgatagtcgagcctggcagagctggaggacgacttcaaagagggctacctggagacagtggcggcttattatgaggaagcagcacccagagctcactcctctacttgaaaaagaaagagatggattacggtgccgaggcaacagatcccctgtcccggatnttgaggatccccgcaaccngnggagcctnggngagagctttttgtnacaaggtcattnagatngttncaggccatgcntncagcggctncanacctggtggcaccggg

SEQ ID NO: 1831 - DNA, 761 bp, Homo sapiens
  misc_feature (1)...(761): n = A,T,C or G
gactgtctcagtggagctgggtcatctcangtggggagttggggtcccgaaggtgaggaccctctggggaggagggtgcttctctgagacactttcttttcctcacacctgtgcctcgctcgccagcagccttggctccttgaacttttggccgccatgtgcttcccgaaggtccgtctctgatgacatgaagaagctgaaggcccgaatgcaccaggccatagaaagattttatgataaaatgcaaaatgcagaatcaggacgtggacaggtggatgtcgagcctggcagaggctgggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaagtcctacggaggccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtcctgtcgccctggcatcttaataaaacctgcttatacttccctggcaggggagataccatgaaaaaaaaa

SEQ ID NO: 1832 - DNA, 367 bp, Homo sapiens
catgctccaagcgcctgcaaaaccttgctgccaccgggtttttgccctgggtgaaaggaaaaggtggtgctcttgggtccatcatctctagccccttctgaaaacggttgcagagtttctgctgctctccgtcagagctcttcatgtcctcttcccagtcctacggatgaccacggtgggacaaggaggagctgacaccccagaagtgctctgaaccccaatcctcaaaatgaagactactgataccacctttgccctcaccgtcaccgcgcacccaccctgacccctccgtcagctgtcctgtgccccgccctctcccgcacactcagtccccctgcctcgcgttcctgccgcagctctgactctg

SEQ ID NO: 1833 - DNA, 377 bp, Homo sapiens
  misc_feature (1)...(377): n = A,T,C or G
gagctgggtcatctcaggccttgntcctttgaacttttggccgccatgtgcttcccgaagtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgtttgaggatccccgcaaccgaggagcctgggggagagctttttnttgacaaggtcattgagatggtttccagggccatgcttncagcggcttncagacctnggttggcacggggttttt

SEQ ID NO: 1834 - DNA, 289 bp, Homo sapiens
  misc_feature (1)...(289): n = A,T,C or G
ggaggcatccaagccccagggctcnttgaggaaacaacaggggtgccagacgtggcccgggcccctggctgggcccagttcggggtgtgtgggagctgaggactcactgggcttgaggactgactgatgtggggtgcagaggaggnttgggcctggaaccgagtgctttgttcctaacaggtgatgtcgagcctggcagagctggaggacgacttcaaagagggctacctngagacagtggcggcttattatgaggagcagcanccagagctcactnctctacttgaaa

SEQ ID NO: 1835 - DNA, 513 bp, Homo sapiens
acgaggctcagtggagctgggtcatctcaggtggggagttggggtccccgaaggtgaggaccctctggggaggagggtgcttctctgagacactttcttttccccccacccctccctcgccagcgggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctatacttga

SEQ ID NO: 1836 - DNA, 194 bp, Homo sapiens
ggtctcctcgactcctgaggaaagcccaccgggcggggcgggaggtgaaaaggctggggaagtcagagcccgccctctcccgcacactcagtccccctgcctggcgttcctgccgcagctctgacctggtgctgtcgccctggcatcttaataaaacctgcttatacttccctggcaaaaaaaaaaaaaaaaaa

SEQ ID NO: 1837 - DNA, 2722 bp, Homo sapiens
tttttttttttttttttttttttttttttttttttttttttttttttttttttgtttttctcatgtcgagtttattaaaactttagcagtacaaattatccagattgcagattatcaaaaaatcaactcaatgaaatccacattaagaaaaaaaaggacaaacataaaacaatccaaaaacaatgaaaaggaaaacaacataaaggagattcattagcaagtctctcaaacttaaaatccgaaacagaatggaagtaagtttatataactcactcatccgcttttgtcttcatctgttccagggcttgattcatgatcaaattttttatttttttcatgtacatggtcattttcttgaccttttgatttttggttttctttttccactgaggatctgatcttctcatcctccttatttttcaacatggaggactttaattcattgtcctgactgctttgttttatttttgagaagggactttgatctctatcagcctttttttccctgctgttatttgagctattatgatcacgacttttagagtacattcttttctcactctcagaattttcttttctgtgtgagctcttactctcttggtttctgtatttgtctttgtttctgctttgactttcttctctctctgagctccgtgagtctctcctccttctcctcctatctttacttcttgatcttcctggtggtgttcttctctctcggcttcgtgaccgtcctcttctcctgtattcctgttctctgtatctatggtactccttgcttctgctgcgatctctgtcatgggttcttgatcgcactcttctgcttctgtccctacttctgcttcgttctcttgttctgctattataactgtgtttacctttagttatatcacattctctactcctggattgtgcgcgtctatccttttccttacttttactgtgatcatgctcattactctttgattctaactgtttagacttctctttacttctactcctttcctgatcttttcctttagaatcagactgcttttctttttctttaacattttcatgatcccttcctttactccttgacctcatcctcttttcttcatttctattatgttttgaatctctttctttactctttgatttctctttgctcttactcctacttttagatttggcccttttcttcactttgtttttatacttgtcatctttttctgaatttcttctgatgtctctctctttgctgttagatttatggtctttaactttcttctccttttcattttttctgtttggactctcagatacattcctgtgatctgttatttttctctcttttactctaactggacttctctgattttcttttatttcattcaactcactcttatcccccttgatccatctttcaccacttgataccctcattctttgagctctctgcatctcttgcctccaatgtggaggagtctcactacgtctgaaacgatcccttgatctggatctggaaggagttcgataacgccttggtcctcttcctttaattttcctgccagatctagtaactaaaagtcgtctctggtatgaagcaggctgggagttaggtggattacactctctttccctttctctctctctgtttttcctttccttctcatcagctttaggaggactttttctcattaggaatctattttcaggtataggagggatctcttctggacggacagtagactggggttgtgcttcaagattttcagcttcactctcactagatgcactcttcttgcttttctttcgctttttcttttctttcttgtgttttcgggaatttttccgatgtttcttttttcttttctttgatttctcttcagtagcactttcggaatcagaggaatcagaagaggactgagaatcacttgagctatctgagtcactagatgaggaggaggaagatgatgatgatttatgccttttcttttcttctttcttaactttagatttgggaatcagctctccacaactgagtatccgtacctccgcaaacggtttgctagctgcatctgttttctggttttcaatctctcttacaacttcttgaccagagattacttgtccaaaaacaacatgatgcccatctaaatgaggagttggtttcgttgttatgaagaactgtgaaccatttgtatccttccctctgttggccattgacaagagaaattctttgttgtgtttaacagcgaaactctcgtcttcaaaaaatcctccatagatagattcccctcctcgtccatttccttcactgaagtcaccaccttgaaccataaaatccttgacaactctgtgaaagagacaactcttataatgtaatggtttctgagttgatttcccggtccccttttcacctgtacaaagacaacgaaagttctcgcatgttttggggcacacatcagaaaataattcaaagacaactcttccagcaggttgattgttaatggcaatgtcaaaaaaacatcgaggacgttgaacctttattcccatggctccaatacttaatcttcaaatgaagaaaagaccaaaaaaaaacaaggacaactgatccctgtgctcctgcaccggtagagttttcctcttctctgggtccggtcctttgaagcgcttcaaatctaccgccgccagaaaaggcgctaaagcccgctaaccgcctccctcccccacaactcag

SEQ ID NO: 1838 - DNA, 755 bp, Homo sapiens
tgtgttttcgggaatttttccgatgtttcttttttcttttctttgatttctcttcagtagcactttcggaatcagaggaatcagaagaggactgagaatcacttgagctatctgagtcactagatgaggaggaggaagatgatgatgatttatgccttttcttttcttctttcttaactttagatttgggaatcagctctccacaactgagtatccgtacctccgcaaacggtttgctagctgcatctgttttctggttttcaatctctcttacaacttcttgaccagagattacttgtccaaaaacaacatgatgcccatctaaatgaggagttggtttccgttgttatgaagaactgtgaaccatttgtatccttccctctgttggccattgacaagagaaattctttggtggtctttaacaagcgaaactcttctcttcaaaaaatcctccatagataagattcccctccctcgtccatttccttcactgtaagtcacccaccttggaaccataaaaatcccttggacaacttctgtgaaaaagagaccaactcttataatgtaaatgggctttctggaggtggattttccccgggcccccccttttcaccccggtacccaaagacaacggaaaaggttctcgccattgttttttggccgccaccaccttcactaaacaataatttcacaagacccccctctttccagccatcgccggacttcggctcaatggggcacctgttcacacaaca

SEQ ID NO: 1839 - DNA, 363 bp, Homo sapiens
gtgttttctgtaatttttccgatgtttcttttttcttggctttgatttctcttcagtagcactttcggaatcagaggaatcagaagaggactgagaatcacttgagctatctgagtcactagatgaggaggaggaagatgatgatgatttatgccttttcttttcttctttgtttttcctttccttctcatcagctttaggaggactttttctcattaggaatctattttcaggtataggagggatctcttctggacggacagtaaactggggttgtgcttcaagattttcagcttcactctcactagatgcactctgcttgcttttctttcgcttaagctgtactttcttgtgtttacggct

SEQ ID NO: 1840 - DNA, 3283 bp, Homo sapiens
tggcccgctatggggcggtgttgaggttgggtccgggatgcggggtctttgactgaaggggtaggccaagtggaggtatcagggacgtcgcgcggcacagaagaggaccagcctggaggccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggcccaggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgatgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggtaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctaaaaaaaaaaaaaaaaaaaaaaaaaaaaaaaaaaaagggcggccgct

SEQ ID NO: 1841 - DNA, 824 bp, Homo sapiens
  misc_feature (1)...(824): n = A,T,C or G
tgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtntaaggagtcaaaagagaaacagcttcaagcagaacgtanaaggaaagcggcgttatttttacagaccctcaaaaatcctctgccggaagcagaaactgggaaaattgaggagagttctttcagtgtcgaggaagatccagaattcttggtatagtagtagtagtagtagtagtcgacccggaatttc

SEQ ID NO: 1842 - DNA, 864 bp, Homo sapiens
  misc_feature (1)...(864): n = A,T,C or G
aagaaaagaaaaagaaaaagcacaaaaaaaaagatctcgaacaagatcacgttctcccaagtaccattcgtcatccaagtccaggtctagatcgcactcaaaagtaaagatccaccgagagaagaagaggaagaaaaggaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccaggaaataggtccaccatctgtccgctcaccccggcttccagtagctgtggacggccacctccattggtgccgccagtgagcactaccctctcggccgtgggggtgccatctcacgagcgcctcctctggttctcacccactgatgtcaccacccagtgccttgcgtggggcagccgtgcatttccactctttccaagcacaaggagcttgttttgtgtccccatgtggagttcgtgcagcctcctggctgtgtgggtggaccgtgtctgcgtctggagctacacagagaaggatggagcattgcacatcgtagccttgagcttcataacacggcactgctaagtgcatgggggtcaggacactcanggtcccagagccttccagaggacgagccttacattgccagggccacctncacaaccaccaccacaagtgcacttgcccccgtggccgccatcat

SEQ ID NO: 1843 - DNA, 594 bp, Homo sapiens
acgacacatgtttccaaagcacctggccagagcggtgagtcacccacctcgatcttgggaattagagccacagttctgccagtccccaaagactcagcactagtttgatgacgtgttaattcactgacagcatagggctgtctgttgtttgtgcgcaagttggtgtgaacaaagttcacaatatctggttgaataggagctttgaatacagcaggcaaagtgacatttttgccagatgactcccccttttcggagtacacccatatcagtggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcctttaagggtagtggacccagttaatcccttggcagcatttgttggtaaggcacaggttgacagttccac

SEQ ID NO: 1844 - DNA, 1173 bp, Homo sapiens
gcttattatgagtttaagaagcagttcttcctccagaaagaagggggcgatagcatgcaggctgtgtctgcaccagaagaggctcccacagactctgctcccgagaagccaagtgatgccggggaggatggcgcgcctgaagacgcagccgaggtgggagcacgggcaggctcaggcgggaagaaggaggcatcgtccagtaagaccgtcccggatgggaagctggtgaaaggtgactgccctggcatcagcgagtgtgcccttgccatgaagtccccagtcagtgcggttctcacagcatggttcaggggctcaccccagccccacgccatgcagtgcacatctgcacagatctgctctgacggcacggcgtcccccaccgtagaccctgcatatgatgtggctccatgctagtcatccccttcccagcagccgatgctcagcaaagcaaaagctggaagatcgcctcgcagctgctgcccgggaaaagctcgcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaaggaaaaggagaaagcccacaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccaacaggaagcggacccgctccagcgaggaatccaggaggtgacactgaagcagcgcggctctcctgctcccagcagctgtcttctcatttgtctcagcatccctgggtgacccctgcctgaatcagttcttacactgctgactgccaaataatgactttccccctctc

SEQ ID NO: 1845 - DNA, 937 bp, Homo sapiens
cgatgactggggcaacagcgtgccggctgcgtctgctgccacaataggctgtgcacagtactgtggtccccgcggcccaagtgatgctggggaggatggcgcgcctgaagacgcagccgaggtgggagcacgggcaggctcaggcgggaagaaggaggcatcgtccagtaagaccgccccggacgggaagctggtgaaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactgggaggcaggcctctgcctactttagaagttaaaccacccgataggccttcgagcaaaagcaaagatccaccgagagaagaagagagagaaaagaaagagataacgcacataaaaagatctcgaacaagatcacggtctcccaagtaccattcgtcatccaagcccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccgactctccacaggggagacgctggctgagtgcgccgagtgggccgcgggggccgcgggccggggcgctgcctgc

SEQ ID NO: 1846 - DNA, 730 bp, Homo sapiens; identical to SEQ ID NO: 1766

SEQ ID NO: 1847 - DNA, 548 bp, Homo sapiens
aagatctcgaacaagatcacgttctcccaagtaccattcgtcatccaagtccagggctagatcagctcaaaagcaaagcattctcttcccagtgcctatcggacagtgcggcggtcgagagtcacagcctccccagggacgctgcgcgcggagccctgtcagagcagcgcgtcagtgacagcggcagccgagccaggaagttatcacgcagcctcgaccaccaccagatttggctccgcgagctcttttgagggaaaacctggtaaaacgtcgaggtcccgctcccggtcccctcggaggagagcccactcccctgagagaccgagggaagagaggagtgtgcccactgcctaccgcgtgagccgcagccctggggccagcacgaagcggacccgctccagaagtcccctcgagaagaagaagaagaggcggtcccggtcgcggaccaagtccaaggccaggtctcagtcggtgtcacccaccaagcaggcagcgccccggcccgcggcccccgcggcccactcggcgcactcagccagcgtctcccc

SEQ ID NO: 1848 - DNA, 472 bp, Homo sapiens
gaggcagagcgctccgggccgggccccggcggccaattggcggaattagccagctgttcccctgtggaaaatcgggggttcaagcaggagcccttcaggggaattttccagggaaaaggaggcccagatcttttcagcaattggttcttcccgtgcagggcaaaatcactcaggatctcatggccaaagtcagagcgatgttgcagcttccaaaaacctgcaaaccagcgcttcctgagacggggccagcggaagcagaccgggaggctgcgtgagcttctgggcagctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacac

SEQ ID NO: 1849 - DNA, 693 bp, Homo sapiens
ctaaaataaaatggatgttcttgtctttgcccgtaaccagtcttttaataccagttcttaatccccaaaatttttctcagcaggaagaaattttccacaaaagacgtgtattcagctgtctgtgggtaaacatgtactgacaaaagtacataatgatagatataaagtgtgaatttttaaaactattttacctcaaaagtaggttgaaaaaagtatgttgtatgctttactgatagctacaactttagaaatatataaagtttttctcagtaattttctatttttgttgataaaattctcatttttattcaagaggaagaatacaagcgattgagtgaagcactagcagaggatgggagctacaatgccgtggggttcacttacggtagcgactattacgacccgttcagagccgacggaggaggagggagccttccaaacagagaggaaaaaaatgaggccgaaaatttagggggaaaatgaagagcccttcgttgcccccttagggttgagcgtcccgtctgacgtgggagttgccacccaccgctaaaatgcacgcctatcttcgggcgcacggtccagcttcgtgtgcaggcagggagcacagtttgagatcatgctgaaggccaagcaggcccggaactcccagtttgactttctgcgcttcgaccactacctcaacccctactataa

SEQ ID NO: 1850 - DNA, 418 bp, Homo sapiens
ccaaaaaagggcacgttataaactaattctctcaaaatttgatttgtccaatcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaatgctttgcttttgagtgtgatctagacctggacttggatgacgagtggtacttggg

SEQ ID NO: 1851 - DNA, 348 bp, Homo sapiens
cggtaagtatgtgtgtgtatatatatatacatatataaaacatcacacacgcacaccagtctagacgttaatttccttttattgaccagcttgttcacattacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcagggcaaggtactgctcaagacaaacttacttcagcaccaacttttaaaatttttaagatttaaaaattactcccattcat

SEQ ID NO: 1852 - DNA, 340 bp, Homo sapiens
gggatgcggggtctttgactgaaggggtaggccaagtggaggtatcagggacgtcgcgcggcacagaagaggaccagcctggacgccggggacgctgtcatgtacggcgcgacgggggccgcgaatacccgagaggaaaagcggccacaggaggaggccgggccaggcggtgcggcggtgggggcagccgagtggagctcttggttttcggctatgctgcagaaaacaaaagtgacgagaaaaaaaaatcaggagtcagctctgacaatgaagatgatgatgatgaagaagatgggaattaccttcatccctctctctttgcctccaagaagtgtaaccg

SEQ ID NO: 1853 - DNA, 478 bp, Homo sapiens
  misc_feature (1)...(478): n = A,T,C or G
gtaattttctatttttgttgataaaattctcatttttattcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccganaatttagaggaaaatgaagagcccttcgttgcccccttaggattgagcgtcccgtctgacgtggagttgccgccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgac

SEQ ID NO: 1854 - DNA, 299 bp, Homo sapiens
catgagacgcagcctcccggctctgcctccgctggccccgtctcaggaagcgctggcaaagccgggaggctggtggggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacccctttaaaaaaaaaaaaaaaaaaaa

SEQ ID NO: 1855 - DNA, 196 bp, Homo sapiens; identical to SEQ ID NO: 1452

SEQ ID NO: 1856 - DNA, 830 bp, Homo sapiens
tatatccaaaatacacccaaaaactcctaaaattcaacagtaagaaaacaaacgacccgcatttgggaggccgagatgggaggatcgcttgaagccaggagtttgagaccagcctgggcaaccaagtaagacctcacctggggggctgaaggaggcctcccatgtcatggaattgtcccgcgtgtacagctccacagagcctctgccaccgctggagcagactttgaacccattggagatgacctgtcccccatacgcagaagggattggtctagactgttctccttgtgtcttccagaaaaaagaaaacgtgaccccttcagggccacactgctctggcttgctgatgcaggagctgttgtacctgccgtaatagagaagcgtgactcccttttcctctttcaggtaaatgcctttgttgaccttcccttccacaatatctacagttgcagagagatttgagtaggcagaatcattggaataacaaaagtagcattacgggaaggaagcacagtgagcttgtgggttcgggacgctccagttgtatcctgaagttcatggatcccatccacattctccagtggccagtaatgggaagcagacgccaacacctgaaatcctggatggtcctgcgatctggagtagacgccacgcacctgaaagttgtaataaaatagcagcagccaggagtaccagcagcacagccgcagcagcttttccatggctctctcggaggtcaaagctcggagccaagtgaaattcctgagggtctgtgagaacgggacctcttaaccttcagttccttggaaaagggacattttcacgtcgac

SEQ ID NO: 1857 - DNA, 670 bp, Homo sapiens; identical to SEQ ID NO: 1153

SEQ ID NO: 1858 - DNA, 2168 bp, Homo sapiens
aatcgaggatttcctctcctagcccaaggcaactgcattctactttttactcctgtacattttcccattttggatgtttcatataaatggaattatacactatgtgttctgtgactgacttctctcctgtaacacagtttttccaaggtttcaccatggggtgggcagggtgtggtggctcacatgtatactaatcccagcgtgttggttgggaggccaaggtggaaggatcgcttgaggccaggagttcaagaccagcttgacaacatagcaaaaccccatctctgtaaaaaaaaataaaaataaaccaggcatgggtgtgtgcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactaaaaaaaaacaattcggcacgagtaatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccatgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaaaaaaaaaaaa

SEQ ID NO: 1859 - DNA, 758 bp, Homo sapiens
  misc_feature (1)...(758): n = A,T,C or G
ctgaccttgtgntccanccacctcagcctcccaaagtgctgggattacaggcgtgagtcaccgggcaggctgttctgaagcttttagatctcagntctaaggcttnntttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccaccttttgtacagttgtttaaagtttcccattgtcacggaaaacattggttgcaaagcccctcaaagccctcaagtgccttctgtgagtttaaatgtgctggtgccctccagaaaagcctcggcctcagctccgtttccgcctgttccctcccccagggataatgaatgggttactgcactgtaaagaccgtgggtctcttttcacttaaatagggagattcggagtttcccagtttacatggaatgaagtctggaatttaaggacgggtgatggaaacttgagggttccagttactcttcgggggactccgaggggaaattatttccntgaggacatggggngttaatttcctttaccaaatttttaaacttattttgttaccaggnttccccaccataacatggttggtttaagggtaccccaatggttttt

SEQ ID NO: 1860 - DNA, 388 bp, Homo sapiens; identical to SEQ ID NO: 1046

SEQ ID NO: 1861 - DNA, 2521 bp, Homo sapiens
  misc_feature (1)...(2521): n = A,T,C or G
cggccgcagactgctgcgagcggtgatcatgggggccccgggctcgggcaagggcaccgtntcgtcgcgcatcantacacacttcgagctgaagcacctntccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtcaaaaaaaaaaaaaaaaaaaaaaaaaa

SEQ ID NO: 1862 - DNA, 2076 bp, Homo sapiens
gcggccgcaggtaatgacctggaaggggaggcttgggaggtagggcacagtccatggtggcagctggctggcaagggcctggcctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagcccagaatggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaattgcccagcgggcctttgctgatgatccttagctctttgctctatggcccttcctcatcaggggaccgtttcccccctcttccttcacagtatttaagaaataaaagtcggatttttctgaaaaaaaaaaaaaaaaaaaaaaaaaaaaaaaaaaaaa

SEQ ID NO: 1863 - DNA, 2385 bp, Homo sapiens
ttgtttttttgttgtgttttttttttttgaggattgaaaaattatctttattatcttgagtgggagctggagctggaagtctccagcttctccctccaacaactcagctcccattgtacccatctggggacttagatgaagttacaggtcagttattggacagctcacaggcctcttgattcctaggagtcaataagaaggctttggagtccaggcaggaagtcagggacttgaattcctccacacacttttcgggaggatgtggtgagcgattgtagaggagaaagcgctggtaaccctggcctgtctcattcagcatgattccacctgggcatgagctggaaaagagctcagtcttcatgtcagggcggccttcagttctgagatctgtgctcccttcagtcaggtggtagatccatttccggggcacacagagcccaatctttcatgcggatggttagcacgaaggtggagctgcatcggggcagagccagcagccatattgaagacaatgttgtccacagggtcaaaagttgccaactcctccttggtgggagctgcccctgcgataaagtaccactggcccaagtggacctctgggaatgtttggggctgcggactttctcgtcgtgccccacaaaagtaaagcttggggacctggggggagccggaagtaatcgcttcgagatccccaaataatcatcgggggaacggaaatgggcgtcgcgtggcagtttttggcccccgccggaagtgacgagacctgtcggccatggagcctaatgatagtaccagtaccgctgtggaggagcctgacagcttggaggtgttggtgaagacctttggactctcaaactcgtacctttattgttgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttctgacagcgctactacaaggttctggggtgctgcttgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcagctgtctcctccgcggccgc

SEQ ID NO: 1864 - DNA, 754 bp, Homo sapiens
ttttttttttttttgaggatttgaagaattatctttattatcttgagtgggagctggagctggaagtctccagcttctccctccaacaactcagctcccattgtacccatctggggacttagatgaagttacaggtcagttattggacagctcacaggcctcttgattcctaggagtcaactaagaaggctttggagtccaggcaggaagtcagggacttgaattcctccacacacttttcgggaggatgtggtgagcgattgtagaggagaaagcgctggtaaccctggcctgtctcattcagcatgattccacctgggcatgagctggaaaagagctcagtcttcatgtcagggcggccttcagttctgagatctgtgctcccttcagtcaggtggtagatccatttccggggcacacagagcccatctttcatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactccttcccatccacgcccagagttgtcagttgactgtgctcagggcactggtagatggagttaaggataataccatagaagtagagcagagctgcccaaatttggtggaacatcttcaggcaggagggagctgtggctctggggccttaactgctctctcctat

SEQ ID NO: 1865 - DNA, 810 bp, Homo sapiens
  misc_feature (1)...(810): n = A,T,C or G
ttttatagcattgctgcgcatgtgctgcatgcacagataggtgnatttggggcccggttgctggagtngtgtaaccagccctgtttgaatgctggngcctaacccgcactgcatgggggggacagcagatggagcttgctgctgttatcaatggcngaattcgtcgtatgtctcgtggggtgaatcctnccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagcccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctgg

SEQ ID NO: 1866 - DNA, 653 bp, Homo sapiens
gggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagcagggcgccggtctgggtaccaatgcctcgttggcccagatggtgagcggccttgtggggcagcttcttatgcagccagtccttgtggctcaagggaccccaggtatggcttcaccggcagcccctgccactgcttctgccagtgctggcaccaccaacacagctaccacaagctggccccgcttctggggggcctggccagcctcaaccaaccccttaacccttcatggctgacttagtctctc

SEQ ID NO: 1867 - DNA, 709 bp, Homo sapiens
atacgcgcccccgggttggtgaccccccccagccacttctgcaaggagccaatggaagttcagggagcagaaagagcttcccctgagcctcagcgggagaatgctccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggcaaaaaaaaaaaaaaaaaaaaaaaaaacaaaaa

SEQ ID NO: 1868 - DNA, 1279 bp, Homo sapiens
aacatctttgagcctggagctgatggggcccttggattctttggggccttgctttctcttctgtgccagaacttctctatggtggacgtagtgatgcttctccatgggcatttccagccactacaacggctccagcccagctgcgatccttcttccaccagcactacctgggtggtcaggagcccacacccagtaacatccggatggcaacccacacattgatcacggggctagaagagtatgtgcgggagagttttgtgagtaacccttctctattcctttcctctcctgggtctggtcaaggcagctgctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaaatgctggccctaaacctgcactgctggggggacagcagatggagcttgctgctgtaatcaatgcccgaattcgtcgtatgtctcgtggggtgaatccttccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatcgccagcgggcctttgctgatgatccttagctctttgctctatggcccttcctcatcaggggaccgtttcccccctcttccttcacagtatttaagaaataaaagtcggatttttctggcaaaaaaaaaaaaaaaaaaaaaaaaaaaaaaaaaaa

SEQ ID NO: 1869 - DNA, 632 bp, Homo sapiens
  misc_feature (1)...(632): n = A,T,C or G
gcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggtgagtggctggcttgccattcacctcatcatcctgtccccctgcccagccaggcagtggtaccttctttgcattacagtaccactggggtagagcccgtatgacatgttngggaaggggcctaggatcattgctctgac

SEQ ID NO: 1870 - DNA, 574 bp, Homo sapiens
gtgggcaacacctttgcggcaccgtctgccctgcgctgcaatctggcctgcacgcccccacgacacctgcatgtggtccggcctatgtctcactacaccacccccaggggtgctccagcaggcagccattcccatacagattcaatgtgggaaccactgtgaccatgacaggaaatgcgactcggcccccccccaactcccaatgcagaggcacctccccctggtcctgggcaggcctcatccgtggctccgtcttctaccaatgtcgagtcctcagctgaggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttcctccgcggcc

SEQ ID NO: 1871 - DNA, 773 bp, Homo sapiens
cggtcccccgggcgacacggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttact

SEQ ID NO: 1872 - DNA, 556 bp, Homo sapiens
attcggcacgaggaatgtgggaaccactgtgaccatgacaggaaatggaactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttcctccgcggtcgc

SEQ ID NO: 1873 - DNA, 835 bp, Homo sapiens
ctcagcccttcttgcagcgctactacgaggtttctgggtgctgctgccaccacggactacaatacaatcacgagggccgggaggaggatcagcggttgatcaacttggtaggtgagaagcctgcgactgctgggaacacctttgttgcaactgtctgaacctgcgctgcaatctgcctgcacgcccccacgacacctgcatgtggtccggcctatgtctcactaccaccaacccccagtggtgcctccagcaggcagccaattcccaataacagaatcaaatgtgggaaaccaactgtgacctcattgaacaggggagatagtgggatctctggtctcgctcgcccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgaaaaaa

SEQ ID NO: 1874 - DNA, 469 bp, Homo sapiens
  misc_feature (1)...(469): n = A,T,C or G
gaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggctttccaacagctccaacccgggtggtgattgcccggcccactcctccacaggctcggacttctcatcctggagggcccccagtctctgggacactgcagggcngccgntctgggtaccaatgcctcgttggcccanatggtgagcggacttg

SEQ ID NO: 1875 - DNA, 373 bp, Homo sapiens
cacatccctctggtgacatcacacgagcctctttcaccctgtaacaccagaagacttggtgagtcctaatcctgttttatgagattttaaccccttaccttgattcctaggagtcaataagaaggctttggagtccaggcaggaagtcagggacttgaattcctccacacacttttcgggaggatgtggtgagcgatctggaagggcaaggtggggtcaggccagtcaaaacccctggaagcacctagctcttcctgggagggtgtcataggacccagagtgaggagttctcctgccctcccttgtttccctccaacccttcctgtcttgtatccctactcactgtagaggagaaagcgctggtaaaaaaaaa

SEQ ID NO: 1876 - DNA, 449 bp, Homo sapiens
  misc_feature (1)...(449): n = A,T,C or G
agaagccccagcgggaaaggtttaaaccccaagccccccttttggnatggattccttacctccaattggtattcctttgccaaaaagacgcaaagacgattccaggttgaggccccccagctgcttcttctcagaggctgtgagccgggcaagttaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccatatnccagcgggcctttgctgatgatccttagctctttctttgctctatggcccttcctcatcaggggaccgtttcccccctcttccttcacagtatttaagaaataaaagtcggatttttctggctgctttctctctaa

SEQ ID NO: 1877 - DNA, 568 bp, Homo sapiens
aggttgggttcccccccccccagctttctttgagaccaattgaatgttaggggacaaaaaaaggtttcccctgagccccaggggagaagtgttttccccagccctgaaaacaaaaacaaaaaggcctattcccagggcccccctcctttttcttaagggggtcccgggattaaaaaggaatgagtttcatttaaaaaaaaacccttgggcagttccagtccccccaagaaggggtccttttttcccagcgggcctttcaagagccaggggagggtgaaccggcagcccccctttaagtaatgcctccctcagtggtatgcctgccaaaaaacgcaagttccggtttgatatacaaaaagggttgcaggaagaccccaattacagtccccagggtttccccaatgcccagggggcctttgttgatgatccttagctttttgctttatggcccttcctcatcagggggccgtttccccccttttccttcccagtatttaaaaaataaaagtgggatttttttggctaaaaaaaaaaaaaaaaaaaaaaaaaaaaaaaaaaaaaaaaaaaa

SEQ ID NO: 1878 - DNA, 474 bp, Homo sapiens
  misc_feature (1)...(474): n = A,T,C or G
tcctccttggtgagctggctgacactatgatgggactgaggcttcaggtggtactggagcacatgcctgtaggccctgatgccattctcagatacgttcgcagggttggtgatccccnccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttaaa

SEQ ID NO: 1879 - DNA, 524 bp, Homo sapiens
accagttgaaagtaagcctcccccgggaagccatggagcaaaaaagtggaggagcgtgcccagcccagaaccgagcctcactctggggccagccccagcgggcccaacacttgcccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggcaaaaaaaaaaa

SEQ ID NO: 1880 - DNA, 395 bp, Homo sapiens
ccatttgttttcccctttggcatctgggaaggcttgacagtgccaccccgggctatttgacagtgtgcttgggggggggaaatgttagcttctgagggatggccttgtgtgcttgctgggatcatagggacttggccagcgtttctccaacctgcttactttttttctttagctccggtttgatatacaaaaacgactgcaggaagaccccaactacagtccccagcgcttccccaatgcccagcgggcctttgctgatgatccttagctctttttttgctttatggcccttcctcatcaggggaccgtttcccccctcttccttcccagtatttaagaaataaaagtcggatttttttggcaaaaaaaaaaaaaaaaaaaaaaaaaaaaaaaaa

SEQ ID NO: 1881 - DNA, 482 bp, Homo sapiens
ccacatcctggactcttaatttcccctctctccactagcatggagactcagtggagtggttgactcatgaaagggtgagccggatggtggcactggatctgacgttgatcctcttttccctcccaaccccctgtcccacagacgatgcagggtgagggcccccagctgcttctctcagaggctgtgagccggccagctaaggcagccggagctcggcccctgacgagcccgagaagcttgagccggaacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggcaaaa

SEQ ID NO: 1882 - DNA, 512 bp, Homo sapiens
  misc_feature (1)...(512): n = A,T,C or G
ttgagggtggaaatccccccncaattccggggacatggaattaggggcagaagagtttcctgacttaagggggagatgtttcccagccctgggaacaacagcagaagagccatntccggagttcnaacttctgttctggagggggntccggggatgaacaggatggagttcagttgagaacagaaccttggggcagctgcagttccccccagaatgggtccctattatccagcaggacattcagagccagcggaaggtgaaaccgcagccccctntgagtgatgcctacctcagtggtatgcctgccaagagacgcaagctccggtntgatatacaaaaacgactgcaggaagaccccaactacagtccccagcgcttccccaatgcccagcgggcctttgctgatgatccttagctctttgctntatggcccttcctcatcaggggaccgtttcccccctnttccttcacagtatttaagaaataaaagtcggatttttntggaaaaaaaa

SEQ ID NO: 1883 - DNA, 373 bp, Homo sapiens
ggccagctaaggcagccgagtctcggctccttacgagccccgagagcctgagccgtgacctggatgcaccagaggttcaggagagctacaggcagcaggtgccaccttgaagcagaatagggatggtctagtgggaggggttgggctagggtccctcttccctggatcccttcagcgatgaactggtcagcctggtgctaccatttgttttcccctttggcatctgggaaggcttgacagtgccaccccgggctatttgacagtgtgcttggggggggaaatgttagcttctgagggatggccttgtgtgcttgctgggatcatagggacttggccagcgtttctccaacctgcttactttttctctttagct

SEQ ID NO: 1884 - DNA, 382 bp, Homo sapiens
gctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcaggagagctacaggcagcagctccggtttgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcccagtatttaagaaataaaagtcggatttttctggcaaaaaaaaaaaaaaaaaa

SEQ ID NO: 1885 - DNA, 446 bp, Homo sapiens
cttcccccagcccctggaacaacagcagaaagaggccatgtcccgaggtccacctcctgctcctgaggggggctcccgggatgaacaggatgggagcttcagctgagaccagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccaagcgcttccccaaatcccagcgggcctttgctgatgatccttagctctttgctctatggcccttcctcatcaggggaccgtttcccccctcttccttcacagtatttaagaaataaaagtcggatttttctgaaaaaaaaaaaaaaa

SEQ ID NO: 1886 - DNA, 413 bp, Homo sapiens
gtccctcttccctggatcccttcagcgatgaactggtcagcctggtgctaccatttgttttcccctttggcatctgggaaggcttgacagtgccaccccgggctatttgacagtgtgcttggggggggaaatgttagcttctgagggatggccttgtgtgcttgctgggatcatggggacttggccagcgtttctccaacctgcttactttttctctttagctccggtctgatatacaaaaacgactgcaggaagaccccaactacagtccccagcgcttccccaatcgccagcgggcctttgctgatgatccttagctctttgctctatggcccttcctcatcaggggaccgtttcccccctcttccttcacagtatttaagaaataaaagtcggatttttctggcaaaaaa

SEQ ID NO: 1887 - DNA, 264 bp, Homo sapiens
ggtgtaccaataaaaagaatttacatgataggttaacaaggaccaggaaagtgagtttcctgaaggagttctttgttcctgatcaaagaaattgatacctgtttactaattatgattgattgctatttatgccaagggagcatttcccaggcatgcctcatctatttactaacaacaaagtatgcttactttatttacatagcgccacgggtttctcttttttcttctcttttttattggcgggggagatggtactataacttg

SEQ ID NO: 1888 - DNA, 284 bp, Homo sapiens
  misc_feature (1)...(284): n = A,T,C or G
gggcccttgtngtcctggccggggatcaggggnacctgggccagcngttcctcccaacctgcttacnttttncccctttagctcnggtctgatatacaaaaacgactgcaggaagaccccaactacagtccccagcgcttccccaaatnccagcgggcctttgctgatgatccttagctctttgctctatggcccttcctcatcaggggaccgtttcccccctcttccttcacagtatttaagaaataaaagtcggatttttctggctgctttctctctaaaaa

SEQ ID NO: 1889 - DNA, 297 bp, Homo sapiens
tgcagctcttcggcactgcaaacctaaccgctaatggcgctgtgggtggagaaacgtttgttaggtagcgttatatattgttatctggtgttccctataccgaaaacggcgggtcctggccgccgggaggtactcagaccaggcttcttacatcatggttgcaggatggctgctacagctctggacatcacatcaaaatatggcagaagctaaagcaggaagacagagaaggaggcaaaacagctttattcacttgtggctctcatatgaagaataaagatatttttcgaaaaaaaa

SEQ ID NO: 1890 - DNA, 316 bp, Homo sapiens
gagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatttgaaaaacaacggctcatttaccagggacgagttttgcaagatgatccttagctctttgctctatggcccttcctcatcaggggaccgtttcccccctcttccttcacagtatttaagaaataaaagtcggatttttttgaaaaaaaaaaaaaaaaaa

SEQ ID NO: 1891 - DNA, 450 bp, Homo sapiens
aatgctgttagtttttctcctacctctttcactacttctcctcagtcttcttcccttctagctgacctctaactttagagttcctcatattttggccagtgaggagaatcctgtttattcctgtggctttaaataacatctgtgtatctataattctcaaattgaaatccaagtcctgaccttacccctgtgctccagactcatgtctacccgctgatttgtcatctcattttaatggttcatacacatcttaaatttaacacatccaaacccttgatctcaccgccttccccaaacttctttgggtcttctccgtgtcaatcaatggctgctacagctctggacatcacatcaaaatatggcagaagctaaagcaggaagacagagaaggaggcaaaacagctttattcacttgtggctctcatatgaagaataaagatatttctcgaa

SEQ ID NO: 1892 - DNA, 329 bp, Homo sapiens
  misc_feature (1)...(329): n = A,T,C or G
caggtggtaaatccatttccggggcacaanaaaccccatctttcatgcgnatggtagcacgaaagttgaagctgcatcgggcagagccagcagccatattgaagacaatgttgtccacagggtcaaaagttgccaactcctccttggtgggagctgcccctgcgataaagtaccactggcccaagtggacctctgggaactccttcccatccacgcccagagttgtcagttgactgtgctcagggcactggtagatggagttaaggataataccatagaagtagagcagagctgcccaaatttggtggaacatcttcaggcaggaggga

SEQ ID NO: 1893 - DNA, 454 bp, Homo sapiens
tcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatacagggcctcactctgttgcccagactagagtgcagtggcataattgggtcactgtaacgttgaactcctgggctcacgcaattcttctacctcagcctcccaagtagctgaaactacaggcttcttacatcatggttgcaggatggctgctacagctctggacatcacatcaaaatatggcagaagctaaagcaggaagacagagaaggaggcaaaacagctttattcacctgtggctctcatatgaagaataaagatatttctcgaaa

SEQ ID NO: 1894 - DNA, 310 bp, Homo sapiens
  misc_feature (1)...(310): n = A,T,C or G
gaatggttancaacaaagttgnaagctgcatcggggnaaagccagnagccatnatttnaagacaatgttgtccacagggtcaaaagttgccaactcctccttggtggnagctgcccctacnataaagtaccactggccnaagtggacctctgggaactccttcccatccacgcccagagttgtcagttgatctgtgctcagggcactggtagatggagttaaggataataccatagaagtagagcagagctgcccaaatttggtggaacatcttcaggcaggagggagctggtgctctgtgtgccttaac

SEQ ID NO: 1895 - DNA, 302 bp, Homo sapiens
ggtactggagcacatgcctgtaggccctgatgccattctcagatacgttcgcagggttggtgatcccccccagccacttcctgaggagccaatggaagttcaggagagctacaggcagcagctccggtctgatatacaaaaacgactgcaggaagaccccaactacagtccccagcgcttccccaaatcccagcgggcctttgctgatgatccttagctctttgctctatggcccttcctcatcaggggaccgtttcccccctcttccttcacagtatttaagaaataaaagtcggattttt

SEQ ID NO: 1896 - DNA, 322 bp, Homo sapiens
  misc_feature (1)...(322): n = A,T,C or G
cgaggtccacctcntgctcntgaggggggctccngggatgancaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagcggggactggagggcaccag

SEQ ID NO: 1897 - DNA, 212 bp, Homo sapiens
aattgacataagtgcttttacaagcaccaaagttgaatgaattttcaacaaaatgtaattaaaatctatgttttcagttatgactcaggttaagaaatgtgttttaggatctacttgctggtttctcttttttcttctcttttttattggcgggggagatggtactataacttgttatttatcagggcagatcacacatttggatcaaaaag

SEQ ID NO: 1898 - DNA, 206 bp, Homo sapiens
tggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcccagtatttaagaaataaaagtcggatttat

SEQ ID NO: 1899 - DNA, 209 bp, Homo sapiens
  misc_feature (1)...(209): n = A,T,C or G
gcttcngctgagacagaaccttgggcagctgcagtccccccagaatgggtccctattatgccngcaggacattcagagccagcggaaggtgaaaccgcagccccctctgagtgatgcctacctaagtggtatgcctgccaagagacgcaagctncatcctgttcatccngggagcccccttaaggagcaggaggtggacctcgggacat

SEQ ID NO: 1900 - DNA, 187 bp, Homo sapiens
gtccacagggtcaaaagttgccaactcctccttggtgcgagctgcccctgcgataaagtaccactggcccaagtggacctctggaactccttcccatccacgcccagagttgtcagttgactgtgctcagtgcactggtagatggagttaaggataataccatagaagtagagcagagctgcccaaa

SEQ ID NO: 1901 - DNA, 1115 bp, Homo sapiens
cgtgtgtccatgatggtgtgagtgcgcgtgtccatggtgtgtaagggcacgtgtgcccatgatggtgtgtgtgaatgcacatgtgtccatgatggtgtgtgagcacgcgtgtgtccatgatggtgtgagtgcacgtgtacatgatgcgtggatgtttgtacatggtgtgttgtttacatgtacatgacagtgtgtgtgccacgtgtgcatgatagtgtgttctgtgtgtacatggtgtgtgtgcatgtgtacatgacagtgtgccatgtgtacatgatggtgtgtgagtgcacgtgtgcatgacagtgtgtacacgatggtgtgtgagtgcacatgtacatgatagtgtgtgtgagtgcacgtgtaaaatggtgtgagtgcacatgtacatgacctcgtgccatgtgtacatgatggtgtgtgagtgcatgtgtacatgacggggtgtgtgagtgcatgtgtacatgatggtgtgtgtgccacgtgtacatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccatgcactgagtgagatttccgtaagtagt

SEQ ID NO: 1902 - DNA, 1342 bp, Homo sapiens
  misc_feature (1)...(1342): n = A,T,C or G
tttaacactgaaatatttttaatattaaaatgttcaatattttcttatttcaaggccagtgagagaagtctcacactgctcacattctgtagtgtgtcattcagggtcacgcatcacacccactgtgcttacggcgctgtcactgaacaagacgttcggttgtgcttcttccgtgaactcatacattacaaggtcagcactcgatgccgggttacagcgtctgagattcattcacgaaatgacaggatgctgatttgnttgcagatntgnatntgagtctcaangataaatggctcttgggatatggttgctatgacaatgttgttgctaggataattccaaggatcataaatggctcttgggatatggttgctatgacaatgttgttgccttcttgccttgctctgatatttgatagctttttttgtttcttctttagcgtgttctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagttatctccagctggcgctggatgcggcctttgctccgctcccgaaacagagtctgtgcctcattgtactccgccatggcttccacaaacttccgagacagcaccgaatgctgggttcttcgtatccgaagatccactgaagtccggttcccactctcatcctgatcaaaactttgttcaatagcctttaacttggctcgaattttattcgcagttttcttgatttctttgttcagatcttcaagctcttcttttatttttccttccgggtttggtgcagaaagaatgatgctgtggtttttctttacttcttcaacatattgagttattttatcaatactgtttctaatctcctccacctgatggaagaaatcatccatgaaatgatctttctcaaccacaacaactgtgtctccatcatcattcttcctacacgccgtcaggtctggcagccggtcccgcatccccgccggccgggcagcgcgccccgccgctcaagcctgtcccgagctgcctccggccgggccgcgggctctccggtctccgcctcaggccccgcggtcccggcccggcgccagcagccctccctggagccggcgctgccacggcaaccgccccccgcgcgctctcg

SEQ ID NO: 1903 - DNA, 1119 bp, Homo sapiens
acagcgtctgagattcattcacgaaatgacaggatgctgatttggttcattgcagcaggaatcttggtggtttgatgtgtgagaatcaataaacaaacttcaatataatgaacatcaatttccccaccctggcagagaggcagcactgcgtacaacatcatttgccaactgacaagccaataattagaacgattatgacaaccagaaccactgacacagcaataattatccactttttccttcttgccttgctctgatatttgatagctttttttgtttcttctttagcgtgttctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagttatctccagctggcgctggatgcggcctttgctccgctcccgaaacagagtctgtgcctcattgtactccgccatggcttccacaaacttccgagacagcaccgaatgctgggttcttcgtatccgaagatccactgaagtccggttcccactctcatcctgatcaaaactttgttcaatagcctttaacttggctcgaattttattcgcagttttcttgatttctttgttcagatcttcaagctcttcttttatttttccttccgggtttggtgcagaaagaatgatgctgtggtttttctttacttcttcaacatattgagttattttatcaatactgtttctaatctcctccacctgatggaagaaatcatccatgaaatgatctttctcaaccacaacaactgtgtctccatcatcattcttcctacacgccgtcaggtctggcagccggtcccgcatccccgccggccgggcagcgcgccccgccgctcaagcctgtcccgagctgcctccggccgggccgcgggctctccggtctccgcctcaggccccgc

SEQ ID NO: 1904 - DNA, 1173 bp, Homo sapiens
tttaacactgaaatatttttaatattaaaatgttcaatattttcttatttcaaggccagtgagagaagtctcacactgctcacattctgtagtgtgtcattcagggtcacgcatcacacccactgtgcttacggcgctgtcactgaacaagacgttcggttgtgcttcttccgtgaactcatacattacaaggtcagcactcgatgccgggttacagcgtctgagattcattcacgaaatgacaggatgctgatttggttgcagatgtggtctgagtctcaaggataaatggctcttgggatatggttgctatgacaatgttgttgctaggataattccaaggatcacaagcaaaacaattacacaaataataatgaacatcaatttccttcttgccttgctctgatatttgatagctttttttgtttcttctttagcgtgttctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagttatctccagctggcgctggatgcggcctttgctccgctcccgaaacagagtctgtgcctcattgtactccgccatggcttccacaaacttccgagacagcaccgaatgctgggttcttcgtatccgaagatccactgaagtccggttcccactctcatcctgatcaaaactttgttcaatagcctttaacttggctcgaattttattcgcagttttcttgatttctttgttcagatcttcaagctcttcttttatttttccttccgggtttggtgcagaaagaatgatgctgtggtttttctttacttcttcaacatattgagttattttatcaatactgtttctaatctcctccacctgatggaagaaatcatccatgaaatgatctttctcaaccacaacaactgtgtctccatcatcattcttcctacacgccgtcaggtctggcagccggtcccgcat

SEQ ID NO: 1905 - DNA, 637 bp, Homo sapiens
  misc_feature (1)...(637): n = A,T,C or G
nnacctttccatnggcnccttnaaaggttgcctatgcccngcctaaaaggctgacctatgnaacactccataatttaatcacctgaaccagtcccttcctgttaacagttcaactgttaaagctgcttccagcatttcagcatcacatataacactgcaattaacctgaatttggtggatccaaaataacagctttcctagatacatccactagacagagtgggatgcagtaagattttacacatgactgacatctctcttggagaatgcaagagtcttgtaactaccctgagtctccacaaacatagccatgtccatgaacatctcatgcaactctcggntgctggtcttccaggttccatgatngtccttggtgacggtgactcgatttcattgagagcttggtcttagtaaattnggtgattcttgatattaatngtcggnaggtgaaggatggttggnttccccgntcttccagaatcttcttctggntcggnggtttttggnggggtcccttccccaggtggaaggnccccgnanccanaggncccnnttcangantgaagnaaaanttnnnnaanangnccntggaacccatnnnntnnnanttaaaccngggggttccagtgttcncngt

SEQ ID NO: 1906 - DNA, 518 bp, Homo sapiens
ctgactcagcaacaaattactagacaagctctcaatgaaatcgagtcacgtcacaaggacatcatgaagctggagaccagcatccgagagttgcatgagatgttcatggacatggctatgtttgtggatctgatataatgtcggaagtgaagatggatggcttcccgctctccagcatctcttctagctcgtcgtctgtggtggttctcccagttatctccagctggcgctggatgcggcctttgctccgctcccgaaacagagtctgtgcctcattgtactccgccatggcttccacaaacttccgagacagcaccgaatgctgggttcttcgtatccgaagatccactgaagtccggttcccactctcatcctgatcaaaactttgttcaatagcctttaacttggctcgaattttattcgcagttttcttgatttctttgttcagatcttcaagctcttcttttatttttccttacgggtttggctgactgagaatttcgtacgtagtagtacta

SEQ ID NO: 1907 - DNA, 1050 bp, Homo sapiens
  misc_feature (1)...(1050): n = A,T,C or G
tactactactacctacggnattctcactcagccttcctaattaaccttcatgcacatttgttaacactgaaatatttttaatattaaaatgttcaatattttcttatttcaaggccagtgagagaagtctcacactgctcacattctgtagtgtgtcattcagggtcacgcatcacacccactgtgcttacggcgctgtcactgaacaagacgttcggttgtgcttcttccgtgaactcatacattacaaggtcagcactcgatgccgggttacagcgtctgagattcattcacgaaatgacaggatgctgatttggttgcagatgtggtctgagtctcaaggataaatggctcttgggatatggttgctatgacaatgttgttgctaggataattccaaggatcacaagcaaaacaattacacaaataataatgaacatcaattttcccaccctggcagagaggcatgcacactgacgttatccacaccatcatttgccaactgacaagccaataattagagcgattatggcaaccagaaccactgacacagcaataattatccactttttccttcttgccttgctctgatatttgatagctttttttgtttcttctttagcgtgttctacatagtctgtggcattcataacatttctttctatgttgttgatcatttcaccctgagtctccacaaacaatagccatgtccatggacatctcatgcaacctctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcgtcgtctgtggtggttctcccagctttatccctgaaacagacccgtctgtccccgaagaaggcgccatttccactgccacagccaactgtccccatagacacccctgaaaagagtctggggcaatagggccgctgcctctgctcacagacaaggagagatgtgaggagccatgaag

SEQ ID NO: 1908 - DNA, 521 bp, Homo sapiens; identical to SEQ ID NO: 1637

SEQ ID NO: 1909 - DNA, 436 bp, Homo sapiens
tttccattttaaaataaaacatttattaattaattatttcttggaataccttttaggcaggcttacatcaatgtattacaacttgaaaccaaatgaagagaaaaacgcagcttaattcttcgaagccaaactcacccttcttgccttgctctgatatttgatagctttttttgtttcttctttagcgtgttctacatagtctgtggcattcataacatttctttctatgttgttgatcatttcaccctgagtctccacaaacatagccatgtccatgaacatctcatgcaactctcggatgctggtctccagcttcatgatgtccttgtgacgtgactcgatttcattgagagcttgtctagtaatttgtgaatctgatataatgtcggaagtgaagatggatggcttcccgctctccagcatctcttctagctcg

SEQ ID NO: 1910 - DNA, 532 bp, Homo sapiens; identical to SEQ ID NO: 1308

SEQ ID NO: 1911 - DNA, 355 bp, Homo sapiens
tatcagattcacaaattactagacaagctctcaatgaaatcgagtcacgtcacaaggacatcatgaagctggagaccagcatccgagagttgcatgagatgttcatggacatggctatgtttgtggggtctcaaggataaatggctcttgggatatggttgctatgacaatgttgttgctaggataatttcaaggatcacaagcaaaacaattacacaaataataatgaacatcaatttccttcttgccttgctctgatatttgatagctttttttgtttcttctttagcgtgttctacatagtctgtggcattcataacatttctttctatgttgttgatcatttcaccctgag

SEQ ID NO: 1912 - DNA, 291 bp, Homo sapiens
ttttttttttaacactgaaatatttttaatattaaaatgttcaatattttcttatttcaaggccagtgagagaagtctcacactgctcacattctgtagtgtgtcattcagggtcacgcatcacacccactgtgcttacggcgctgtcactgaacaagacgttcggttgtgcttcttccgtgaactcatacattacaaggtcagcactcgatgccgggttacagcgtctgagagcgggtgcgggtgggagctcatggagaactgtggagctggggggtcggcttgtggtcg

SEQ ID NO: 1913 - DNA, 5232 bp, Homo sapiens
tttttttttttttttttcaacaattccaaaaggtttatcttccttacgttggtattataccaatataacgcaaaagggcaggaaatcacacaaaattcgctttaaaatagacaaagggtccagcactatcaagagaacattcaaccaggggcagcagttgaggcgcccaggacctgcttggacacacgcacatgcggccgcgacggaagcaagaggaccaggacaccgggcaagatccccgcagtgccagcttcccaggactcaggattccagtcggccatgaagcaataaatacaaacatgccccacaaggtgagaataaagccatcaaggtgatgaggaagaagtcacggggattttcttcttctaagtccaagcacagtggcaatatttcaagtattgcaaagaaaaacacacgtgtgtgtatttttgtctgttatgtggcgtgtgaccctggaaccccccgcatgggtccatggccccaccactgcctcccgcagactggggactcgttcaagtatctactgattcaggcagggctaaccgagggctgggcagaccaagggaggcccaggcggggtttgcagggcatgcccgcctggaatccggaaggcaggcctctctgcagacgccctccgtggccttgggcaaggcagaggcagggagggacagggctgtcatcaggcctaccctgccgaggagctgacatcaaaactgactgtcaaagctggacggggagcttttgcacatgttacttttttctttgcatgaagtattcccctcatctgcttccaggcccaggtagggagggtgctgggcacacacctgtcctgctgctgccacagggaggggcggcaggggacagccaccaacacaggtgtgcaaagcagcctcacccgcccgccacacgcccctgtgccatctgcctctaacctggcccagtcctcgccctcccaaaaccaattcttaaacacctacaagttttctcctttaaagaaaaaatgagctgcataaaaataagacacgttttaggaataaagtgtgaaagattacaagacgtatccagggctgagagaacacggtgcctctgctgccggtccccagaggaacgcttgaacaaagaactgcctctgcctctagcgcagggccccactccccccggagccagttctcccgctgaggtccagacctgggcagcaacgtggtccggtgctcgggcttggggggccctggcatgtgtctgcatatgtgtatgtacaaacaccaggccactgccaggaatcgctgcccagcagtccctggtgaggtccaggttctgtctctatatgcataaagtgcttgggtgattgacaaagctgggtgggtatctcggagggagaggctcctggagactgggggacgccgaggccgcaggctcttcctgggcacagtgcctgctgacctgccctaagcaggagctcgctttggctttgagtcggcagtggtctcaggcccttgcctgtcctccggggctgccctggggctagagggtggtggcacccacgcctgctgagccaggcagctggaggggcagaaattctgtgatccccacctgtaaaagatgggagacaccccccaagctgtgtggctccagatgtgctggttctgccccgtgagctgcagggaggccggcaggctgactgtccgtggggcccagggcagggctcagcaccagcgatcagcgccatgggcttgtcccgaggagtccagccagcacacagagcccactctgcagggctcggcaggacggggggcccagccaggccagaaaggtcaggcacagatgccagtcagcagcgccgagagtctccgctcaatgcacagcttgcacttggtgacgttctcgatgtcggcctggtccgagagcatgtgctgcagcccctccaggagcagcagggccttgtggtagcgtgggacgcagccctcacggtgctggaacatctcgtccagggcagccgactgcaccatctgcacagcgtggctgaagatgagcctctcggcagtgatgctgtgaatgcggtccaggagccgctgcttgtccaggaagaagcgctgcagccgcaggctcaggccctggcaggacaccacgctggccttgtacagctcattcagcctgcgcaccacctgcttcacagtggacgacaggcagagcttgccggcccggatctggtcgatggcactttgcaggccggaggacagtagctcggccaccttcaggtacagcaccagctgttccgcgaagccccattctcggctcagcaggctgatctggtcggccaccacactctcctgcagctggtactcagggccccccgccgcctcactggcgctgcccttcagggctgcgatctccaggacgtgctgcacgaacagcagcgtgaagcgcaggccacgcaggatctccgtgtgctcttgctccatgagggtctcctcagggaggtcgggggcctcgaaggtcacagccccctccaggttcgcagcaatggggtcggcaaagctgcagccgtgtcctggagcagggagctcaggggctggggcctcgctgcagggcccaggcaccaggtggcgggcagaagagctggcagagccagtggggcccgctgagaacatcctggtgcgggggccctgggggggcgtgctcccgctcgggggagagcccacggtgaagaccaccggggaggggctgctggtgcccccagcacgggctcctgggtgcaggctccctccaaagccagctgagggtgcgatctccatgggcttctcctgcaggctctccgtgctgcccgggtccggggcttgtgtcccaaacgccgccttaaggagcaggtcagtgaggcggctggtgctgaaagaccggccaaaggggcccttggggtcctcgcctggccgcaggccagggcccaacggctgaccatggaagggtcccacctccgagaggtcgggcagcgtccggtttcgagggggcgtcatcaccacgccctgccgggctaggagggccagcaggttctgggagctgggggtcttcgggaagtcaaaggagggcacagccttggtgggggagcccaggatggggggcagggggtttcgctgcaggaagtcgggcagcttgggtgagccccgcaggttccggcaggactgcaggccgtgggacggctggggagggctggcctgtggtgggctgaacacagctcccagggggtccgtggggggtttgggcagcttggggcggacgacgtgcaagtcagacaggttgggggcgctgtgcaggcggcagcccagcccggaagtgcggggagagtgctcgggtgcagaggagcctggacgaggggacctgccaccccgcatctcagctccctgtggggagggcgtcccgctccagcctggccgctcagggatggttccaacttgaggagatggcgtgtagggccggcctccacccagagacatcttcctggccaggacgcctccatgctcagcgtgggcagggggcgaggggctggcccttgcaaagcccagggggctggtgctgcctgacctgcggatggcagaggaccgaggtgtttggaactgggtgggtgactgcaggtttcgctcaatgcgctggtagttctgcacctgcgtggggactgggatggggacagaggcgccgcacctgctgctggagaacgggccagcccggcctgagggactgggggagctgctgcagggtggggatggagatggggtccggccgtggctctccaagcccgcagaggccaccagtgagctcccactgcacatcaggctgtctggcgggggtttggcactgggcgcctcagccaccaggtcacctggaaactgcgcggggaccatgacgaagtcgtctgtgtcacaggaagagtccttgctgccaccagagtcccgggagctgtgcaggaagccagcggtgtcagccggggaggccagggtcttctgcagctgctgcatctcgcccagggacggcggggaggccaggtgggaggtggagctgctgctggagctgctgccggaccccgagcttgggtacgagggcacaggcacgggtggggatttcctgaccgaggggctggcatcgaggaaagggtgatgaaaaaactcatcgaagtccatgcggtccttgtggttgcgttgcagtagggccaggagcagctgccgcagcggggccgaggtctcccgggggatggtggggaccaacgtcttgttcttcgcgtagaacaggcgctggtcctcccggcggctggccgggaccggcgccttccccgtcaggcactggtagacgatggtgccgatgctccacaggtccgccttcccgtcgtagtgctgggacatgatgacctcgggggccatgtacatgggggagccgcagagtgtggccgccatcatgttgctctggaggtaccgcgcgaagccgaagtcagcgatcttgacgcggatgctgttggggttggcgcggcggccggcggggttggacagcaggatgttctgcggtttcaggtcgcggtggatgatgcctttgctgtgcagaagccgcatggcgcccgcgatctgctgcaggaagagcctgatggtgtcctcgctcagcgtgcgcatggcgtgcaggtagtcggccaggtccccaccgttgcagtactccataaccaggtagacagaattagccatttcctggaagtcgtacagggccacgatgttttcatgtttcagttccttcaggattttgatttccttccccagcagcgtctgagacttggcgaggttcttcttgttaatgcacttgacggcgacctccaaatcgtgcttctcgcggtggcggcccttgaagaccaccgcgaaggcgccgtggccgatcaggtccttgcgggagaactcgaacttgcccacggtctctgtgccgccgcggccgggctccatggcgcaggcgggccgggggcgcggggcggggggtggcgggccaaggcgcgggggactcaggcggaggcgcgggccggggcgggcgggccgggggcgcggggccgggggcgcggggccgggcgagggcgcatctccggggccgcgcgccccatcgggcaggccggggccgggtcccagccccgcgggccaggcggggtccgagggtcgcgctccctccggcgcctgtgccacggcactcttcccgggctgctaatccgaatccggatcc

SEQ ID NO: 1914 - DNA, 388 bp, Homo sapiens
ggacaccgggcaagatccccgcagtgccagcttcccaggactcaggattccagtcggccatgaagcaataaatacaaacatgccccacaaggtgagaataaagccatcaaggtgatgaggaagaagtcacggggattttcttcttctaagtccaagcacagtggcaatatttcaagtattgcaaagaaaaacacacgtgtgtgtatttttgtctgttatgtggcgtgtgaccctggaaccccccgcatgggtccatggccccaccactgcctcccgcagactggtagacgatggtgccgatgctccacaggtccgccttcccgtcgtagtgctgggacatgatgacctcgggggccatgtacatgggggagccgcagagtgtggccgc

SEQ ID NO: 1915 - DNA, 741 bp, Homo sapiens
  misc_feature (1)...(741): n = A,T,C or G
agacagagtctcgctctgtcacccaggctggagtgcagtggcgcgatctcggctcattgtaaataacacgggccacttccaaggccacagtttctctcccctaaaatacagaggtaagggatgggggctcacccactgcacatcaggctgtctggcgggggtttggcactgggcgcctcagccaccaggtcacctggaaactgcgcggggaccatgacgaagtcatctgtgtcacaggaagagtccttgctgccaccagagtcccgggagctgtgcaggaagccagcggtgtcagccggggaggccagggtcttctgcagctgctgcatctcgcccagggacggcggggaggccangtgggaggtggagctgctgctggagctgctgcccgacccccgacttgggtaccaaggcacaggcacgggtggggatttcctgacagaggggctggcatcgaggaaagggtgatgaaaaaactcatcgaagtccatgcggtccttgtggttgcgttgcagtagggccaggagcagctgccgcagcggggccgaggtctnccgggggatggtggggaccaacgtcttgttcttctcgtaaaacaggcgcangtcctgggggctgctggcctgaagggcgccctccccgtcnagcactggtagnacgatgtgcgatgcttcacaggtccgccctttcggtctagtgcttggacatgatgacctcggggggcatgtacatggggaagcc

SEQ ID NO: 1916 - DNA, 686 bp, Homo sapiens
  misc_feature (1)...(686): n = A,T,C or G
cncnntttttggggaaaaaaanncnnggggaatttctttcntnccaaaaaccccaaannannntttgnaaaaaatnccaaaggnttttcccaaaanaaaaaaaaaaanccttntttttgaagnntttggccttgnaaatnnggccnttntngaccccgggaacccccccccnanggggngnaattgnccccnncnncctgcctncccnaaaanctgggggattcggtccaagtancnncttgatcaagncagggcctaaccngagggctgggcaagcccaagggaggccaggccgggggtncagggcatgcccncctggaatcnggaaggcaggcctctctncaagacncccnccgtggccttgggcaaggcagagacagggagggacagggctgtcatcaggcctacccttccgaggagctgacatccaaactgactgtcaaanctggacggggancttttgcacatgttacttttttctttgcatgaagtattcccctcatctgcttccaggcccaggtagggagggtgctgggcacacacctttccttcttcttccacagggaggggcggcaggggacaaccaccaacacaggtgttcaaancagcctgacccgcccgccacacgcccctgtgccanctgcctntaaccggcccatcntctataaggaaccaccggnaagann

SEQ ID NO: 1917 - DNA, 679 bp, Homo sapiens
gaaatcacacaaaattcgttttaaaataaacaaagggtccagcactatcaaaagaacattcaaccaggggcagcagttgaggcgcccagaacctgcttgaacacacgcacatgcggccgcaacggagcgcaagaggaccagacacaccgcgcaagatccccggggtgccattttcacaactctcgagttcacactggcctgtaacgctatatacacacacgccccacacagtgagaataataccatcaaggtgatgaggaagaagtcacggggattttcttcttctaggtccaagcccagtggcaatatttcaagtattgcaaagaataacacacgtgtgtgtatttttgtctgttatgtggcgtgtgaccctgcaaccccccgcatgggtccacggccccacctctgcctcccgcagactggggactcgttcaagtatctactgattcaggcagggctaaccgaggtctgggcagtccaagggaggcccaggcggggtttgcagggcatgcccgcctggaatccggaaggcaggcctctctgcagacgccctccgtggccttgggcaaggcagaggcagggagggacagggctgtcttctggcttaccttgcagaggagattacactgtccagtcattgggttgtgcaggccgtgtattcgaattctagtagtcggcg

SEQ ID NO: 1918 - DNA, 227 bp, Homo sapiens; identical to SEQ ID NO: 1683

SEQ ID NO: 1919 - DNA, 1534 bp, Homo sapiens
gatcatgccctccatgtgatcaactcagatgacactcaatgaccacctcagtacaaagattcatcctgagacaaggagcacagatggaccttggccaggcccaagggcaatgggcaaagagctcctgaggagctgaaacccaggttcctagacctcccagaggggggacaaatcctgctgactccaaggcctggcttggcagctggtacctgctggaagtacgcagcaaagcggtgcaggtactggtcatagggcagcatggcgtgtgtctcacacccaaagcagttgatgtaccagatacccagcagggccagcaagacgggggcgttcttctccaggggcgtcgtgcggaagtgctggtcctgaaacaggagcaggattgtgggagctgagcagctgcacggggaggggagggacaggacagtgggggagaaagcgggggaccaggaccaacacacgcgcctctggccagcacttggcagagaaccagcctcagcactaccatccagtgagcccccgagagcagctgctcgaagttgtcaaaacctgtgacacaaaagcagagtcaacagaagtggccacaccctcgtcctgtgggcagtgggcacagctccttctgcaacgaaggaaggctgcatggagagccagaagatacgacatgggaggactcggacctagacaaagcccctccagtgagaggtggccctgagtgcagggatctgactctgcctaggataggagagaaacaggactcagttgtgaggggcaaagacgggggccaacttgcacacgcaaaaaaacccagaccttccttctggacatgaaataaatatcccagccagctgtagagaggccagcagcctgtgaggacagcatgatgttcaaggatagaaccccctaccccgaccttagactgcaacactgtctcctcacaggggctgcaagacacataaacacactcacccacgtgcagggcaatggagagtccgatggccgaccacagcgagtagcgtcctcccacccactaggagagacaggacaacggagctgagggagggccggcacaccccgcccccacctcctgccggaaaccctgtcccttgtcttgcacaggggcgtctcggagggccctggcccaacccacctccaggaagcaaggcagcaggcaggtgctggcaacacatgggaagaccaacagggcagactacagatgactgaccacagccacaagacaaactgaagagcttaccgtggtcttccctgagatgtcgggccctgtctctgcagacaccagcagacccaggacctcatacctgtgccagggcccacctcctcagacacggacacacccagggcctcatacctgcgccagggcccacctcctcagacacggacagaccccaggcctcatacctgtgccgggcccacctcctcagacacggacacacccagatcctcatacctgtgccaggtgctacctactcagacacgggagaccagatcctcatacctgtgccaggtgctacctctagca

SEQ ID NO: 1920 - DNA, 596 bp, Homo sapiens
gggtatgtgggcctgctacctcggtgtagttgatcttctcaccattgaacatccgctcccgggcggcctccacgcccctggacttggcctaggaagagacgatactgaggcctggtcccacccacactggccaccccaagtgtcagcccccaaacacaaggcttggtgctgtccccaatgagacagacagacggctgctgtctggttccctcccctgctgtctgggaagggtctactcagacatcagacactggggtccctgggatgctgcttagaacctaagccagggacaggtgcctcaccagcacagaggaggtgactgaggtctaatgagaggaagaactcaagatactcaaggtcctgggactcccagagcccagctcacccaccactctgtcggttaccagttatgcctccccaagcagaacattaccaagtccaccagcatccgcatcacgtcctccgtcaccaggttcttggagtaatccaccaggatatgcccatggttggtgttgagggtcaagctgcagaaagatggagatgctgctgaccacaccctggtctcctagcggggagccatgccctaagcaggagct

SEQ ID NO: 1921 - DNA, 522 bp, Homo sapiens
ccatggttcactcggaacccaccaaaaggaccaatggccagggggatggcaagacagctgtccctccccaccccaacacacacaggccaggggccgggcagttttcggcactcataccttggaggcaatgatgaacagggaggactccgggttcagctgggccagggttttggcaatgtgagttccatcaatgttggagacataccagacgcggggacctcctgaagagtatggcttaagggcttcagtcaccatgaggggtccctgcggggagacatagcatcagagaataagaattcagggcccacgaaaagtggagacagccaggtcccatccctggagaaagtaaagacctgagtgggaccaacagtgcccagactcccaccctaccccaaggcagttttctcctcaccaggtcggagccgccaatgccaatgttgatgacgtccgtgatggtcttgcctgtgtaccccttccagtcaccgctccggacacgctggcaccaggggcgaagataccatc

SEQ ID NO: 1922 - DNA, 2090 bp, Homo sapiens
ttttttttttttttttttttttttttttttttttttttttttttttttttttctcccccgtggcatctttatttttctacatgggatgtgaacaacgtgaacatgggtcagaaaagtcagctgcacaaaaacacttcagccaattctaacacagagggagcatagacatggaggggctgggggttaggctgggggagaccagccttccctgctaagggctcgtggtccaagcccacaaccagagggtgctctgggtggtgtccaggaacatgcagtgccggctccggggaggagggacgagaagagaaaggggagtcacagaggaggctgcagatgagcacgagtttattggactctggcctcgcgctgctgcttgatgaagttgatgagcccattggtagaagcgtcgtgagaggtcacttgagcactgccatcaagctcaggctctattttcttagccagctgctttcccagctccactccccactggtcaaagctgttgatgtcccagatgatgccctgaacgaagatcttgtgctcatacatggcgaccaaggctccaagcatgaatggtgtgagcttggtgaacacaatagagttggttgggcgatttccttcaaagaccttatgtggcagcagcctctcaaggtcctctggactcttgcccgcagcctggagctcctttcgggcctcctccgtcgattttcccctcatcagggcctctgtctgggccaagaagttggccaggaggatcttgtgatgcagacccttccgtatggggtgctgggtctggaccgggatgaggaagtcacagggtatcatcttggtgccttggtggatgagctggtaaaaagcatgctggccattggtccctggctccccccacacaatggggcctgtctggtggtccacacgggttccagatttggtgatgtatttcccattggactccatgtcgccctgctggaagtacgcagcaaagcggtgcaggtactggtcatagggcagcatggcgtgtgtctcacacccaaagcagttgatgtaccagatacccagcagggccagcaagacgggggcgttcttctccaggggcgtcgtgcggaagtgctggtccatccagtgagcccccgagagcagctgctcgaagttgtcaaaacccacgtgcagggcaatggagagtccgatggccgaccacagcgagtagcgtcctcccacccaatcccagaactcgaacatgttttgagggtcaattccaaactccttcactttggttgtgttagtagacagggcaacaaagtgcttcgccactgcagaaggatccttggccgcctggagaaaccactccttcgccgtctctgcattcgtgatggtctcctgggtagtaaaggtcttggaggcaatgatgaacagggaggactcggggttcagctgggccagggttttggcaatgtgagttccatcaatgttggagacataccagacgcggggacctcctgaagagtatggcttaagggcttcagtcaccatgaggggtcccaggtcggagccgccaatgccaatgttgatgacgtccgtgatggtcttgcctgtgtaccccttccagtcaccgctccggacacgctggcagaaagacttcatcttgtccagaaccttgttgacctctggcatcacatccttgccgtctaccaggatgggtgtgtttgaccggttccgcagagccacgtgcagcacggctcgaccctcggtgtagttgatcttctcaccattgaacatccgctcccgggcggcctccacgcccctggacttggccaagtccaccagcatccgcatcacgtcctccgtcaccaggttcttggagtaatccaccaggatatgcccatggttggtgttgagggtcaagctgaagtggttgaagcggtccttgttggcatcgaagaggcggcgcaggttcagctcggagcggtgctcgcggtaccattgctgcagcttctggaactgggggtcccgggtgagagcggccatggcgggactagagagtacactgagtgagacacgaacccaggaggaaggagcgccggcagcgcgcagca

SEQ ID NO: 1923 - DNA, 567 bp, Homo sapiens
tttttttttttttttttttttttttttttttttttttttttttttttttttttttttcccccccggggcatctttttttttctacatggggtgtgaaaaacgtgaacatgggtcaaaaaagtcagctgcacaaaaacacttcggccaattctaacacagggggggcctaaacctgggggggctgggggttaggctgggggaaaccacctccccttctaagggctcgtggtccaaacccacaaccaaggggtgccctggggggtttccaaaaaaattcagttccggccccgggggggggggacgagaaaaaaaaggggggtcacagagggggccgcaaatgagcacgagttttttggaccctggcccccccccgccgctttaagaaatttaagagccccttggtaaaaacgtcgtgagaggtctacttgagcactgccaacaagcccaggccctatttttttaggcagggggtttcccagcccccccccccactgggcaaaaagttttgtttcccaaatgaacccctaacgaagaattttgttctcttaaatgggggccaaggcctcc

SEQ ID NO: 1924 - DNA, 522 bp, Homo sapiens
ccccttagatggcctagatgggctcttaccttgtgatgcagacccttccgtatggggtgctgggtctggaccgggatgaggaagtcacagggtatcatcttggtgcctgtgaagggcatgtggtcaccacatgaccccagcccatgggagctagccatatggcctagaggagggcactgacctaagttagatatctcttctggaagatcctttcctcccccaacatcacacttcctaggcgacaggggcctaccttggtggatgagctggtaaaaagcatgctggccattggtccctggctccccccacacaatggggcctgtctggtggtccacacgggttccagatttggtgatgtatttcccattggactccatgtcgccctggaaaatggaacagaaacccagttcttggcaaaatgaaagaacatttaaaaagaaagaaagaggctgagcgcagtggctcaagctgtaattccagcactttgggaggccaaggcaggcggatcacctgagttggaag

SEQ ID NO: 1925 - DNA, 1896 bp, Homo sapiens
  misc_feature (1)...(1896): n = A,T,C or G
tctcctgcctcagccctcccgggaggcggaggttgcagtgagccgagttngcaccactgaacttccagtctggggtgaccagagcgagactcaaaaaaaaaaaaattccagttttcaatatctgcctttttaaagcaaaagaactacctgagcgtcttgccagggagatggcagtcatcctcggtcttgtccaggaattcacccgaaacaaacataatctcaatgcagtttttagaaccatcgagtgaacagagtatccaatttctccagtcacagaggtgaggagtggaaaacagtcttgggatttggtgacacaggccaagttgccgtcctgactgattgtgcccccaccccactattgtcttctcagggcaccttgctccactctagacccgctcaccacttagtgttaagtgtccgcagaggcacagcctgcgtcctgctgagcgctcctgccctctgctacataaagcaccatcacaggaaaaaaaaaatcagaggctgagcctttttttttttttttttttttttttttttttaacaaccccccccggggcatctttatttttctacatgggatgtgaacaacgtgaacatgggtcagaaaagtcagctgcacaaaaacacttcagccaattctaacacagagggagcatagacatggaggggctgggggttaggctgggggagaccagccttccctgctaagggctcgtggtccaagcccacaaccagagggtgctctgggtggtgtccaagaacatgcagtgccggctccggggaggagggacgagaagagaaaggggagtcacacaggaggctgcagatgagcacaagagtttattggactctggcctcgcgctgctgcttgatgaagttgatgagcccattggtagaagcgtcgtgagaggtcacttgagcactgccatcaacctcaggctctattttttagccggctgctttcccaagctccactccgccacgaagggaagggaagggaagagtggtatgaggaaggctaacgtgctactgaaatccctgagccgacacaaatggtattcccggccctcccctaagtgagcaactcacccccactggtcaaagctgttgatgtcccagatgatgccctgaacgaagatcttgtgctcatacatggctgcagaagtgacagacagggcacatcagggctccacaagcccattccaacctaccccaagccaggacctttcccctactcactcaccgaccaaggctccaagcatgaatggtgtgagcttggtgaacacaatagagttggttgggcgatttccttcaaagacctgcagaaaacaccaaggaatgtctccaagagagtcctgatccctaaaccccttaagggaagcacaccctgccccagaggctgagacgtgcaggtctgtgaggacagccctcccattctgtaggacaagccaggcatgccccaagcccctgcctggtgccatagcttcacacctccaactccagcatgcaccccaaatccaaatgcagaagtgctgaccttatgtggcagcagcctctcaaggtcctctggactcttgcccgcagcctggagctcctttcgggcctcctccgtcgattttcccctcatcagggcctctgtctgggccaagaagttggccaggaggatctgatgagcgagacatcagttatgcttgagagcactgtctgggcttcaggcagagggacaagaccgcctggtacttctcagcaggggtcagtccagcctgggtcactcgctgtacagctcagttggagcgagggggcacatccgatgacaccacaaggcagggaacagtgtaactctctttaagaactatacaccagtggccaggcgcggtggctcagctgtatcccgac

SEQ ID NO: 1926 - DNA, 496 bp, Homo sapiens
  misc_feature (1)...(496): n = A,T,C or G
tttttttttttttttttttttttttttttttttttttttttttttttttctacaggggatgggaacaacgggaacaggggtcaaaaaagtcagctgcacaaaaacccttcacccaattttaacacaaagggagcataaacatgggggggctgggggttaggctgggggaaaccacccttccctgctaagggctcggggcccaaccccacaaccaaagggggctttggggggggtccagaaacatgcagggccggctccggggaggagggacaaaaaaaaaaaggggagtcacaaaggaggctgcaaataaccacaattttattggactttggcctccccctgctgcttgataaaattgatgaccccattggtaaaagcgtcgggagaggtcacttgagcactgccatcaagctcaggctctatttttttagccagctgtttncccagctccactccccactggacaaagctggtgatgccccaaagatgccccgaa

SEQ ID NO: 1927 - DNA, 514 bp, Homo sapiens
tttttattatttttttttttttttttttcccccgtggcatctttatttttctacatgggatgtgaacaacgtgaacatgggtcagaaaagtcagctgcacaaaaacacttcagccaattctaacacagagggagcatagacatggaggggctgggggttaggctgggggagaccagccttccctgctaagggctcgtggtccaagcccacaaccagagggtcccctgggtggtgtccaggaacatgcagtcccggccccggggaagaagggcccgaaaaaaaaagggggttccccaaggagggctccaaatggccccggtttttttgggctcctggcccccccctgctcctttaagaaatttgatgagcccccttggtaaaacccctcctgaagaggtccccttgagccctgccattaaggcccggccccaattttcttaaccaggggtttcccaagttcaatcccccctggttaaaacctttggatttcccaaataagcccctgaagaaaatc

SEQ ID NO: 1928 - DNA, 511 bp, Homo sapiens
  misc_feature (1)...(511): n = A,T,C or G
cccgccttgctgagcgcgggttcctccgtggcatctttatttttctacatgggatgtgaacaacgtgaacatgggtcagaaaagtcagctgcacaaaaacacttcagccaattctaacacagagggagcatagacatggaggggctgggggttaggctgggggagaccagccttccctgctaagggctcgtggtccaagcccacaaccagagggtgctctgggtggtgtccagaaccttgttgacctctggcatcacatccttgccgtctaccaggatgggtgtgtttgaccggttccgcagagccacgtgcagcacggctcgaccctcggtgtagttgatcttctcaccattgaacatccgctcccgggcggcctccacgcccctggacttggccaagtccaccagcatccgcatcacgtcctccgtcaccaggttcttggagtaatccaccaggatatgccatgtttgntgttgagggtcaagctgaagtggtgaagcggtccttgttg

SEQ ID NO: 1929 - DNA, 638 bp, Homo sapiens
ttttttttttacaacctcctccgtgctccggcatctttatttttctacatgggatgtgaacaacgtgaacatgggtcagaaaagtcagctgcacaaaaacacttcagccaattctaacacagagggagcatagacatggaggggctgggggttaggctggggggagaccaccttccctgctaagggctcgtggtccaagcccacaaccagagggtgctctgggtggtgtccaggaacatgcagtgccggctccggggaggagggacgagaagagaaaggggagtcacagaggaggctgcagatgagcacgagtttattggactctggcctcgcgctgctgcttgatgaagttgatgagcccattggtagaagcgtcgtgagaggtcacttgagcactgccatcacgctcggctctatctttcttagccagctgcttctccagctccactccccactgttcaaagctgttgatgtccaagatgatgccctgaacgaagatcttttggtccaatatggcgaacaaggctccacgcattattggttggggtctgtgagaacaaatagagttgttggggggttctcttcaaacctatgtgggagaacccctcaaggtcttctgattcttgccccagctggag

SEQ ID NO: 1930 - DNA, 496 bp, Homo sapiens
tttttttttttttttttttttttttttcctccgtggcatctttatttttctacatgggatgtgaacaacgtgagttccatcaatgttggagacataccagacgcggggacctcctgaagagtatggcttaagggcttcagtcaccatgaggggtcccaggtcggagccgccaatgccaatgttgatgacgtccgtgatggtcttgcctgtgtaccccttccagtcaccgctccggacacgctggcagaaagacttcatcttgtccagaaccttgttgacctctggcatcacatccttgccgtctaccaggatgggtgtgtttgaccggttccgcagagccacgtgcagcacggctcgaccctcggtgtagttgatcttctcaccattgaacatccgctcccgggcggcctccacgcccctggacttggccaagtccaacagcatccgcatcacgtcctccgtcaccaggttcttggagtaatccacaggatatgcc

SEQ ID NO: 1931 - DNA, 491 bp, Homo sapiens
  misc_feature (1)...(491): n = A,T,C or G
ctcacgaggcatcatttatttttataaatgaggatgtgaacaacgtgaacaatgagtcagaaaagtcagctgaacaaaaacaattcagccaattctaacacagagggagcatagacatggaggggctgggggttaggctgggggagaccagccattccaatgcataaaggctcgtggtccaagccaacaaccagagggtgctctgggtggtgtccaganacatgaagtgcaggctccgagaagaaagaacaagaagaaaaagaggaaaccagagaaagctgcaaatgagcacgaatttattggactctagactcacactgctacttgatgaagttgatgagccacttggtagaagcatcatgagaggtcacttagacactgacatcaagctcaggactcattttcttaacacgctgacttccacgatacgatccccaatggtacnagacgttgatgtcccagataatgccctgaacgagatcttatgatca

SEQ ID NO: 1932 - DNA, 440 bp, Homo sapiens
  misc_feature (1)...(440): n = A,T,C or G
tagaccttatgtgcagcagcctctcaaggncctctggactcttgcccgcagcctggagctcctttcgggcctcctccgtcgattttcccctcatcagggcctctgtctgggccaagaagttggccaggaggatcttgtgatgcagacccttccgtatggggtgctgggtctggaccgggatgaggaagtcacagggtatcaatcttgntgccttggtggatgagctggtaaaaagcatgctggccattggtcnctggctccccccacacaatggggcctgtctggtggtccacacgggttccagatttggtgatgtatttcccattggacttggccaagtccaccanatccgcatcacgtcctccgtcaccaggttcttggagtaatccaccaggatatgcccatggttggtgttgagggtcaagctgaagtggttgaag

SEQ ID NO: 1933 - DNA, 365 bp, Homo sapiens
ttccaacttcaggagaaacacggccagcttggcactcaggggcccaccctgctcttcccagcccagaggctaaccacgaggaaggccctatagccaactcacatccttggccgcctggagaaaccactccttcgccgtctctgcattcgtgatggtctcctgggtagtaaaggtctgcaaccaaagagaacagcagtgggcgcccgagcttaggggtgggtgcaggccttgagccagggttcagcagtagaggccaaggcaatgcccagctgtcccatggagcagtatctgcaggtcagtgacagtgacgcacataacctcctgagattccagctctttaaaaccagaggaggggggacggtaaa

SEQ ID NO: 1934 - DNA, 331 bp, Homo sapiens
agaccctaaataactcacacacacgacaagggtgagtgcggcccagtagccacttacctggcagaaagacttcatcttgtccagaaccttgttgacctctggcatcacatccttgccgtctaccaggatgggtgtgtttgaccggttccgcagagccacgtgcagcacggctcgaccctggggattacggtcaggatataaagactgtcccccccaaccccaggcagccatgctcccagctgggcatggtgccatagctcggccctctatccactagacaggcaggcctgaggtctctgttagcaccataaccttgttccaagaccatctg

SEQ ID NO: 1935 - DNA, 164 bp, Homo sapiens
agtagctggacagcagctgcagcgcttctaccacaaggctgtacggcatgctacacattgaggggatgaggaagtcacaaggtatcatcttggtgccttggtggatgagctggtaaaaagcatgactggccatttggtccctggctccccccacacaatagggg

SEQ ID NO: 1936 - DNA, 530 bp, Homo sapiens
acattttttttttttttttttttttaccatttttgcatcattttaatatattgtctttggaaacaaaatacatcatgctatttatagcattctgtctttagtagtggtatttccatttacaaaacatagtaattctcgatcgctgaaaatgtcaaatcctggaaaatgtagtattcctacacgtgatgttaacatcgttctcaacagttagccgaagattcattcgatgagtccgatttttctgaaagagatgattctgatgattcagatgattctgatgttagttctgtttagaaataactccaagaatagtttttatattttattttcacattgaaaatcagtaagatttgcttcagcctccaagagtgtgtttacgtaaaattaaatgagcgctggcagtgagctgcactttttttttctaaatgggaaaagggttaaactctgcttcttacaataaagctttgtaattttctccaaaaaggtcttgcatatttttattagatttatttctagaaactttatatttt

SEQ ID NO: 1937 - DNA, 472 bp, Homo sapiens
aaaggaatcccagaaattaaaagttttatatttttggccaccaggaaaacacgtgcaagtatgaaactttttgtaaggtcctctgagctggctgcactatggtcaagccacggtgacattcccccacccttgtgataatgtactttgtgatactcctgtccttgtgaatgtactttgtaacattcctccccacccttgtgacaatacatcctccctgcccttgtgacgatacaccctccctgcccttgtgaatgtactttgtaacatcctccccacccttgagaatgtactttgtaatatccatcccctgcctgtaaaaaattgctcctgactacaccgcctatcccaaacctataagaaccaatgataatcccaccaccttttgctgacccctttctcggactcagcccactcacacacaagtgaataaacagccatgttgctcacactaaaaaaaaaaaaaaagtcgacc

SEQ ID NO: 1938 - DNA, 481 bp, Homo sapiens
ctgctgacacccggcactttattagtggggaaactcgccttggtctggcagagactgggatcaacaggaccagcaccatctcgaggtggtattttctgtaagatcaggtgttcctccctcgtaggtttagaggaaacaccctcatagatgaaaacccccccgagacagcagcactgcaactgccaagcagggcttcgatgtcaggctcgatgtcaatggtctggaagcggcggctgtacctgcgtaggggcacaccgtcagggcccaccaggaacttctcaaagttccaggcaacatcgttgcgacacaccggagaccaggtgatgagcttggggtcggtcataagcgccgtggcgtcgtcgctgggagctggcaaggctcccgcagaaggcgaagagagggtgcgcccccgaccgttcacctcgcacttctcgaaaagcatgaagttgggcttgaacccaccaccaggccggacgtactt

SEQ ID NO: 1939 - DNA, 484 bp, Homo sapiens
gctgacacccggcactttattagtggggaaactcgccttggtctggcagagactgggatcaacaggaccagcacccatctcgaggtggtattttctgtaagatcaggtgttcctccctcgtaggtttagaggaaacaccctcatagatgaaaacccccccgagacagcagcactgcaactgccaagcagccggggtaggaggggcgccctaggcacagctgggcccttgagacagcagggcttcgatgtcaggctcgatgtcaatggtctggaagcggcggctgtacctgcgtaggggcaccgttcacctcgcacttctcgaagagcatgaagttgggctcgaacccaccaccaggccggacgtacttgagggaattcagaatctcttcgttcttggcgttctcctgatgcccaaactggttgcacgggaagccgagcaccaccaggccccggggtccgaggcgccgctgcagctcgttcatct

SEQ ID NO: 1940 - DNA, 420 bp, Homo sapiens
taaaatgagacaagtgctgaacttaactatgttaactatgatagtgtgtctactatagatatcagatggttaaaagctggtaaaaggtaatgattctaaaaacaaaaatagcattgaccctttttctacctagcccagacctcattcattttgctaacaatgcaggataaggttagcttgcttagcatggaatccaacagaaagttgagctgcatgatgatccctttcaaaaggcttcatgggagtctctccttttgcagagcatgaaatgagcttttttcaaaaaaaaaaaataataataaaggattgatcatccacaggcttcatgataaactgtcccaggctgagttttaatagctcattattagctatccaagattaatacctgattttcttgtcttttcattcgaatagttttta

SEQ ID NO: 1941 - DNA, 518 bp, Homo sapiens; identical to SEQ ID NO: 1289

SEQ ID NO: 1942 - DNA, 339 bp, Homo sapiens
  misc_feature (1)...(339): n = A,T,C or G
acatcagtataacaatcggtatctgggtaggagaggggcctcagncnatcaataatcttcctgcccagctgtgtcccanaaaagccaactctacctgctttccatccacctcgatatctgccacatagttctcaaacactgtgggcacatacacctctgggaactggtccttgctgaagaccaccaacaatcaccagtttcttccggatggcagccattgctcaggcaacgaatccgagtccagcctcttcgcgccggggacgccggtccgcgagtngcaaactcggagacgaaggcgggtagctgaagaccagaccgtggactaacgagagaaccgac

SEQ ID NO: 1943 - DNA, 356 bp, Homo sapiens
  misc_feature (1)...(356): n = A,T,C or G
aaccggagaccaggtgatgagcttggggtcggtcataagcncggtgncgtcgtcgctgggagctgacagggcctcccgcaggaaggcgaagagaaggtgcgcccccgcaccgttcacctcgcacttctcgaagagcatgaagttgggctcgaaccnaccaccaggccggacgtacttgagggaattcagaatctcttcgttcttggcgttctccttgcccgcagggagcccaggctcacaggctncccgccggccagcgggcgcgccgagaaggcatacaccgacatgggccgccgccgcgccgccgctagccgagcagcacacatggcgcaattgtccaagaagccagggagcgc

SEQ ID NO: 1944 - DNA, 528 bp, Homo sapiens
ttcatccaaatcaaggctgtatttatcgtcactgattgacatgggaacagaatatttaaaaccaaacagggtccaccgtggaaatgtggctgaaacacagaactgagcaaagcaagtggctcgacggctgaccccgaaggctgggaatcccggcaggggacacagcccagacatcggggaacacaaaaggccgcaagtcctgaagcccacaggagccgcccaggagtgctgttctgctggcccaggggctctgctggggggacccaacccctccacggacccaggggctgggaggtcgctggcggaaccttcctcccccaaccagcagagccgccgggaaagcgctttgcattaatttgaaaggaaaatttgctgccattaaacttcttgataatgttttacaagcccagcaagcgcctgggtttttgtgaccatgttagacaaacaaccagaggggtttctggaaacggtttttataaagtctatctagattaagaatttagtaacgtcatatatttatatcaacag

SEQ ID NO: 1945 - DNA, 1481 bp, Homo sapiens
tttttttttttttttttttttttttttttttttcatccaaatcaaggctgtatttatcgtcactgattgacatgggaacagaatatttaaaacaaacagggtccacccgtggaaatgtggctgaaacacagaactgagcaaagcaagtggctcgacggctgaccccgaaggctgggaatcccggcaggccaacaggcccagacatcgggggaacacaaaagggccgcaagggtggtcagggcatgggggggctcattgtggtgaaggccaaaacccaaactgagaggaggccagggccaagggcctggtatggcggacgaccacaccgacggtgacgctgatgccttcaggcgggaaggaaaacacacagcagtgattttgtgtgtgtgtgtgtgtgtgtgtgtgtgtgtgtgtgtaaaatcagcctttagactcttgcacttctataccctccaccggatctggtctacagattcccaaagaacacttgcaccatccacacaaacgtcccacagcaatcgccctttgcggctggaaccggccaaatcctgaaagccccacaggaagcccgccccaggagtgctgttcctgcctggcccccaggggctctgcctggggggacccaaacccccttcaacggaccccaggggctgggaaggtcgctggcggacccttccctccccccaacccagcagagcccgcccgggaagcgccttgccatagttgaaggaaagttgctgcccattaaacttctgataatgttttacagccagcagcgccctgggttttttgtgacccatgttagacaaacaaccagaggggtttctggaatcggtttttataaagtctatttagattaagtatttagtaacggtcatatatttatatcaacagactatttacacgtttcgtttgcttttaaaaaaacaaaccaaaaaagaaattacacttctgcataataaggcaaaaaaacaaagttttgtacattattattttaatataatctgtaacttcggttccaagtaccaagggggggccagggctaggctgagtcgggggcctcacagtgcgctggacaaagtgaccggttttttctccataaataagacaaagaaacccctggggatctggagaaggatctgaggccattaaactgcaaatcccaaccgaaaacgaagaagcaaaagtttccttttttggttcttttaaacgtctaaagagcataaaattaagaaaaaaacaaaatccattacaaacacttctcatctgtggggggaaaaaggtacaaacgcgattttttttttcccaacagccgaatcccaaactcggaaaacaaaagatcacccttagaaaagccgacacccaagtccccgcctccgcaggctgcgggtggagaggtggcgccgccccaggatcggcgggagctgtgcttgagttctaggaactgatggagagacggacagccggtgcgctccgctcga

SEQ ID NO: 1946 - DNA, 11314 bp, Homo sapiens
cttcgttcacagtttttatttcttccaattaacttttgtgtcttcaaagttgatttgtcttttaaaaaattaatacttcttactcatacaatctacaccaccccaaggaaaacaaacccagggaagggtaatttagggggcagttaaaatgtgcactataggtttataacaaatgctttccagcccataatcctgtacatatgcaacaaaatggcacctcaagttcatctgaatgaaggcccaaataatgcaagcgaaggccatgagaataacaaaacaaacagaagcttagtcactggcttcattcactttgtatgggtagcacagtcttcaaactgtctcacacttgatcaagagtaagcaaacacagagacaacatcttggactcagccattaagtaattataagtggaaaccagaaataatttacctggggccacaaaaaggaattgttttgtcctgtttttcattaagtccctagcacctgaaacgtagcaagttctgatactgggcttctaaaggcatgcagtttttcactcacatctacttcaaagaatttcttccactgaaacatagcacaatcaaggaaaaacttcttctggaggcaaaggaagagcacaagtatatgttgaggcgtaatgtatgaccaagatggtacactatatatagaagcagtgaatgctgttaaagtgtcactcacaaagggatagtctaacattaacacacaactcaactgcactgctaaatatcggttgtctttattttctttttccttgcccagccctatctaaacataaaataaaactacaggactgaaattaacaatccattaaaatcagcaataagttatgaaaatcataaagcttttttttttttttttaagtaattaagggtagttaaattaatttaaagtatacaaagtccaaacagcccaggcgtaaggtctccaagaagccttctcaggagtaagggatgagggccacaggggaaccttggtattttgaaagacaaagggaacacatgacatcaaagtgcagggctagaaatttcacttagaagaaaataacattactgaaaatattcgtaagagtaacaataggcacctgcacagtggggactgtgaggaagacgagagactgcctgtagggaaaatgggaaggcaaatctttacattaaaatgaggacaagtgctggaactttaactatggttaactatggataggtgtgtctacttataggatatcagatgggttaaaagctgggtaaaagggtaatggattctaaaaaccaaaaatagcctttgaccctttttcctacctagccccagacctcattccattttgggcactataaagagtgaggtgtgaggtgttttatccattatccaatgctgcatccaaatagatgatttttttccccatgtgtttttccactataaaagacatctatttttttttatggataagctttaaaaagatgtcattttggttttcaacacatataaacagttatcaaaatctgaaataaaaatgctgctgtggctcagaccttggcctgctaatctgcgtgcacaactcttctgacccacgcagacaaagaggcacatggagctttttccttttgccccccccaatccatactcataggccttgtaggatagaggctgtcatgcatggactgctcccatgtggcctaagggcagcaggatggagaggtggcagctgggtgcctagtgcctaacaatgcaggataaggttagcttgcttagcatggaatcccaacagaaagttgagcctgccatgatggatcccctttccaaaaaggcttccatgggagtctctcccttttgcagagccatgaaatgagcttttttcaaaaaaaaaaaaataataataaaggattgatcatcccacaggcttcatgataaactgtcccaggctgagttttaatagctcattattagctatccaagattaatacctgattttcttgtcttttcattcaaatagtttttattttgcttttaggaccataaagctcaggaagggttcataaccccatccttaaatgtgtctactcaatgtagtatgagcaaactagaaaagagaaagaggatggcatctccaatgtcctcttctcaatcaactcaaatcaagaaaatttcacacaagttttctgctgccattaaaaattgtgatttttccaatatgaatattctgaatatttgttctccttgggaggctctgccccactttttgctaagtatttgcttaaatacaggtcctctgacccttttgttcaagtatagttttgttttgttttgttttgttttaaagaggagactgcatcatgaacccaatttaagagattgtttgtattgaattggcccagtgaatattttgccctgcactgttatgtcatgctgggttctatgaagtgaatgaaagtttgacactggcactggagtaaccctcgtcactcccaatactcggcaggctgctgtggtcatcaatgtcactgatgctggtggtacttatattgtccactttctccatgggagaactctgtgctttcaacatccacttcaatctcctctgccaaaggaaaaaaaaaaaggaagaagaacattatttatcgagtatagcgcaccttcaaaaactaacagcatgaggaaaagaggtttaagaaatgttacacaacaagcttattatcagtgatgtctggagaacagaggaacaaggtgaagagacaggaatatttttggccaaggggaatgtctgatatacagtggtggtcttaatttaggcagcaaatttcctaaatcctttgacgccagtccgtctggacctccctaaagcacttggcgtatttgggaattagtgcttaatattaaaaggtcccaacccccaagtggtttaaaaacatctgttttgcattaaaccacaaactaattctcagttctgtttattaatcagggttgccttaaagggtgggcaggagcataaacttaatataggcaaactagaaaatttacccatccaagcctttggtggtgccattctacagatagttcaacagacttctaggattcatcataaagatcttcaactagtcagtcaaacaagtcattataaagtagagtttgaggtatatgtcttagatttaattttcttgcatcaaatatagcttgaaataagggcctgagacttaaaagtcttcagattatagtgagatccattttggtggtagtatacagacttaaaagccaaacattaaaaaaaaaaaacaccacaaatacatatttgactcagctatcaatagataatgttgctggacgcagtggctcaacgtccgtaatcccagcactttgggaggctaaggcaggaagatcacttgagtgcaggagtttgagacaagcctgggtaacaaagtgagacctcatttctaccaaaaaaaaaacaacaacacaaaaattagctgggtatagtgggtgatccagtagtcccagctactcgggaggccaaggtgggaggatcactcttgagcccaggaggttgaggctgcagtgtgccaaggtctcaccactgcacttcagcctgtgtgacagagtgagaccctgtctcttaaaaataaaaaaaaaaatcttaattgttaaatactagatattcaatcatcaataatatacataaatcaatacacatgttaaaaacaaaaaggagttaaaaaagttgttttctcccatcagagctagagtgaaacccaggatttttcagttaccttacttaaattcaaagcctgatgtttcacatttggcactgactttttaagggttcacactaatcacaactgctttaaaaaaaaaaaaaagtggattcagccgggtgcggccaagcactttgggaggctgaggcaggtggatcacgaggtcaggagttcaagaccagcctgaccaatatggtgaaaccccgtgtctaggctaaaaatacaaaaattagctgggcatggtggcacgcgcctatagtcccagctacttgggaggctgacgcagcagaaacacttgaactcaggaggcagaggttgcagtgagccaagatcacgccactgcactccagcctaggcgacagagcgagacactctctctcaaaaaaaaaaaaaaaaagtggattcttgtgaggccaaaaggacagggtgaagctatttccaggaatatacttttcaaaagggcttgttgcttcaaaagttttagagattctagagatgtttttaaaatgtaggcagctgtccaaataatctgtgaattcatatattggctctatatccgaattgcttcagaagccattgtttcccagcaccactgaacactcatccaacctacaactagaagataataacaaggcacactatccaaaagagcatgctgaactcagtcaaaataaagtaaaatgatggccaacacagtggctcacacctataatcccagcactttgggaagccaaggcaggaggattgcttgagcccaggagtttgagaccacttgggcaacaaggcccatctctattttaataaaatttaaaaatatgtttaaaaaaattttttaaaaacccaaaaaaacaaagtaaaatgagaaactgctttagccaagtgtaccacagatgttaactaaaagcccccataacactacaaaaaggaggttgccagctcaggataaggatggtacttggtaaggtaccactaaagtaaggtacactgggaacactaaaaaaaaatgagagctatagtgatgaaaatacaccctcctctctgaaatttggaggtagttggggtgggtacaaggaggaggtaacaggaaggacagctaaaacctaaagacctaagaagaggtttccgctagttagcaatagaggaaagactgggacaccaaggtcagggttatttctgctatatttcactgttactgataaatgtagcatgtacttcaggttcttgctactgcctctggtagacttttcttgaaaactgccacacaaaaataaacttttacatagaaaaataacaaaacagaaaaacaagaactcctagggttgtgttaaaaaggttgcgttaaaaaggatgaaaaaactatttcctactcagcaaatctgggacagtttgagcattcaaaagaatttaaaaggatgactgcaatggattggaacacattcagtacagcaaaacatgagttcatgatataatcaaaaaatagtaaaaccaaaacttgttacttctggaagctgctaggttaccaactctgtttggaaaactgataaagcaaaaaccaagaccaagcatttatcccaccttccctgtatgaactttatttcaggataaccgaaaagttgatgagaaaatgtttataggagaaaaacagtttataaatacaagaggaatgacacaattagaaaatcactattttatgacacccaatgaaataagggcaataattgctaaaactgttaagttaaaggctatacatttatataaatgtattaaaatgaccttacctgaacctattgattaatattaaaagtgcaacaacaactacacacaatactgacgtaacaggaagtacaaagcaccacctatgaagtattctgcatctaccaaccagtttacagtcaatataaaggacataacatgttaaatgacaccatgaggattcacccagccaaatctaggatgtaggaaattctataagaaaaatgactcagtctcttgatgtttaaaaaaatatgtacatatatacaacacacagatctatacctatatattccttcatgttttctctgccaaagaagtctttttgagatgttatgtagaaatcagtttttgtttctaccaaaacggtgtagggggaagagaaaaaattattatagattaatatcttaaaaggcacatcaaacaaatgcaatgtggcctttggatcctgatttaaacataccaatggtaaaatgccatttttgagacaactggagaaaatgtatcacagactgggtattagatgatattaaaaaagattatctgaattaattttgtggggtattataatagcattataattacatttttaaaaatcctatttattcaagatacatactaaagtatttaggggcaaaatgatgttatctgggatttgagtttaagcattccagaaaaaatattgagggtgagcgtagtgaagaacagatgaaacaagttgacagctattcaaactgaatggtgggtatacaggagttcattattctattctaagtatgtttgaaaatttccacttaaaaaagtcaaaaacaaaaaacaaaatcagagtcctaaaaacaaacaaacaaaaaaactctgtcacttgtctcatgttttagaatcctaaagagctcatgagctcctttctccaaatgtaagacttcaaatcaccagtgttcacctctgggatctttttaatgtgatatgaagcctgatgtggtggaagctttgggaagaacaatcagtaaaattcaaaccattcttttttgggtgacttctgttctttaactctgtcaaagataaatattctaggatagatggaaagagaaataaagggtgttgtactttaaaatctacatataaaaattcacatcaccagtagtaaaaacttcgacatcgtgtatcttcctgacacaatggattgagaaaggcacaacatcatttcttttcttttttttttttttgagacggaacctcactctgttgcccaggctggagtgcagtggcatgatctcggctcactgcaagctccgcctcccgggttcacgccattctcctgcctcagcctcccgagtagctaggactacaggcgcctgccaccacgcccgtctaattttttgtatttttagtagagacaggattttaccatgttagccaggatggcctcgatctcctgaccttgtgatctgcccgccttggcctcccagagtgctgggattacaggcatgagccaccgggcacaacatcatttctgtgatattccttaccccaactgtataccctcaatctaatcatttgaaaacatcagacaaacctaaattgagggacattatataatttataatataaatatataaatatattttttttcaaggaaaaaacaaaaagttttatagtccacactggcactgctgtagacaatattatgattgcataaaacctacaatgttactctgttggctagaaagaaagcaaatacagtgcctcccaacataccttccctaaatccagatacagagatgtttagtatttcattagagaagaggcaagctgcctacctcgctctgaatcagaacgatctgaagaaatagttgatccaatgctgtccattcgtattcgttccatctcctgaggaccctgcagctgttccagtcgccactttaaaaatctctgttctcgttccaaattctcgagctggtgctggctttttctttcagcttcttcaagtttctgaaatgatgaaatgatttttacatttgtgtatagtccagtacaaacaataaaactgattcctcctttagcagagaaaacatgaatgaatatacatgtgtgagtgtgtataaaaatatataaatacattttaaagcctccaaaatgagaatgcatataaatacatatttttaaaaataaaaaatagttttgtctttacttttgtgtgtatgtaatgaatgctatgttacttgaacaagatggacttctaaaagtctgtaaagtaatctccacggagaaacttcctctagtatggtatttgatggaaaaatacggaaggacacagccaaatgaagtcatctccaccagagggcacaactgccttccgagtatgaagagggtaattgttattttcctagtgttctcagttcttcaaatggccacgctgtcaaaacaatttagtttaatcaggttatgttgttcccatcagattagctggtaagtttttagaaagacttctcttgaggtcagttattaaggagggcatggtgaactagctgatgtatatgaataggaatcagtgccaataattaaaccagaactgagggaattgtgcaaatctgaaagtaaaaattctcaccttgatgtgtgctttggctttgttgagcaaaccaagtgttgtgtgccgggtgcagtctggtcctagtggaatcagaacttttaagcgttctaaacaaaggcgcagatgagctcgtctaagaaagacaaaaagtcaaatcagcacagtctggttatttcactagaaatatcataaaacctattttaagataaacaataatttgcatttattcagcctataggatagatgtcacacccctaattctccactgtcaaagaatgtaggggtggccgcatttcagtctctgctatttctgttgtactctttagacaacactcactttagattattatccccaatggtaatctctgtcaagatggtttattttttaactcaccccataaactgtctcaactgtattaatatggaagtgtgaaaacataccaggacaattgtatttgatcttgaataactaaaaccacaggcgagaggagaggttttcagctatggtaccccaagggaatataatatgctcacaagtttctatttcccccctcccaccttttacttgcttgcacgtgtgtgggcacacacacacacacacacacacacaccctacctctctacaactgtagccatcctacagtgtgttacatgttgttatatattagtttgaaccacatgaaatttctgatattcaaccacttttcacttataaaaatgttgatttcttatactccaatacaacagaaacagcaaaattctgtgaccagctagggtagggttagacaaaatatatgccctgtggtcaattctagccacagaaataacccataaaataatcccctgcttcctatctaagtgtgctagctcgttagcttaatttttatttcttttttctcttcctctctcgtctctctcactacctgcctccaatccacaaggacaacaggtgacaaaaattacttactgaaagtcattgcattctctaatctatccttcctgtgggaaagttgagggaaatttctcctagaaatgctagcagagaacctcatggatttaccttccctgtgccctaaaagaactatgatcatggtgatgagagagttctgagtatttaacttcatcctaaaacaatactagtccacatctttggtcctgtgtttcataaggggtaaggtaattcagcagttaacagcatatctgaaaagaaaatccacaaatacgttcacagtttacccctagtccttaaagacctataattgaacttttggtaactgtcttaactgcatcaagaacaaaacacacaccctccattctcttctgaaagaggactaaaatggttttgctaattcacacaccaaactatgcgctttctctgtcttaatagacaagaaataatgtcaagtgaaattctcaaaggctagcaatttgaaaagagaggtaggagaaggcaataagcagccaattatgtcatgacaagcaaggatgattaagggtagtgaggtcagaggtttggctaatgaattaagattcttctagcacctactaacctaactatagttaaaggtctgacagtatttccatttcaaatttctttattgagttcagtacctcaggtctaataattgggtccaggctgaaacctgacgtaactggtgtggataaaggaatccctaaatcaaaggtatatcaatggattctccttaatgatatttaacaacttcaaagtcactttcctcccctgctgtactacccaaatgcatagaacctttaacaaaattttcatttttaactggaaaatttcttaggtgaggattctcatgtgaccacagtgctcttgctcagcagaccaaaaaaagcaaacaaacagcaacaacaacaaaacaccagagtaaaaagtgcctttaaactcttcattaagattattatggcatatgataacaactgcactcatataatatgactggagcgtggaaacaaagactggcagctacactaatagacaatcctgctttaaattcagtcttctaaaaaactcaacaaagcaactagtaaagttaacaagcacattaccgcaagaataccttgtcaatttggttcaaattaactccaaaacttcagtatatgtaagaattatcttttattttttagtttttaagaaacttaaaatgggctgggcatggtggctcatgcctataatcccagcactttgggaggccaaggtgggcagactgaggccaagagttcgagaccagcctggccaacccagtaaaacctcatctctactaaaaatataaaagttagctgcgcatggtggtgcacgcctgtaatcccagctactcgggaggctgaggcacaacaatcgcttgaacccagcaggtggaggttgcagtgaaccaagatggcgccactgcattctgcctgaaccacagagtgaaactctgcctcagggagaaaaaaaaaaaaaaagaaaagaaaagaaagaaaggaaaatccaaatgattccataaactttcacatcaaggaaaagaaaggtgagtctattttccgttttgtgatacttgctaaaacctagaatgaaaataactaacatattaaaattttttctctctttaatcattccatgtatttattacatggattttacatactcagcactgttccagacacttgcttgagaaggaaaagtaaaaaaaaaatgttaactttaagagtttacactcaagactacagaaagaaacatattactttgtttcatttggtccatactgaatgagtcatacagatatcaaggacaacagaatctgaataaatcgagagattgtaatcagaggagggagacttgtaaaagaggttgaaatctgactttggacttaaagaatattgaatttgtctatgaaaaagtgaggatttgctaggtaattttaaaagtaaaggacctaaatttatggattgggaccaagtttaaacataaaattgaaaaaatctgaataaatggagagattgtaattggaggaggtagacctgtaaaagaggttcaaatttgactttggacttgaataatatagaatttgtgtatgaaaaagcgaggattttctaggtaatttaaaaagtaaaggacctaaatttatagactgggaccaagtttaaacataaaatttaaaatgccttattttctctccttcaagggaaaacaactgagctggaattc

SEQ ID NO: 1947 - DNA, 555 bp, Homo sapiens
tgtatttccacacacaatcaatttaaaacacttttatcaacccaaaaagaaacttcacacccaccaccagtcattccccatttcctctcttagcccaagcaatccttccaccttggtctcccaaagcactgggattatacatgtaaaccaccatgtgtgctctcaaatagatttttaaatgattgagaattacctcccaaaaaatagtgtaagtaaacaaattttgcaatttactaactttaaaacttttttcattaaatgacatctcaacaactttattgagaagtaaatctcttaatatgtgaatgatatttggagcatacaattaattcagtggtttttggtgtatttccacacacaatcaatttaaaacacttttatcaacccaaaaagaaacttcacacccaccaccagtcattccccatttcctctcctagcccaaggcaactgcattctactttttactcctgtacattttcccatttaggatgtctcatataaatggaattatacactatgtgttctgtgactgacttctttcctgtaacacagtct

SEQ ID NO: 1948 - DNA, 478 bp, Homo sapiens
ccccatttcctctcctagcccaaggcaactgcattctactttttactcctgtacattttcccattttggatgtttcatataaatggaattatacactatgtgttctgtgactgacttctttcctgtaacacagtttttccaaggttccaccttggtctcccaaagcactgggattatacatgtaaaccaccatgtgtgctctcaaatagatttttaaatgattgagaattacctcccaaaaaatagtgtaagtaaacaaatttcgcaatttactaactttaaaacttttttcattaaatgacatctcaacaactttattgagaagtaaatctcttaatatgtgaatgatatttggagcatacaattaattcagtggtttttggtgtatttccacacacaatcaatttaaaacacttttatcaacccaaaaagaaacttcacacccaccaccagtcattccccttttcctctcctagcc

SEQ ID NO: 1949 - DNA, 688 bp, Homo sapiens
ctaaaagttacagttcatgtctcacgttcacaaagctcttcccaccggctaaccgctaagtctaagaaacagcctggggttacagaatgtgaaatgcagtatacattcgtaattccttatccagaatgctgaaatccacaacattatgaaaactgggttttccttaagctcgatgtcaaaattcaatgagcggcaaaatctgacctaaactgagtcatggctatttataatcttaactcctcccccttactgtgaatactcacatttcactggagagctgtgtgaatgtgcctgattacagggtgcagtcctagaccccacctggggattacataatacacctcttatacattgtactatcttcctaaaatctgaaaaattctgaactctgaaacacatacagccccaaccattccagagaaagcactgtggacctatgtaacatgccctggtccaagaagaaactcacttgccatttgaagaaacaaagcatacagcacaggaaaagatatcctgtgatacaaggtaagaaacctgcctgatgacagggctgacggaaggaagaaagaaaggggacaaaatggttttaggtgcaaggatttggagaagaccaccgtatgaagacagcccgctgtgtggccagagtgacgccatcctgaagcaaaaccaccgtgatgaccgatgctcg

SEQ ID NO: 1950 - DNA, 851 bp, Homo sapiens
ttttttttttagtaaaccaattttttattcattttaaataggttttaaacgacttttgtttgcggggcttttaaaaggaaaaccgaattaggtccacttcaatgtccactgatttctttttgtgaaacttgtatgatgctggcaggtcatatcgaagttctgctataatatctatcttgattttccattctgcagctttcttttgaacatgttctctagttgaggatttgtgtaaggaatatactgctgttcttgccatttccaaagcagtctttagaaaagccatatctgtccctttattatttttggtcccaaagggaggattcataattactgtatcgaatgacttggacattctgttagataataagcacacatcacattgaaccatgtcaatatttgttaactcaaactcttctgcattcctattaaatatttccaatgcgtcttcatctatgtcaaatccaacacacaaccctgctcctaacattgcagttccgatgctaagtactccacaaccacatcctagatctgcaacgactttattttcaatgtcatcataagtgttatggattgtatagagcatacatgctgcaatgtgcggcctggtaggatactgttccagaagtagcttgggcttttcaaatccatccacttgttgcaggcgactctctagttccttaagccttactttcttcattttgttttaaagtatggactcgtagggtttgaaggcacaggatctcccggctaacccaagccgccccaggagacggcggcggcgcactgctggagcagcctcaggatccctcgcgccacgaccacgcacctctggaggcgacccgcacctc

SEQ ID NO: 1951 - DNA, 1893 bp, Homo sapiens
  misc_feature (1)...(1893): n = A,T,C or G
cgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaaaaaaaaaaaaaaatttttttctttttgtacccaaagcatttaggaaagaactagaatattagctattgacgatgggcctttcccacaggccatttatggtgtctcctaggctgggctttgnatatttacacaggaaagttgggtaacactagaaataattacttggtcacaaagccttccctttttttttccttttcgagactgagtctcactcctatcgcgcagctgga

SEQ ID NO: 1952 - DNA, 416 bp, Homo sapiens
ttttagtaaaccaattttttattcattttaaataggttttaaacgacttttgtttgcggggcttttaaaaggaaaaccgaattaggtccacttcaatgtccactgatttctttttgtgaaacttgtatgatgctggcaggtcatatcgaagttctgctataatatctatcttgattttccattctgcagctttcttttgaacatgttctctagttgaggatttgtgtaaggaatatactgctgttcttgccatttccaaagcagtctttagaaaagccatatctgtcccctgctcctaacattgcagttccgatgctaagtactccacaaccacatcctagatctgcaacgactttattttcaatgtcatcataagtgttatggattgtatagagcatacatgctgcaatgtgcgg

SEQ ID NO: 1953 - DNA, 414 bp, Homo sapiens
ttttttttttttttttagtaaaccaattttttattcattttaaataggttttaaacgacttttgtttgcggggcttttaaaaggaaaaccgaattaggtccacttcaatgtccactgatttctttttgtgaaacttgtatgatgctggcaggtcatatcgaagttttctctagttgaggatttgtgtaaggaatatactgctgttcttgccatttccaaagcagtctttagaaaagccatatctgtccctttattatttttggtcccaaagggaggattcataattactgtatcgaatgacttggacattctgttagataataagcacacatcacattgaaccatgtcaatatttgttaactcaaactcttctgcattcctattaaatatttccaatgcgtcttcatctatgtc

SEQ ID NO: 1954 - DNA, 563 bp, Homo sapiens
  misc_feature (1)...(563): n = A,T,C or G
atagccgcaatggctgaaaatggtgataatgaaaagatggctgccctgaaggccaaaatctgtcatcaaattgagtattattttggcgacttcaatttgccacgggacaagtttctaaaggaacagatanaactggatgaaggctgggtaccttgngagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattgtaagtgggcctgtaatgcatttaaatatcttacatttatttagaaagtaaagtacggaagaataagggctcaggaatcacagcctcactaattactgtatgtcctttcgtaatattcttaacctaagtttcttttgttttgttttgttttgagacagtctcatcctgcactccagcctgggcgacagagcgagactccgtctcaaaaa

SEQ ID NO: 1955 - DNA, 498 bp, Homo sapiens
aagcctgccgcctgtgttcctgtaagggaaaagtaccgtttcaggccaggaaacgaaattttctgttgtggtgaacatggtggacctggtggaaattgtgccacttggcctgtggaaagggccagggaaggaaccgaccaaggaggacctgcctcccaaccaccggaaaccggaaatggttccgggggcccgttgttttgtaaacccattttttattcattttaaaaaggttttaaaccacctttgtttgcggggcttttaaaaggaaaaccggatttggtccccttccatgtccccccgtggggaaggaaaaatttttttggtgtttaacctgtctttttgttaagcaaaagggatttctttgaaagtattgttccgtttgtgttatttcagatgattcaaatatcaaaaggaagattcttccattaaattgcctttgtaatatgagaatgtattagtacaaactaactaataaaatatatactatatgaaaagagc

SEQ ID NO: 1956 - DNA, 758 bp, Homo sapiens
  misc_feature (1)...(758): n = A,T,C or G
aattgagtattttttggcgactcaatttgccacgggacaagtttctaaaggaacagatanaactggatgaaggctgggtacctttggagataatgataaaattcaacaggttgaaccgtctaacaacagactttaatgtaattgtggaagcattgagcaaatccaaggcagaactcatggaaatccagtgaagataaaacctaaaatcagaaggtctcccaagcaaacccctacctgaagtgactgatgagtataaaaatgatgtaaaaaacagatctgtttatattgcttcccaactgatgcaactcttgatgacataaaagaatggttagaagataaaggtcaagtactaaatattcagatgagaagaacattgcataaagcatttaaggtatgataatacagactttttctagttttaaaatatatgggacataacttaaaaaaatattttccttcctttttacagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacagtaagtatgttgaactaatcacgacataatttgaattccttaaaactctgacagaaatatagctggtgagctctggaaatagtggccgtaggaccttttntctttgctagtgaaac

SEQ ID NO: 1957 - DNA, 934 bp, Homo sapiens
  misc_feature (1)...(934): n = A,T,C or G
tctgtcatcacatgagtatatttagcgacttcaatatccgcggccatgtgtctgacgtcacgataatactgactgaaggctgggtacctctggagctaatgatacagttcgacaggttgaaccgtctcacaacagactttaatgtacttgtggagcattgtgcatatccgaggctgcactcatggaaatcagttacgatgaaactaaactcagtaggtctcccagcaaacccccttgaagtgactgatgagtataaacagtgatgtaaaaaacagatctgtttatattaaaggcttcccaactgatgcaactcttgatgacataacagattggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctatacttttcaaggacgattactttgccaaaaanaatgaagaaagaaaacaaanataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggtttggatacatccctatcctttttagcaatcagtttgaaaatctgtagaaacttagacaaaattagtagaaagtaattttaaaaattgtgtttattaaattagtttctacttgatcatttgttattgccactagatgtgatgtctgatattttctgaattatactaaattagtttctaaa

SEQ ID NO: 1958 - DNA, 394 bp, Homo sapiens
agtaaaccaattttttattcattttaaataggttttaaacgacttttgtttgcggggcttttaaaaggaaaaccgaattaggtccacttcaatgtccactgatttctttttgtgaaacttgtatgatgctggcaggtcatatcgaagttctgtaaaacaaaagccacctgctataatatctatcttgattttccattctgcagctttcttttgaacatgttctctagttgaggatttgtgtaaggaatatactgctgttcttgccatttccaaagcagtctttagaaaagccatatctgtccctttattatttttggtcccaaagggaggattcataattactgtatcgaatgacttggacattctgttagataataagcacacatcacattga

SEQ ID NO: 1959 - DNA, 558 bp, Homo sapiens
  misc_feature (1)...(558): n = A,T,C or G
gctaaaatggtaaaaataaagatgcctgcctggagccaaactctgtctcaatgtaagtattatctgaagacctcaggttgccacggacaagtttttaaaggaaaagataaanctgaatgaaggctgggtatctttggagataatgataaatttcaccaggttgaaccgtctaacaacagactttaacgtaattgtggaagcattgagcaaatccaaggcagaagtcatggaaatcagtgaagataaaactaaaatcagaaggtctccaagcaaatccctacctgaagtgactgatgagtattaaaatgatgtaaaaaacagatctatttatattaaaggcttccctactgatgcaactcttgatgcatgaaagaatggttagaagataaaggtcaagtactaaatattcagatgagaagaatattgcataaagcatttaagggatcaatttttgttgtgtttggtagcattgaatctgctaagaagtttgtagagacccctggccagaagtacaaagacacagacctgctaatacttttcaagaacgattgctttgcc

SEQ ID NO: 1960 - DNA, 411 bp, Homo sapiens
aattcaacaggttgaaccgtctaacaacagactttaacgtaattgtggaagccttgggcaaatcccaggcagaagtcatggaaatcagtgaagataaaactaaaatcagaaggtctccaagcaatcccctacctgagggactgtggtgttttaaatgttgtaaaaaacagatctttttatattaaaggctcccctacggatccaatccttatgccatgaaaaatgggttgaaaattaagggccagttcctaattttccggtggggagaatatttcctaaaacactttagggaaccaaatttttttttgttttgtagggaagcaatcagccaagaagtttgtagagacccctgcccagaagtacaaagacacagacctgctaatacttttcaagaacgattgctttgccaaa

SEQ ID NO: 1961 - DNA, 824 bp, Homo sapiens
gcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagataaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattattcagagggttatctgccttcagcttacttgttcttaatttttaatacagcggagatgtttcttgctttgttttcagactctcctttttaatcaggacaacatttgaaaggttttattgtgcctctaaggggtatatttgggggttgggtctttttgttaaactctggatagtaataagtttcaggtcagtataggcctgaatcatgtggtttcaggtatgtttttctttt

SEQ ID NO: 1962 - DNA, 591 bp, Homo sapiens
  misc_feature (1)...(591): n = A,T,C or G
gaaaatgagagatatgaggctattgtaagagccagaaatagcatgcaactcttagaagaagctaaccttcaaaaaagtcaggctctacttgaggagaagcaaaaagaagaagacatagagaaaatgaaagagacagtttctcggtttgtacaagatgctaccataagaaccaagaaagaagttgcaaacaccaaaaaacaatgcaatatacaaatttctcgattaacagaagaactttcagcccttcaaatggagcgtgctgaaaaacaaggccaaattgaacgagtcattaaggtgtctgcccatggaagagaggaagcatcagatagccgtttacagcagttacagtctagtataaaacaattagaaataagattatgtgtgacaatccaagaagccaaccaattaagaaccgaaaatacacatctggaaaaacagaccagagagctacaagcaaagtgcaatgaattagnaaatnagagatatgaggctattgtaagagccagnaatagcatgcaactcttagaagaagctaaccttcaaaaaagtcaggctctacttgaggagaagcaaaaagaagaagacatagag

SEQ ID NO: 1963 - DNA, 1184 bp, Homo sapiens
tttatcattaaagtttggtaagcaatgaaaaaaaacacaagtgacactttggaaaagcaagcctgacaactcaggcgacacattcaatataaaccatggtgtgaaggcacagcacgcttgagcacagcacggagccatcagatccagacatgatctgattccgcggccctcccttcaccagttctcgttttcgagctctaattccaaaaggaaacgtcagggatggaaaaaggcctatttggtcattaatgtgtccattctggccagctcagaggtcatccctacagtcatgctccagggctatgaagaatccagttttaatggtctcaaacgatgggctttcttcacgtggagagactattccacagtttaatggttggtcatggttagcttttcagtccgggccccagaagtagccgaacaggcaaaaaagaaaaaaaaaccaccccacaacaaccccaaaacccagagacgaggggaagggggattgaaaaaatgggaagaaagaggggagcaaaccacctacatcatgtaatgttatccttttcaaatcaaacgcctttagaaatccttaatcccaggcccccactgcccataatcgctagacaccctcgagtgacgacctaaagcaggtttgatttgaaaagaaacaacacatctatatcccagctccacccttcagtcttaagagacagtgaaaccagccctaagaacactatctcttccaagagcaaggccagggtccgcacgaagtcaagtggccaccaactgacgggcaactttgctcactacctcaatctgtcaaactcgtcggattatcaccgggaaatcaaacgtcatgccggcaaagtacgggcgctccactgagggctctgggggcataacaggttaaggctaactcacaggtccaagagacacttctagccactgtctcagtgagcggcggttcgggagaataaaggcacgcctcccagggtaccctcccagtacaccgagcagtgagagcgcggcaagtagaaaagcagcgcacgaccccatggcatcgccgggcggcaggcccaggtgcactcaggaaaagaccctgggcactggctgctttcaccgcgcggaatcgcaactgcagcccagcgacagggtgaggggtcgagaggggctgcgggaccagagacgatccctccggagac

SEQ ID NO: 1964 - DNA, 690 bp, Homo sapiens
  misc_feature (1)...(690): n = A,T,C or G
ctcctgtgtccctgcctccctgggctcccgagataggcaccactgtatcctccagctccttccttccttcccccaggaacacggaggccaccgagggggctgggcctatcaggaggacacaggctacagcctggcacccacccctcccatctccaccccacacggaagacttgtcttcaacttggccactgtctttgcagtagctgcgcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagctttctgtggactgttccccccactgtggtaggacaggactggccaacttagtcctcaagctcccaacctgctgtccctcaagccccgcttctaccagcctgtggagttcaggaggcgagacatcctgncctcctttgagaactgatgggatctaccccctgtccacgcgggacagtttctcagaactggttcatagaccacctgtgtcaccaacagccagatacctaatccctgagcctcctttgggaaggtctggggccgagggtctgggaantttttttttttttttttgggacagagtctcattctgtcactcaagctan

SEQ ID NO: 1965 - DNA, 7764 bp, Homo sapiens
ccaaataaaactcttttctctataaattacccagcctcaggtattcctgcaaaacagactaacgcaattgggtagagtgcaatgaggctctttaccttgggggtgggcaatcattagcccttgactgagcactgctctggttctacctaacgaatcttaacagcaagacctgaaaaaggaaactgcttccaaataacctgcaactcataacaaagctccagaatacttacaggaatacagaaatatccagcacccaacaaggtaaatgttacatctggcatctgacaaaaattactaggcacagaaagcaccaggggagcaagacccacagtgaggaggtatcaactgaaactgacccaagtgataagattcgcagacaaggacatcaaaaccattgttatatctgtgttccaggttttaaaaggttagacacagaacatatataaaaagacccaaaaacaactttccgaacttttagaactacaatgtataaaatgcaaagtacactggatgggcctcacagcagtcttgacattgaaaaggaaagtattagtgaacttgaagaggtagcaatagaaactatccacagtgaaacagaaagcataattttttaaaagtcaacagaatacaagtgagctgtgagacaacttcaagcaagctaatataggtgtaatgagaatctccaaagaagaagagagagtgggggatcagaaaaaatatttgaagaagattgtaaaaatttccaaattttatggaaacaataaacccacagatccaagaagttcaaaaatttccaagcacaagaaaccaaggaaaaatacaccaaggcacatcataatcagtgattttttttaaaaggaacattatgtaaagaggaacaaagataaggatgacagatttttcatcacaaaacaatgcaagtaaatagcagaggtacatctttaaagcactgaaagaaactgtaaagccaaaaatgtatacactcagcaaaaactactttcaaaaatgaaggcaaaatactttttcaggcatatatacaaacactgaaagagtttatcaccagcagaaaaagtccttcaggcaaaaggaaagtgacatcaaatagaaatacagacctactagaagaacgcagggcaagatgcccactgggtccagacaatagagaagggtgggagcgaggggcagtctcccaacgaggtggcagctactcagctacagctctctgctaatgcgggctgctgttaccagatcttccaaaaacaaagcacgactttgacacgtttatatgaaattttcccactgtaaattcaaggtacagtgcaaatgacgcacatcatcagcccagggaaaaccaaagctgctatgaggttaaattatccaagatttgaaattaggaaatacagataaaacctctttagctctccctggacttgctactctcacaatgtaaagctttggctcatcgtactactggtggcattgtactgaagtaaagagggtgcagcttcagaagactttgactcttcaattatgggctcgtggcaggtaaggactgtgggctggtacccatctcgggatccctgatacctagtgtggctgacagcctcgcacagagcttaataattttggttgttgactctaatattttatggcgacctcttcactagatttcctcaaaagacggcagaaaactcttttcctgcacaggtgaaatgtgctccctatgacccagaaaacaaaacataaaacctataaccaagacatgggattcgctgtggctgacacatgcatgatgagatcttcagtaatttgatagataaatacattcatgtatacgtcactttctccctagaaacagctcctggcaaaggttggcacctggtgtctcacagccttttgcatacctgtcataataatctctgtgtccccggtggtctcggtcactgctgtactggtcataaggcctctttctggacatgttgttgggtcgatagcttccggaacggtgggcatccatatgtcgccggtccccataatggtggtccttgtaccagtgctgctcatactgatggtgcctgtcgcttccccatggtggattgttgttgccaccaccatagttgaactttctttccctctgccagtctcctcgatctgcattactgaagtgtctcttgttggggtgattgtagttatctcttgggtgtccatgcatctgtgggccatgggaggcaggcaaatgaggcttctgagggtgaaggttgtgtgaggtatgggactgagatatcagagagtcccggctggagcctgaggcctctggacgaaatggtttcttacccccagtcacgtcgtctttcttcttttgctcctcttcttcttgagaccttttcttatgagccatcttgtataacttatgcagttttcgagcatcaaattctgtaaacttggaaacaaaaatccataggttcctcctccagagtttgatgtgctcctgatctgagtaggctttaaggcactcggctatccggtctccgattttcagcaggcagttccgggtgtgttccagctgttcttgcacgttgagccccttgtcaggtttgtcgagctgtttcagtgcctttttcacgggcctcatcctctccttacatatgctgaatgtctcctggtccagatcatcatcctcatcctctccaatggggacaggttcacttcctgctgtaatatggacaggaccctgagatcgctttgatttactcgaagatttggcatcaccacttttaggcttctctttcttatcttttgacttctttctttccttgtccccttctttgtctttcctagaactcatttgtttctccttgttctccttgttctctttcttcttctgtttttttttcattggacttttttccaagccatcatctttcacttctccctcttctgatggattatctgaatgcctaggagatgaaagctcaattccatgctcctctttcagcctgggcactttgttttccttctttacccgaggcttccgcttctttaatttggcctcttccccacctgtcacagcccccttcttctccagaccctttctgagcagcttcaacaagtaatccgctcgggtctgtagctgcttcccctgaggctttttatctgtctccaccggcagaattttgtcagttaatttaagctctgggtctgttttaattaactcccagtttccatagccatgttcataaatccccagcaacaggcgagaatcatcttccaccccccactctacatcaaaatgtgcagctttgacacgacaggttaagcagtatttttttttttcttcagggtccacagggatagatttatgcagcatctcaaactcctcttcatgttggataatggatttcacattaacctgaactccggatatcttgattgttggacctctccttttccctggtccttttccctcgctggcattttctttcagctgctcttcgtattcctgcattgctgacacacagctgttgtggatcagttcacccaggcgcttcagatctgccaccgacttatctaccagctcagcatcacgtgctatgcactccagccgttcaagagggagaccaaacttcttataagccttgatgaaccttcggatctctgcatcagtaaatccctccacgaggtccttccgcacactcctcggacgccctctgcgctttggcttcttgtcatcatcagagtcttccgtttcactctcagaagcagaggatctctgggcctgcctcttagactcagtgtcagagtcactgtcatttgtctgagcctttttagtggaactccgaattcgaggcagcatataaatttcttctagctccttctgccgctcttcctcctctacttttttcctttgttcctctggaatgatctcatcccagtccttgtgaggacgctcttctagctcttcttcatcttccattgttgcaaagttggcaaccttaaactgtgatagaagttcatctgttgcacttgttgacacttcattctctctcgtttcagccaaccgcaaaatttcatctatatccatttcctgaggttctgattcctccccttccagttctttgaagagatcctctgctccaaatttcaaaatagctgtcagctcttctttattaaaaggatttgagttggaccttcctgagttgttttccaggatcgtccggccagtggtgtccatgcgctgaatcaccagatgatctaataccatcttctttttggcccgttctatgatctcctcctccacagtcccctttgtaactaagcggtaaatatttacctgcttcttctgaccaattctatgcgctcgggcttgtgcctgcaagtcattctgggggttccagtcagagtcaaagatgacgactgtgtccgctgaagccaaattgattcccaggccaccagcccttgtcgagagcaggaaacagaagtcctcagacccatctgcattgaagtggtccagtgcctgttttcggatttctcccttgatggaaccatccagacgctggaaaggatagtgtttaatagttaggtattcagccaggatatccaacattctcaccatctgagagaagataagcactcgattccccctttctcgaagtcttgtcaacagtttgtctaataaaatcaacttcccactgctccttatgagggacagaagaatctcctgtccattttccctttcattttcttcagggggtttaatcagatagcagtggttgcaacattttttcagttccatcacaatattaagaaaaccagatgtgctgcctcttgttcctttggcaagagccttgtaattcctggtcagaatccacttgtaatactgtttctgaagggctgacatctccaccctgagaatctgttccactttagcaggaagggatttctccacatcttttttgactctccggagaaggaaaggcttctagcaccttatgaagactctggtagccattctctctccccttcccatggtcttcttcaaaatcttcccaaaattcaaacttctccggcataataaagtgcagcaaggaccagagctctttgagggaattctgaagaggggtccccgtaatcaggagcctatggttggacttgaaatcaatcagagttttatacaataaagagtcatcattcttcaaccgatgggcttcatccactcccagaaaggcccagttaatactgcccagcacagtcttatctttcaagaggatctcatatgttgttataagtgcgttgaacttcaatcttttggtttgggaatgaatccattcatattcccgtatcgtatttctgctcatcaggtcacctatgtaaaccactacgttaatctctggtgcccagatttcaaactctctctgccatgaggtgagggtggataaagggacgactataagaaaggggccatacagctggtgttggtggaacaggtaggagaggaatgatatggtctggatggtctttcctaggcccatttcatcagcagggattacactattatttttgcaccaggaatgagctagccagtttagaccttctagctgataatctcgaagttccagattctcccctcctaaatatgcaggttgtttctttaaagctacaaatcgtggtctctgcttcagggccttgcattctcttgttgggatggtttttgagttgttcctactgtggaagctgtcaatgcaattctggaatttctttccaatgagggcttcatcttcccagctacactctgaataggggagtcccatccatttacatagatattcgggctcatttgagggtgccggcttccgactatgagctggaaaatctgtttgacccaatgtagatttacttgtcttcacagctattactctttctactatctgatactgtttattcaactctgaagccagctcctgttggcaattgaaatattctacatcttcaggagaaactttccctaaccattgtttgatttcgtcctcttttttcttgaagttctctagtttttttaggcccttcactttctgttgctgtaaggattcttcactctcccatgtgctgtggatgtaagaccaacccttccacttgatgaggtactggatttcaccttcatccttttcagtgtcaaagtcaccactagggtcgccattagcttcaatcgcatatacagtagtagatgctccagtggctcctttctttcccagtcttgaatctaagaccttttcaatagtttcactattatcttgctgttcatcaactccttctccagtcatttcaatgagatcatctgagtcagtctcaaagtcatcatcttctttgtaactaacgtttttagccgctcttcgacgagtctgccttttgggagcttcgtcatcatcatcatcctcatcagaagaatcttgcttttttctctttccacgctgagtcttcggctgctttttaacacgaggtttgggcactgttcttctggggacaggtcttctggcttttacttttttttgttctggctcactctctgcactggtgccttgttcctgttcatcttctgagggttcctgtttccatttttcttgttttttcagctgcctctggcctcttctttttgggctcccactctcagacccgctacttgcctcttccttaatattaaatcgcgatggttcttgtctgcttcggtttgaccgcctgaccccataaacatcaggatattcttcccacatcttcttcacatcagctatccgttccttcttagaggctggcttctctttggcttctgggaggactggctgggatttggaacctgctgattcgctctcagattccgactgactctcagaagattcagagctgctgttcgactcgctgccatgtccacttcctggatcacttccctgctcactttccgactgactgcctgagtctgaacccgaagcttcttcagaggctgagtgactcgatgcattgctgtgtagcgaactgtcctcctcttggcttttgtccttatttctcatcatcttttaattcttaaatattaagggggagggggaatctgtgtttgctttgaagtcctgtgcccaggtatttactgatccatgtagtatgtccaaaccaagagtcctatctactagtagaaaaatatcagatcccaaataattaaaaataaaggcaaaatcctccgttaaaaaacgaaaaataaataaaataaccctcaaatatgttaactggtcaaaaaaataaagcaataattaatactaaaacaggtccgaaagaaaaaaaacctcattaggagagcgcacaaaaatggaggtgcgccatggcttctaagctggaaaaaacaacgacctgggctctcagtacggctgcttctttccaacaaggcacgaaaagaaagctcctaaaagctgcttttctcccaaaaaaaggttcgaatcgaccccagtaagtccctaggaaaggcagggggctacgggggccccctgaggctgcccgaaagttagggaaagttgcgtaaagtgaggcaaaggcagggagcagagcgcgctctctctaaggcacagccgccatctagagcctccttcccagctctgagagctctgcctttgattgacactctctacatttaccccacaactcaggtgatgtaccatagacccaccccttcatctccaccaaaaaaaaaaaaaggagagagagagagagagacagatcctccatcccagg

SEQ ID NO: 1966 - DNA, 3967 bp, Homo sapiens
tttttttttttttttatgattcatatgctagtttatttatcttattattgagagataatttcatgatgacagttatcaataatcaattacaatatcaagaaattcaaagaacaaaatcttgcagagactatgcttttgtatttggatttaaaaagtatgtgatctcattttcacataccaagctgagaggccatttagactatctctttgctaatttttgcttactgctgtagggaagaagatttccaatgaactttaaatatctcattcatgtctaccattgtcgaaaaagagaaggaaaacgaggaggccaaaagaagcagcaggacagagaaaacgccacatggattcaagagttgagacaactgacagtaaaatatatgctctttggttagcaaagcaaaaagggggaaagtattgcatacatgatagatacacactagcattctaaagcaggagacaagaatgtcaagagtgtattctacccccactgccagatggaagggctattattataaatgaaaggcagcagtagtggatgccaggcacttttgttgtgtgccagattctaaagtccagatgtaagcaggttacccctgagacaggacaggcttcagttcccgcagcagaacagagccaatcacagttttctcagtgtttatgataagctgggctgtagagccttccttcagttccactgtgactagcatcaatgacccactgtgcacagttttagctgcaaacctgtgtatattatcctggccagaagggactgcacctacattggctacatttacaaccttctgaaagatcacagagggagtgaaattctgtggtgcagcaatgattacagcagaagtttcattcattcctgttagcactccttgctctttcttaaaatctttctctgacatggccacaggtaaaagcagttctccaacaggtggctgaatattaacattgaagcaatcatccttggtacacaactggaaactggcagtctgagtagaatcacaaaagtcaatacccattgaaactgtaatggatccctcaggctcaagagagtctattggattaaaaacatgcattttcatgcctataggaagttttttttcccctatgtggatattttctatctttcgatcagtagtgttattcagtgttatttgtatagagaccatcttatcaccaaaaatgcaaggctgtcttggaaagaaataatgggcagctagtccttttccactcattcgatgaagcagcacgtgagttttcgttggtacaaatgcaggagtactgacactgatgactgaagaggaagttgacaagtgtaaaccttcaagatcagccatcaaacttggagaaagagctggtgtgggaagtgcaactggagtggatactgggttaaaatcatccagatctagaagtgaaacatctttggtaagaggagttctatcttgctttgttttcttttctttctccttagtgactcttctggattcagattcactttcaggttctgactctgattcagaatcggaagaactgtcttctattgaactagattcgtcatttgaagaatctgaagttttagatttttcattttccttctccccatcttcagaatcactttttcctttggcttttgagttcctcttggctgttcttttgttttctaggcctgactcccgtccactctcactgtcctgctcactggaggagtcctcactgctgtcctcattgctgtctccttcctccccactttcgccttgttctccactttcacttccagattcactctcactgtcactgctactatcagaagagtcctcctcttcctcagattcagaataaaacttcttggcagaattctcttgctttgcttttcctgctggggtccattcttttgccaactctattacttctacatttcgaactgatgggtcgggcgccacctctggccaattagataattccaggtacccagtagctttaatgttgagagtatgagataaggtgccaagctggaaatgatctctatctttaaaaggagactcaagcagtggtgcaggcttttgtgctaggaatatttttttggcatatttacttaaagctccactcttttcattcggaacaataagctgcctaataaatcttgtacggtctctgatgtcgtagttttgatcatacttgccgagatttaatatgtactgggtaagcaattttgtctgtttggagttggttaaatacaattttgctcccagatttaatatctgcagttttaccagatcatcttcactagtgaagcttttagccatcttcctcaaaacatcaggggcaattttaggaactcgttcacagttttctccaattagccaaagaatacttgctctagcaacaggaacagtgatactgtccaggagtttggccatatgtttaataatttcaccatgttgtgcaggttgcatttgcagtaatttctttataacaaccacactttcagcaacaactatttcatccctgttggacagcagacagaccaagccattgaggcacgtgtcagtgacttccaagatgttggttgcacatctgcctatagtctgaatagtggctgctgcaaattgtttatcctggcttttcacataggtctgaaattctcgaagaagagttgatatgttggcttcatttgccaagtttgtcaaaatttcaagcttcagtgtcttgatcatagttggatcagttgacctaacatagaaactcttcagataaggttcaaacatcccctttctttgaattgacatagttgctatattttgtaggacaatatactgcacctccctgttgctacgaagtaaacgcactagtgatttagaaattatgccagcttcagattttggtgatatgtgccaatacagctgagcaactgccataaccaccgcagcattcctgctctgaagcaaaggctttgtatttctaattaagagtctatgatctggatccatagtatacggcttcttctttttgtcagtcttttccttctgatcatcatcagattcgtagaaattctttccattgtcttctaattcatcaccctctttccaagggctgacaaactgtgtccgagcatatcgagttagcatgtggattatgacaacctgcccccactcttcaacatccactagtaagttacatagcttgcggtaatttttatgaatcagatctattctgtccgggcatacttcttcaaaagccatcacaacactgccagctaccaatgtgcttttatctttcagaagtttttcaattacttcaattaacatttccttctgctctggatcaaggctgtataatttttgtattgcatgggctgcattcttcctaacatatggtgataagtcagcagaagcttccttaatagcaagcatcatgataggtacaataattggcactctaatacttgacagaactctcaaagcgcttgcacgaattagttggtttgggtccttcagagctcgctgaaaagtgcttatggacaggagtgcaagatcctgctgttcttcagcatatcgaaccaggtaaacatataccaacttcttgatctcaatatttttactggccacattcttcacaacagcaggaaacagttcagatgcatttttcccttttgcaatcatcccaacaatccgcttcatagcatccagtttagcagaatctttgttgctctctaacatttgctttagatcttcattcttcttcaaatcgctgctaaagaggccgaaggcccccgagggggaaatggttgaggtcgcctcctgacccagctccgtcgcctcccctcctccggactgctcattgtaaggaaaactattgctggacattgccgcggtgctggcgggtgcggggttggtcctgccgggggttctctccaaaaggttccagtccagagggcacggaacaaaactagttctcg

SEQ ID NO: 1967 - DNA, 3219 bp, Homo sapiens
  misc_feature (1)...(3219): n = A,T,C or G
atcatcatcatgatcgctcgatttttttttttttttttttttttttttttttttttttatttgggatcttttttatttttatacacatgacaagattttacatcaagaatagtcagttaaatagtacaaatttacattcatgaggaatgttaaaaaaaattcaactaaaaaacccactttttcctgtgacccataatcccacattttacagtgcaggggagaaggggattagggggcatccaaaacaagtctctcccaaaaagaaatgatgtaaatttcacattccctctccacacaggatccaaatggtgagagtataatttacaattcatctttttcagctgtagattcctttgctgtttcttcttcttcatctgttcccacatccatttcttcatcttcgtcttgctctgtgtcttctgttgtgtcttctgctgtctcttcaggttcttcttcgggctcttcttccacctttgcatcagggtcaatgttcaaactgaggcgaagcattctttctattctatctccatatgctttagtgtctggtaaaagataccctgaccgaagcgttgctgtttcaaacaaaaccacagcaagatccaaaactgttttatcatcttcatcttccttaattcgtcgaagcatgtctctgatcagcgggtgtctgggattaatttcaaatgttttcttctgactcgcatagtaatttgtagagatgtccttgcccgtttggtacgcttgtgctttcatgattctctccatgttgccagaccatccgtactggctggccaccaaagcacacggagattctgtcaggcgctgagacaccacagccttttcaatcttgtccttaagggctttatctttcatccaattcagcagaggctcaaattctttctcaactgcttcacgactctccttagttttctcactttcatcgaacttcactccttccttggcaacattctggaacctcttcccatcaaattcgggaagggcctgaatacagtattcatccacaggttctgtgaggtaaataacttcatagccctttttcagaagtcgctcaacaaatggagaagattcagcctcttttctgctggacccagccatgaagtagattttgtcttgtttttccttcattctttccacatactggtctaggctagtaatgtcagttggatgatgagaagactggaacctaagaagtttagcaagacgtgttcgattcgagtggtcttcaatcacaccaagcttgatgttggtaccaaattctttccaaaaagtatcattgtatttatcatcagcaatcttcttgatcatgtccagcgttttacgaacaagcttcttcctaatcaccttaagcagtttatgttgctgaagagtctcgcgggaaacattcaaggggagatcatctgagtccaccacacccttgacaaaattgaggtatttaggcatcatatcatggaagtcgtctgtgatgaatacacggcgcacatagagcttaatgtaatcgctctttttagatccatattcgtcaaacagaccacgtggagcagatgtgggtacaaataaaattgatttgaaggtaacttccccttcagcagtaaagtgaatataagccatggggtcatcactttcctttgaaaatgatttgtagaaagctttgtattcatcttcttctacttcttttgatggtctctgccatattggtttgatatcattcataagttcccagtcccagacagttttttcaacttttttagtctttggtttcttttcttcttcttcttcctctactgcagcttcatcatcagattcttctttctcttctttggctgcttcttcttcctccatgggctcctcaacagtttcagtcttgctgctccatacataaataggaaagtttatgaactgtgaatattttttgacgagatttttaattgtatccaattcaaggtaatcagatgcttcttcttttaagacaagggtaattgtcgttccccgtcctagagtgtttcttcaacttttttagtctttggtttcttttcttcttcttcttcctctactgcagcttcatcatcagattcttctttctcttctttggctgcttcttcttcctccatgggctcctcaacagtttcagtcttgctgctccatacataaataggaaagtttatgaactgtgaatattttttgacgagatttttaattgtatccaattcaaggtaatcagatgcttcttcttttaagacaagggtaattgtcgttccccgtcctagagtgtttcctcttgggtcagcaattacagaaaattcattggagtcagactcccagatgtgctgggtatcgttgttgtgttttgaagtgacaataaccttatctgctacaaggaaggcggaatagaaaccgacaccaaactggccaatcaattcagaagttgactggccatcttcctgtgcttcagtcattttgtttaaaaactcgcttgtcccagatttggctatggtaccaaggtttttaaccaactcttctctggtcattcctacaccggtgtctgtgacatgcagcaggttcttctccttatcacacttaattttgactgttagttcctcatttccagaaagagcattttcatcagtcagtgatattagccttatcttatctaaagcatcagaagcatttgaaatcagttctctcaggaaaatctctttatttttatacaatgaattgatgataagtttcatcattctgttaacttcggcttggaaggcaaattttccgacttctctctaagttctcttatttgtgatgcatttaatccatccaactgaatagcttcttcctctctctgtactacttcatcatccgtccttgatccttctctacttttccccaaacccttttcttgcccatcccataacttaattgcagcttgaccgaccgaagtaagaggacccaaaggcccaacccccaggcccctttgggtgcgggcgaaattaatacctctaatcagggcccccttggccaatttgcccgggccaaatcttattgggggttaaaaaaaaattttattgtttggggaaagttcccccatccccaaaaaccccggaaaagggaaggggggcgttaggggaacaatattggctcctccctcncccaaaanccccgcctattaaaacccgggagggaaangtnttccctctcctctcaccccnc

SEQ ID NO: 1968 - DNA, 1245 bp, Homo sapiens
  misc_feature (1)...(1245): n = A,T,C or G
gacaccaaantggccantcanttcagaagttgactggccatcttcctgtgcttcagtcattttgtttaaaactcgcttgtcccagatttggctatggtacccaaggtttttaaccaatcttctcttggtcattcctacaccggtgtctgtgacatgcagcaggttcttctccttatcacacttaattttgactgttagttcctcatttccagaaagagcattttcatcagtcagtgatattagccttatcttatctaaagcatcagaagcatttgaaatcagttctctcaggaaaatctctttatttttatacaatgaattgatgataagtttcatcattctgttaacttcggcttggaaggcaaacttttccgacttctctctaagttctcttatttgtgatgcatttaatccatccaactgaatagcttcttcctctctctgtactacttcatcatccgtccttgatccttctctacttttacccagatcctcttctactgtaccatccacatcaacttcatcgtcagctctgaccgacccgaaggtcagcaggacgcagcagaggcccagcacccacagggccctcatggcgtgcggccggtgagtctcaagtccccttcgatcgcaggagccgcctccaccccccacccctgggttcggatcctcacacctccagccgcgcggtccgccactacaccgcaagcaggtcgggccgcttttcacccccacttcccgcgggcgggggacgggaaacatgaacccaccaatcgcgccgcaccacgcacccacggcacccaatgaggattcgtgagggggggcggaagtccaccaatcggagctgtccaggtgcggtgaccgatgcccgaagcgtggctccttccgattggtcagggtttgcagcttttctccaatcaaatggctccgcgggcccctcacacgtgggacgccctttcctggcgccttggcctctaagggaaaacgtccaatgaatgtaagcagagaacacatccatccttttagagaggtcgcggcggaactacttccggatcctagagagcgtttattccgtgaccggggaaacggtagccatgcgaacgtgttcttcaccctttcccatctatgcctgggggtttcgttggaagtgattccagcacgactttcgcggccagctttctcgtgtggcggcgcttctcggaaagaagaaacacacgagagaggttgcaaatcccctagaaccctttc

SEQ ID NO: 1969 - DNA, 614 bp, Homo sapiens
  misc_feature (1)...(614): n = A,T,C or G
ttttttttttttttctctcaatcatcttttatttctgtaatatgcagcataaagatttcttggttgagatacaataagggtgtgaaaaaagaaaaaaaaaattcttgacatctaacaataaagaagccagaaacagtaaggaaaattgcactcatatttttctacctacttgcaccaggaatgagctagccagtttagaccttctagctgataatctcgaagttccagattctcccctcctaaatatgcaggttgtttctttaaagctacaaatcgtggtctctgcttcagggccttgcattctcttgttgggatggtttttgagttgttcctactgtggaagctgtcaatgcaattctggaatttctttccaatgagggcttcatcttcccagctacactctgaaatagggagtcccatccatttacatagatattcgggcctcatttgaggtgccggcttccgactatgagctggaaaattgtttgacccaatgagatttactgtcttcacagctattactctttctactatctgatactgttattcaactctgaagccagcctctgttggcaattngaatattctacatcttcaaggagaactttccctaa

SEQ ID NO: 1970 - DNA, 603 bp, Homo sapiens; identical to SEQ ID NO: 1179

SEQ ID NO: 1971 - DNA, 505 bp, Homo sapiens
  misc_feature (1)...(505): n = A,T,C or G
aaaagngggaaaatnggcccctcggaggccnaaagaaanggggnaagaagccttcccctcccttcccttcccctcccttccctncccctcccttcctncccctccctcccttnccctcccttccctcccctccttcccttgttctctntcttcttctgtttttttntcattggacttttttccaagccatcatctttcacttctccctcttctgatggattatctgaatgcctaggagatgaaagctcaattccatgctcctctttcagcctgggcactttgttttccttctttacccgaggcttccgcttctttaatttggcctcttccccacctgtcacagcccccttcttctccagaccctttctgagcagcttcaacaagtaatccgctcgggtctgtagctgcttcccctgaggctatttatctgtctccaccggcagaatctgtgctgttaacagggttgaacaactcaggtaggaggggcttgtggcttcatctgcta

SEQ ID NO: 1972 - DNA, 797 bp, Homo sapiens
tttttttttttttttttttttttttttttttatacacatgacaagattttacatcaagaatagtcagttaaatagtacaaatttacattcatgaggaatgttaaaaaaaattcaactaaaaaacccactttttcctgtgacccataatcccacattttacagtgcaggggaaaaggggattagggggcatccaaaacaagtctctcccaaaaagaaatgatgtaaatttcacattccctctccacacaggatccaaatggggagagtataatttacaattcatctttttcagctggagattcctttgctgtttcttcttcatctgttcccacatccatttcttcatcttcggcttgctctggggcttctggtggggcttctgctggctcttcaggttcttcttcgggctcttcttccacctttgcatcaggggcaatgttcaaactgaggcgaagcattctttctattctatctccatatgccttaggggctggaaaagataccctgacccagcggtgctgttcaaacaaaccacagcagaccaaaactggttatcatctcattttcttaattcgcgaacatgtcttgaaacacggggctggattaatccatggttctttacttccaaaaaatttgggagagctttgccctgggacgctgggcttatgttttttctgtgccaacatccgtcggtggccccaaacaacgggatttgggggcgtgaccccacctttttatttagaaagaaaagcaataattattcaaagggaggctggcatgctttatggctaaatttc

SEQ ID NO: 1973 - DNA, 682 bp, Homo sapiens
tcacgtgcctgcgccggcagcgctcccactttcctgtccggtgcggccccgggtccatgtattttgggtccggcctgctcgccgtccgctccgtccgcccttagacctgttgcccagcatccctgcagttcgcgcctgccgaccatgcccgcggggtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactaaaa

SEQ ID NO: 1974 - DNA, 683 bp, Homo sapiens
  misc_feature (1)...(683): n = A,T,C or G
gaaaatgaacgggtcccccaaaaaaagcaaanggagaagttgatagccaaccccgattcatgctgtgtaacgactgccccccctggnctttggccttattcccaacaancttttaatccctaaaatttaagggggngggaatctgtgtttgctttgaagtcctgtgccccngntatttactgtcaaaagttgaaagaaaggtaaggtcccggcttctatcgatgctttttattatcaggaacaaagtcctgacgatgttaacgatattgttataacacaacaacggtaagcaccaaaaaactaaatatttctattttttccttaaaagaaaaaacaacaggataaaccgaacagtggaagcatcactatcaatanggaaactttctcaaagtagcacactagatacaaataacaacctctgtatcttattgcgtcatccaagaatttctcgtatttacagaaaacaaggcaaacttaaacaaataaatctttaaaattatcaccaatgatcgtgaacttacctgatccatgtagtatgtccaaaccaagagtcctatctactagtagaaaaatatcagatcccaaataattaaaaataaaggcaaaatcctccgttaaaaaaacgaaaaataaataaaataaccctcaaatatgttaactggtcaaaaaaataaagcaataat

SEQ ID NO: 1975 - DNA, 727 bp, Homo sapiens
  misc_feature (1)...(727): n = A,T,C or G
ttttttttttttttttttttttttttttttttttttaaggccataattaggagtttattttgaaggataagggagtttaatgggggcagggacaaatacattagtaaaacataaaaaaacagttttatagggaaaaaatacaaaaacataacaattataggggtaggacatcggtaaagcccccaattcctggcactttgaataatacaaaacccattattatatcattagggtggacagcaacacctttcaccattgaaaaggggattaaaaattaatgtttcatttaaagacatattaatcaattttcaagtatgccaggaatataaacaaacatctgtttttaaggttgtaagtgcaaagcattaacaaaaattggaagattgtgcactaatatctgttaatggctatgtccctatgaaaatttattttaaagactgtacaggaataaccacatattatttggtatgtaaatttctagaaagntgnaaacatctctcaccttgctctttcttaaaatctttctctgacatggccacagggaaaagcagttctccaacaggtggctgaatattaacattgaaacaatcatgcttggtacacatctggaaactgcagtctgagtagaatcacaaagtcaatacccattgaaactgttatgattccctcagcttcaagaaagctatggattaaaaacatgccttgccatgcctaatagaagtttttt

SEQ ID NO: 1976 - DNA, 445 bp, Homo sapiens
  misc_feature (1)...(445): n = A,T,C or G
catggtangtattgtccccaaacccaaggngtccctaatccnacttangttgggaaaaaattatnccggatncccaaaattaattaaaaaattaaaggccaaaattcctcccgttaaaaaaacggaaaaatnaataaaattaaccctcaaatatgttaactggtcaaaaanataaagcaataattaatactaaaacaggtccgaaagaaaaaaaacctcattaggagagcgcacaaaaatggaggtgcgccatggcttctaagctggaaaaaacaacgacctgggctctcagtacggctgcttctttccaacaaggcacgaaaagaaagctcctaaaagctgcttttctcccaaaaaaaggttcgaatcgaccccagtaagtccctaggaaaggctngggctacgggggccccctgaggctgcccgaangntagggaangttgcg

SEQ ID NO: 1977 - DNA, 443 bp, Homo sapiens
  misc_feature (1)...(443): n = A,T,C or G
cttaccctccttccttccctccttccttccctccttccttccntncttccttccctccttccttccctccttccttgttctctttcttcttctgtttttttttcattggacttttttccaagccatcatctttcacttctccctcttctgatggattatctgaatgcctaggagatgaaagctcaattccatgctcctctttcagcctgggcactttgttttccttctttacccgaggcttccgcttctttaatttggcctcttccccacctgtcacagcccccttcttctccagaccctttctgagcagcttcaacaagtaatccgctcggggtctgtagctggttcccnggagggctttttatntgtctccaccggcagaaatttgtcagttnaatttaaggtttggggnttgtttttaanttaagggggccgaaaggttt

SEQ ID NO: 1978 - DNA, 428 bp, Homo sapiens
cagggtccacagggatagatttatgcagcatctcaaactcctcttcatgttggataatggatttcacattaacctgaactccggatatcttgattgttggacctctccttttccctggtccttttccttctctttcttatcttttgacttctttctttccttgtccccttctttgtctttcctagaactcatttgtttctccttgttctccttgttctctttcttcttctgtttttttttcattggactttttttcaagccatcatctttcacttcttttgatggtctctgccatattggtttgatatcattcataagttcccagtcccagacagttttttcaacttttttagtctttggtttcttttcttcttcttcttcctctactgcagcttcatcatcagattcttctttctcttctttggctg

SEQ ID NO: 1979 - DNA, 374 bp, Homo sapiens
tttccttctgatcatcatcagattcgtagaaattctttccattgtcttctaattcatcaccctctttccaagggctgacaaactgtgtccgagcatatcgagttagcatgtggattatgacaacctgcccccactcttcaacatccactagtaagttacatagcttgcggtaatttttatgaatcagatctattctgtccgggcatacttcttcaaatcgctgctaaagaggccgaaggcccccgagggggaaatggttgaggtcgcctcctgacccagctccgtcgcctcccctcctccggactgctcattgtaaggaaaactattgctggacattgccgcggtgctggcgggtgcggggttggtcctgccgg

SEQ ID NO: 1980 - DNA, 458 bp, Homo sapiens
  misc_feature (1)...(458): n = A,T,C or G
gcagggtgcaatgggggtagaggctgtttatattcccccagtttatctgtgtggaaagagcggtaatggtctgagggtccctggccatggtagcccatagcggggcggtgatcagacattcgtcggaaatcctgctggtggtaattttgaggcctaaattcatcggatctcctccgcttggagtcatgatggtgcctgaaatagagatgcaaggattagtcgaaagacttgaagccagattcccatccacttctcttcactacccacttggctcttcctcatattactcatatttcaagggacaaatgctcacattatttagggaatcaaaaaaatttattaacagagtccatttttacanttatttaggcaaaatacatcccatggaattaagggntcaagtgtggcagttgacacaagttacacanttggaaaatttactgntgggntttgncaaa

SEQ ID NO: 1981 - DNA, 425 bp, Homo sapiens
gatcttgctcactgcaacctccgtctcccgtgttcaagcaattctcctgcttcagcctcccgagtagctgggattacaggcgtgtgctaccacacacccagctaacatttttgtatttttagtagagacagggtttcgccatgttggccaggctggtctcgaactcctgacctcaggtgatccacctgtctcggcctcccaaagtgcggggattacaagcatgagccaccgcgccggcctgccttcattcttttagtgttgaatatttaaatacgtgccaaggtaatacatataagtttttaatcaatatagatttaccttgctgctccatacataaataggaaagtttatgaactgtgaatattttttgacgagatttttaattgtatccaattcaaggtagtcagatgcttcttcttttaagg

SEQ ID NO: 1982 - DNA, 474 bp, Homo sapiens
  misc_feature (1)...(474): n = A,T,C or G
tttgcnaccccggaaccactggaannncccncctccaaatgggtttganatcaatcataagttcccagtcccaagacagtttttcaacttttttaatctttggnttcttttcttcttcttcttcctctnctgcagcttcatcatcagattcttctttctcttctttggctgcttcttcttcctccatgggctcctcaacagtttcagtcttgctgctccatacataaataggaaagtttatgnnctgtgaatattttttgacgagatttttaattgtatccaattcaaggtaatcagatgcagnagaagaaacagcaaaggaatctacagctgaaaaagatgaattgtaaattatactctcaccatttggatcctgtgtggagagggaatgtgaaatttacatcatttcttttgggagagactttttcctgtgacccataatccnacattttacagtacaggcggccccccccn

SEQ ID NO: 1983 - DNA, 459 bp, Homo sapiens
  misc_feature (1)...(459): n = A,T,C or G
catatcatnggaagtcgtctgtgatgaataccacggcgcacatagagcttaatgtaancgctcttttaagatccatatncgtcaaacagaccacgtggagcagatgtgggtacaaataaaattgatttgaaggtaacttccccttcagcagtaaagtgaatataagccatggggtcatcactttcctttgaaaatgatttgtagaaagctttgtattcatcttcttctacttcttttgatggtctctgccatattggtttgatatcattcataagttcccagtcccagacagttttttcaacttttttaggtctttggtttcttttctttctccttagtgactcttctggattcagattcactttcaggttctgactctgattcagaatcggaagaactgtcttctattgaactagattcgtcatttgaagaatctgaagttttagatttttcattttc

SEQ ID NO: 1984 - DNA, 569 bp, Homo sapiens
ggccagtcccctggccatgtgcgcaggggcagaagtggtgcacaggtactaccgaccggacctgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaaccgccaaagcacatatcatcaaaccatttcatgaatatggtttggaagatgtttagtcttgaatataacgcgaaatagaatatttgtaagtctacaaaaa

SEQ ID NO: 1985 - DNA, 435 bp, Homo sapiens
  misc_feature (1)...(435): n = A,T,C or G
atgggaacttttttccaaangccatcaacctttcaacttcctcccctccttcctgaaggnattatctggaatgccctaggagatgaaagctcaattcccccgctcatctttcacttctccctcttctgatggattatctgaatgccctaggagatgaaagctcaattccatgctcctctttcagcctgggcactttgttttccttctttacccgaggcttccgcttctttaatttggcctcttccccacctgtcacagcccccttcttctccagaccctttctgagcagcttcaacaagtaatccgctcgggtctgtagctgcttcccctgaggctttttatctgtctccaccggcagaatcttcaacaacccaaaatatagataaagcctcagatcctatctcatgtccatggctcccagccactgaaaatccc

SEQ ID NO: 1986 - DNA, 491 bp, Homo sapiens
  misc_feature (1)...(491): n = A,T,C or G
gaaangcccngcccgacccttngcgggaaaggttgggggaaaacaaaccccttggcatccngggtccaatgcttccaaaccgtaggcgaagcatcccttccctattcccatcccccccatatgcctttagtgtccgggtaaaagatacccctgacccgaagcgttgcctgtttcaaacaaaacccacagcaagatcccaaaactgttttatcatccttcatcttcctgaaatgcaagaagatgcactagattaatattaaaagatacaaagtactcaaattaaaagacaagcaagaggactgctttaatactaccttaattcgtcgaagcatgtctctgatcagcgggtgtctgggattaatttcaaatgttttcttctgactcgcatagtaactgttaagagataaaaatgaacattaacaaaacatatccaattttagggttcatacgtttcccttattctttcataattacaaagaaaatntcttggt

SEQ ID NO: 1987 - DNA, 340 bp, Homo sapiens
ctttctcttgtttggctacttcttcttcctccatgggctcctgaacagtttcagtcttgctgctccatacattaataggaaagttaattaactgggaataatttatgacaatagtggaaattgtgtcctattcaaagtgatcagattcttctaatttggagacaagggtaattggcagtcccacgactatagtgtgaacgcttgaatcggctatatcagaataaatgattgaaatcgaacaaccaaatgtactgagagtatatggggagtgcgggggaatcgggacatagactgattcaatgtaagcggaaaaaaaagccacaacatattgaaatatgag

SEQ ID NO: 1988 - DNA, 333 bp, Homo sapiens
  misc_feature (1)...(333): n = A,T,C or G
acangacagcaacccatgtctgtccaagggtaaacaattgtaagcctggaggtttcccccccccaaaaaaaaagacaaaaaggaagaaagttggatagcctcatacctcgaatgcattgctgtgtagcgaactgtcctcctcttggcttttgtccttatttctcatcatcttttaattcttaaatattaagggggagggggaatctgtgtttgctttgaagtcctgtgcccaggtatttactgatccatgtagtatgtccaaaccaagagtcctatctactagtagaaaaatatcagatcccaaataattaaaaataaaggcaaaatcctccg

SEQ ID NO: 1989 - DNA, 768 bp, Homo sapiens
  misc_feature (1)...(768): n = A,T,C or G
aacggggtgccngggaattaaatttccaaaggttttcctcctgaactccgccatagtaaattggtagaagatgtcccttgccccgtttgggttacgcttgtgcctttccatgaattcctcctcccatgttgcccagacccatcccgtactggctggcccacccaaagcacacggagattctgtcaggcgctgagacacccacagccttttcaatccttagggaaagaaatcaagtcatataaattaatatcaacaggtaaggtcattgagcaattgtctttcaactgtctaagactttatcacttaagatcataaacacagaagcaggtcataaaaatagcttttcttaaggtttaggagaatttgtaggggcacttacttgataatctgaattttctagtcagaagtttaaataccaccttttaaaaacataaaatttaatttgtaacaagttattaacaaagcagtattgtcgaaagttttaagctttctcccaataattttaattacattaattaaatttttaccattctaatggttacaaagtaaccagctgcagcttaatttgttcacaaaataactttctcttaaatgctgatactaatatttccacaatttgtaatttccacagtaccttgtccttaagggctttatctttcatccaattcagnagaggctcaaattctttctcaactgcttcacgactctccttagttttctcactttcatcgaacttcactccttccttggcaacattctggaacctct

SEQ ID NO: 1990 - DNA, 625 bp, Homo sapiens
  misc_feature (1)...(625): n = A,T,C or G
cgccgtccgctccgtccgcccttagacctgttgcccagcatccntgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggggtgcccatgtccacctaccttgaaaatgttcgcagccagtctcctggccatgtgcgcaggggcagaagtggttgcaaaggtaactaccgaccggaccttgacaatacctgaaattccaccaaagcgtggagaactcaaaacggagcttttgggactg

SEQ ID NO: 1991 - DNA, 423 bp, Homo sapiens
gcctcccgtccgcccttagacctgttgcccagcatccctgcagttcgcggtacagtctctagtagagcgcgtgtatagaggcagagaggagtgaagtccacagttcctctcctccaagagcctgccgaccatgcccgcggggtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttccttaatttattgcatcaactactttgtcctt

SEQ ID NO: 1992 - DNA, 469 bp, Homo sapiens
tttttttgtgtgttgaaagcagtgtgctttattaacatttatatgttctttacctatgtctttgggttttgctccagcaattactgtcactgttgtcaaccactttgttctttgtagcaaaactggatcacaagtctttcggtcggagaactggaaggtctgggcagagtcgagcagaggagaccatgatgactgcctagacttgtgctcagtgctgtgttggggagaactgctacaggtgcttttagttgtccagctcagctcatctttgctgtttcttcttcttcatctgttcccacatccatttcttcatcttcgtcttgctctgtgtcttctgttgtgtcttctgctgtctcttcaggttcttcttcaggctcttcttccacctttgcatcagggtcaatgttcaaactgaggcgaaatttctttctattctacctccatatgctttagtgctggtaaagatacc

SEQ ID NO: 1993 - DNA, 536 bp, Homo sapiens
  misc_feature (1)...(536): n = A,T,C or G
ttattnaggtnccactgtggcctagcatcaatggcccccactgtgcaccagttttaggctggcaaaccctgtgtatatttatcctggccagaaagggactgncacctacattggctacatttacaaccttctgaaagatcacagagggagtgaaattctgtggtgcagcaatgattacagcagaagtttcattcattcctgttagcactcctgtaaaagcaaaagaaggctcccttttattaatntctttttgaaaattacatttacagaattttaagctcatggccaaaattttaactttttttcaacaaaagaaacactactttaggatgtaatttacaagataattataaaactaaaacaaaatgcaattgtttcgaagttttttaaaatcctcattgtataggaaaatgtgtaaaaattcagtaaaaaatcacttaaatctaattttaagtatgataggataaaaacttagaatcacacatatgaaatatcaatttcagtctctttaaagtatactcaatctggggtttatc

SEQ ID NO: 1994 - DNA, 395 bp, Homo sapiens
  misc_feature (1)...(395): n = A,T,C or G
aatgctagtttatttatcttattattgagagataatttcatgatgacagttatcaataatcaattacaatatcaagaaattcaaagaacaaaatcttgcagagactatgcttttgtatttggatttaaaaagtatgtgatctcattttcacatacaaagctgagaggccatttagactatctctttgctaatttttgcttactgctgtagggaagaagatttccaatgaactttaaatatctcattcatggtctaccattggtcgaaaaagagaaggaaaacgaggagggccaaaaggaaggcaggcagggacaggngaaaacgccacctcgtggccggatttnctggcagnccgggggggatccactaggttctagaggngggccggcancggg

SEQ ID NO: 1995 - DNA, 510 bp, Homo sapiens
tgttattttttactctttaaagacttctaggttacattgaattacagccttattaagggttagacatttatgttttttgttttgtttttttttgcagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaaccgccaaagcacatatcatcaaaccatttcatgaatatggtttggaagatgtttagtcttgaatataatgcgaaatagaatatttgtaagtctactatatgggttgtctttatttcatataaattaaga

SEQ ID NO: 1996 - DNA, 360 bp, Homo sapiens
tttatgattcatatgctagtttatttatcttattattgagagataatttcatgatgacagttatcaataatcaattacaatatcaagaaattcaaagaacaaaatcttgcagagactatgcttttgtatttggatttaaaaagtatgtgatctcattttcacataccaagctgagagtctattggattaaaaacatgcattttcatgcctataggaagttttttttcccctatgtggatattttctatctttcgatcagtagtgttattcagtgttatttgtatagagaccatcttatcaccaaaaatgcaaggctgtcttggaaagaaataatgggcagctagtccttttccactcatt

SEQ ID NO: 1997 - DNA, 301 bp, Homo sapiens
  misc_feature (1)...(301): n = A,T,C or G
nnccgggaagggcctgnatacagtattcatccacaggttctgtgaggtaaataacttcatagccctttttcagaagtcgctcaacnaatggagaagattcagcctcttttctnctggacccagccatgaagtagattttgtcttgtttttccttcattctttccacatactggtctaggctagtaatgtcagttggatgatgagaagactggaacctaagaagtttagcaagacgaagatgaagaaatggatgtgggaacagatgaagaagaaacancaaaggaatcnacggcagnganaa

SEQ ID NO: 1998 - DNA, 263 bp, Homo sapiens
  misc_feature (1)...(263): n = A,T,C or G
gccggangttccatccatccctgntagcactccttgctctttcttaaaatctttctctgacatggccacaggtaaaagcagttctccaacaggtggctgaatattaacattgaagcaatcatccttggtacacaactggaaactggcagtctgagtagaatcacaaaagtcaatacccannnactttgtaatggatccctcagtcnnttannggatacgactcactataggnanttnttcctctatacgactcactatagggn

SEQ ID NO: 1999 - DNA, 230 bp, Homo sapiens
tctgttgccagccagctgagtgagggcatgatcttggctaactgcaacctctgctcccgggttcaagctaatctcctgtctcagatttggctatggtaccaaggtttttaaccaactcttctctggtcagtcctacaccggtgtctgtgacatgcagcaggttcttctccttatcacacttaattttgactgttagttcctcatttccagaaagagcattttcatcagtc

SEQ ID NO: 2000 - DNA, 796 bp, Homo sapiens
ccagaacccccccatacgtatcacggttgtgcgtggggtactcttacactcacgggggtgccgggcccctggaacctgcaactcacgcaggatgctcttttaacttactctattatgtttcctgttttatacggtgctgtatcgttggctctgtctttaagatcattcaccttttcctccatgtgtggtctgtgaaccccatccattgtagccttgatttctagaagtttggtttgcatatttttaaatggtctatgtttctacttagctctttcaacacagggaacgcagtcaggatgactgtcagtgtctgtctggcgattctaacacttgtgttagttctgaccaggatttcgcagtggatttttcctccccttacgggtgggttttcctgcttccccgaatgtaatctttgaatcgatggcagacattgttaacatcacctttgttgggtgtggatgtttgtgtttatgtggaaacattcctgcacctttttctggcgtgcggttcagttacatggaaaaggtttggcctcaggtcttattttaaagtggccatcagggccgaatgttctgcccattttgtccacactaattatccctctttggggagcaagacccttgtgagatgccaccgccaccctcgggaggcctccaggctgggggacgggcactgtgggctgctggtgtaaggccggacgctctctgacaggtgtggcccctggcctccagcggcttcctcccaagctgggttggggctcttctgaacgctcccctccatgcccttgcctgggaac

SEQ ID NO: 2001 - DNA, 1467 bp, Homo sapiens
  misc_feature (1)...(1467): n = A,T,C or G
tttttttttttttttttttttttngttttttttttttttttttttttttttttcaaagtggttatttttattatcttacctccactgggttttcagtcccaatggagattgtgagacctggcaagaccttgagatcagtagcatccctgaggggtaaacacaagactggtccactgtctgctgccctgactttcctacaactcttaagaggtttgcagtccccattcctcatagccagccatagaaatctttccctgaaacaggaaacactttgggcagcagagcttctcatcccattccaggtagacaaccacacccctaaacactcctctccataactgaaggtcagagggtgaagggaatagtctctgctctctgtgaccaggaacttcactcgttcctttccagcatcattcctgctctcaagcgcctgagtctgggccttttctacctagtgggctacacactgctcagcccccacatcacagaagactatctcctcactgaagactatgacgtgagtgtctactaaagcagcagcagcatgactgcaccagagctagaaaatggacaggcaaggatccctacagatagcagagaagtaggaaatatcatctacaagtgcatgttggttttgctctagatctgtgagttgtcaatgccagccgtgctgggacatgttcatcagccagcactgaacaaccttcgcgggcacagggctgtgccaggtgcacatttagcacccgttgccttctctaggagccgctcctagcttgccttatcacatccacgtgacccctcagagcacagcagcttctgattctccatcctattttcttctcttgactgatacatttgggcacttctagggaattcagaaaccaagggaaggggggaagtgctggcttttgctcctgcccagctgaaaggcttgaaaacagttcagtaattctgggcaggtttctctccttaaattaaaatccaatatgggcccctctgtacttaacattccaaatgctcattccaaacactttgccaacgaaggcaaacagtagagaagttaaatacagtgctgcccttgaggctctccaagggaaaggcgaatgaatattctcccaggccctctgcttattcctctctgcctattgtgaaggcaatcaggccagactattgagggcatctggcagcaggactcaggcaggtatgaagtagccagccacaagtgtgaaaaggaagagtgctgagagaaactgcctagtcatgtgatatccctaatgcactgtgctttcttccctcaagaaccaccccttctggttccgctgcatgtacatgctgatctggggcaagtttgtgctgtacaaatatgtcacctgttggctggtcacagtaagtagaaaagttgaaacaaggtcctatttagacaagccatgggggccagtatggggagtggcaagagccctaactgag

SEQ ID NO: 2002 - DNA, 2278 bp, Homo sapiens
  misc_feature (1)...(2278): n = A,T,C or G
ttttgcccgcattcggggcgcgcggagtgggngggtccctgtgggcatcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattggtttggctgttgactactttgacggagggaaagatcagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccgctacatcttcaaacgactcaagttccttggaaataaagaactctctcagggtctctcgttgctattcctggccctctggcacggcctgcactcaggatacctggtctgcttccagatggaattcctcattgttattgtggaaagacaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggtgtataaatccatctatttccttggccacatcttcttcctgagcctactattcatattgccttatattcacaaagcaatggtgccaaggaaagagaagttaaagaagatggaataatccatttccctggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttcaaaaaaaaaaaaaaaaaaaaaaaaaaaaaatcgccg

SEQ ID NO: 2003 - DNA, 929 bp, Homo sapiens
tctttaggtttttttttttttttttttttgcaagaacagtattcataggataaacaaatagcaaatgtacagccttggcttccccaaactccacagtctcagtgcagaaagatcatcttccagcagtcagctcagaccagggtcaaaggatgtgacatcaacagtttctggtttcagaacaggttctactactgtcaaatgaccccccatacttcctcaaaggctgtggtaagttttgcacaggtgagggcagcagaaagggggtagttactgatggacaccatcttctctgtatactccacactgaccttgccatgggcaaaggcccctaccacaaaaacaataggatcactgctgggcaccagctcacgcacatcactgacaaccgggatggaaaaagaagtgccaactttcatacatccaactggaaagtgatctgatactggattcttaattaccttcaaaagcttctgggggccatcagctgctcgaacactgagcttgtgtaaaagttgaaccatgaggccacaaaagcggtcaaaggttctgggaattcgggtctggggattcacttcaatcagaacattcttctgtgtatggatataaacctgtagcaagccagctcggttcaggggactatccatcagcatcagcaaactctggtgggtgatatctggccgcgcttccccagggtcccgtccattcttcaacaatatagacttgtgcttgtcacagttgagtagctcatatgtcttccctaccttgactgtctccagactggccccttccagcaccacaataagcctacggcctccgatcttgtttcctgcccctagtcggggccgcttgggtggcagagcatcccagtcctgtgcctgctccccaccgcttcgttcacgaggcttgaatccatcactgggcgcggccgc

SEQ ID NO: 2004 - DNA, 799 bp, Homo sapiens
tttttttatctctcctaataatcttttttattttaataaataatttccatcctctcctccaaaacatgaggttattctgaaaaaaaagatcctgatgccaacattttttctttatatattacgttgtgattggaagtctcaggacggtgggagtgtaaaaaccaggctaaattctctcttcttgcatccaggaaaccagctctaccactccctgctgtgtattgtgcttcagttcctcatccttcgactaatgggccgcaccatcactgccgtcctcactaccttttgcttccagatggtaaacgtctttcccttagcagctcaggctacagctgacagcggttcaggggacaggggtaggcaggggactgtggtatagaaattagcagacctaatttctaacccctctcccagcacttagcagtatgacttcaggtaggtggcttatcacaggcccaagtgttccatccacagattgtaatggtaactctttgcctgcctcaaggaagggccaccagctaaccctttgcatactgtgccattaggctctttggtttaacccactatccaggagcagagtcacttcaaggcaagacagaaaagcaactttagatgagttaaagaacctaagcctaggccaggcaaagtggctcacacctcgtatccccagcaccttgggaggccaaggcagtcagattgcttgagccccagagttgagactaacccgggcaacatgtgaaacccatctctacaaaaaaatacaaaaattagccctccagcctgggcaacatggtgaaac

SEQ ID NO: 2005 - DNA, 604 bp, Homo sapiens
ctcccaattcctccgccttcttctcatgtgtttgctagtgtgcaatacctcacctgtttggaactcaacaacgtcccctcctgcaaaacgcacctcagaacgtcataaagccatcatgactttactctggaatagatacgatccagacacctcatcaacaaagaatcctcagtttctctgtgctgtggatgtaactgaatgaccgagccaagcagtccccacttagattcattcttcacttcagacattcaaaaatacagtaacaagctgggtgtggtagcccggaattcaaggctgcagtgagctatgattgagctactgcactcaagtctggacaacagagcaagtcgcatctcttgccatgggcaaaggcccctaccacaaaaacaataggatcactgctgggcaccagctcacgcacatcactgacaaccgggatggaaaaagaagtgccaactttcatacatccaactggaaagtgatctgatactggattcttaattaccttcaaaagcttctgggggccatcagctgctcgaacactgagcctgtgtaaaagttgaaccatgaggccacaaaagcgggtcaaggttctgggaattcg

SEQ ID NO: 2006 - DNA, 611 bp, Homo sapiens
caaaccaaactgggatggcaccaggcacaaataacactcttcttatcttttcccccatctaggttacccctttgctttgttttatcggcattaccttttctacaaggagacctacctcatccacctcttccatacctttacaggcctctcaattgcttattttaactttggtgagtaaactaaattagcagtgacaccgcaattagtgggaacctggaaggaacagacctgaaacaaaatttcccttgagagaatcctaatagggtaggggaagttataatgctccccacttgcaaagagggttgtatgaagaggaacacagcttaacttttcctttttttcttttatgtacattcttctgtcagataaaaacattttgagggtggttacccttgccatacctcatcaacaaagaatcctcagtttctctgtgctgtggatgtaactgaatgaccgagccaagcagtccccacttagattcattcttcacttcagacattcaaaaatacagtaacaagctgggtgtggtagcccggaattcaaggctgcagtgagctatgattgagctactgcactcaagtctggacaacagagcaagtcgcatctctaaa

SEQ ID NO: 2007 - DNA, 576 bp, Homo sapiens
  misc_feature (1)...(576): n = A,T,C or G
gcaagaacagtattcataggataaacaaatagcaaatgtacagccttggttccccaaactccacagtctcagtgcagaaagatcatcttccagcagtcagctcagaccagggtcaaaggatgtgacatcaacagtttctggtttcagaacaggttctactactgtcaaatgaccccccatacttcctcaaaggctgtggtaagttttgcacaggtgagggcagcagaaagggggtagttactgatggacaccatcttctctgtatactccacactgaccttgccatgggaaaggcccctaccacaaaaacaataggatcactgctgggcaccanctcacgcacatcactgacaaccgggatggaaaaagaagtgccaactttcatacatccaactggaaagtgatctgatactggattcttaattacctaaagtaaaaaagagagaaaagtcagccccagaaacattccagaaccagcttcaacttacaggtttcatactcacttcaaagctttgggggccatcagtgtcgacactgacttgtgtaaaantgaccatgagccacaaagcggncaag

SEQ ID NO: 2008 - DNA, 557 bp, Homo sapiens
ctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccggtgagctgctggtggggagcctggaccctggttccttccttccactgtcttcccagattggagggcaggggtgtaccatgtcacccctatgcgtctttcccatctgggcagaaccccctgtcgctcacactgactttgacccccacctataccccccccccaaaaaaaccattactgtcatatttgaaaaaaaggcaagatataaaagtgcgttaagacctgggtgttaaaaaaaaaaaaaaaaa

SEQ ID NO: 2009 - DNA, 990 bp, Homo sapiens
ggctgtgccaggtgcacatttagcacccgttgccttctctaggagccgctcctagcttgccttatcacatccacgtgacccctcagagcacagcagcttctgattctccatcctattttcttctcttgactgatacatttgggcacttctagggaattcagaaaccaagggaaggggggaagtgctggcttttgctcctgcccagctgaaaggcttgaaaacagttcagtaattctgggcaggtttctctccttaaattaaaatccaatatgggcccctctgtacttaacattccaaatgctcattccaaacactttgccaacgaaggcaaacagtagagaagttaaatacagtgctgcccttgaggctctccaagggaaaggcgaatgaatattctccaggccctctgcttattcctctctgcctattgtgaaggcaatcaggccagactattgagggcatctggcagcaggactcaggcaggtatgaagtagccagccacaagtgtgaaaaggaagagtgctgagagaaactgcctagtcatgtgatatccctaatgcactgtgctttcttccctcaagaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccggtgagctgctggtggggagcctggaccctggttccttccttccactgtcttcccagattggagggcaggggtgtaccatgtcacccctatgcgtctttcccatctgggcagaaccccctgtcgctcacactgactttgacccccacctatacccc

SEQ ID NO: 2010 - DNA, 628 bp, Homo sapiens
gtcatcaagagagccccactgagcaagctggccgcatactgtccccagccctactactatttgggcaacagacatccactggtcttcagggttctccatatgcctgttgtgccctccttcacgtgggacaaatggcttaaggtgtataaatccatctatttccttggccacatcttcttcctgagcctactattcatattgccttatattcacaaagcaatggtgccaaggaaagagaagttaaagaagatggaataatccatttccctggtggcctgtgcgggactggtgcagaaactactcgtctcccttttcacagcactcctttgccccagagcagagaatggaaaagccagggaggtggaagatcgatgcttccagctgtgcctttgctgccagccaagtcttcatttggggccaaaggggaaacttttttttggagaaggcgtcttgctttgtcacccacgctggaatgcagtggcgggatctcagctcaccgcaacctccacctcttgggaggttgaggcaggaggatcacttgagcctggaaggtggaggttgcagtgatccaagatccattgcactccagcctggatgacagggcaagacctgttactagaaaaaaaaa

SEQ ID NO: 2011 - DNA, 931 bp, Homo sapiens
  misc_feature (1)...(931): n = A,T,C or G
cggcacgagaatcagtcagcactgcctcctgtaccctctgggggctacacgtgggaacccaccagcactccaatccaatcctcagggtgaggacccagaggcaggtggcgggatgcaaggaccagtcagtttgagggtcgccccacccacccttttctccagctacatcttcaaacgactcaagttccttggaaataaagaactctctcagggtctctcgttgctattcctgggcctctggcacggcctgcactcaggatanctggtctgcttcccagatggaattcctcattgttattgtggaaagacaggtaggcctccagggtgggggtgaaggggaatataagggacaagatgctgatgagctcctcctccctccccaggctgccaggctcattcaagagagccccaccctgagcaagctggccgccattactgtcccccagcccttctactatttggtgcaacagaccatccactggctcttcatgggttactccatgactgccttctgcctcttcacgtgggacaaacggcttaaggcaagtgaaggcctgcttgtgagactgggagggactcactgcaacctcaaaggttgcaaaggacactccaggcctgtctaccttagtggcctctctctccacaggtgtataaatccgtctatttccttggccacatcttcttcctgagcctactattcatattgccttattttcacaaagcaatggtgccaaggaaagagaagttaaaggaggatggattaatccatttccctggtaagttaatacagctaacctaaaactaccaccaggttacagattggagcaacagactggaaaaaaacaatagtattagaaatctggggtgaattccaaggattagcctggctactaagggacacagtatgggcaatgactactgtgacttattg

SEQ ID NO: 2012 - DNA, 498 bp, Homo sapiens
tcaaaggggttatttttattatcttacctccactgggttttcagtcccaatggagattgtgagacctggcaagaccttgagatcagtagcatccctgaggggtaaacacaagactggtccactgtctgctgccctgactttcctacaactcttaagaggtttgcagtccccattcctcatagccagccatagaaatctttccctgaaacaggaaacactttgggcagcagagcttctcatcccattccaggtagacaaccacacccctaaacactcctctccataactgaaggtcagagggtgaagggaatagtctctgctctctgtgaccaggaacttcactcgttcctttccagctctgccaatggacttatgtcctccactgccctgtttatcaacagctttacttgtttgtccccaccactagagtgtgggcagcttgagtagagtgtctggttcaccactgatctcagcatcagcctcagtcactgctgctga

SEQ ID NO: 2013 - DNA, 424 bp, Homo sapiens
  misc_feature (1)...(424): n = A,T,C or G
aaaaaaaactgaaactttnttgaaaaaaaaatttgaaacccnatggaggcccaaaaaaaaagnggttanaaaaggtttctgggaaaattcggggtcctgggaaattcaacttcnaatcaagaacattccttnctgtgtaagggataataaaccttgtaagaaaagccaagctcggttcnaggggactatccatcaagcatcagcaaaactctggtgggtgatatctggccgcgcttccccagggtcccgtccattcttcaacaatatagacttgtgcttgtcacagttgagtagctcatatgtcttccctaccttgactgtctccagactggccccttccagcaccacaattactacggcctccgatcttgttntccccngtagtcggggccgcttgggtgnagagcatcccagtcctgtgcct

SEQ ID NO: 2014 - DNA, 415 bp, Homo sapiens
ttgcgttttttttttttttttttttttttttgcaagaacagtattcataggataaacaaatagcaaatgtacagccttggcttccccaaactccacagtctcagtgcagaaagatcatcttccagcagtcagctcagaccagggtcaaaggatgtgacatcaacagtttctggtttcagaacaggttctactactgtcaaatgaccccccatacttcctcaaaggctgtggtaagttttgcacaggtgagggcagcagaaagggggtagttactgatggacaccatcttctctgtatactccacactgacctaagaaaagaacagttttgtcagccaactctgtcactcagtagctgtttcagcccttctttagggcaggaaaactatggctgagctagtatttcagctgtgctg

SEQ ID NO: 2015 - DNA, 703 bp, Homo sapiens
  misc_feature (1)...(703): n = A,T,C or G
ttttttttttgcaagaacagtattcataggataaacaaatagcaaatgtacagccttggcttccccaaactccacagtctcagtgcagaaagatcatcttccagcagtcagctcagaccagggtcaaaggatgtgacatcaacagtttctggtttcagaacaggttctactactgtcaaatgaccccccatacttcctcaaaggctgtggtaagttttgcacaggtgagggcagcagaaagggggtagttactgatggacaccatcttctctgtatactccacactgaccttcaaaagcttctgggggccatcagctgctcgaacactgagcttgtgtaaaagttgaaccatgaggccacaaaagcggtcaaaggttctgggaattcgggtctggggattcacttcaatcagaacattcttctgtgtatggatataaacctgtagcaagccagctcggttcaggggactatccatcagcatcagcaaactctggtgggtgatatctggccgcgcttccccagggtcccgtccattcttcaaacatatagacttgtgcttgtcacagntgagtagctcatatgtcttccctaccttgactgtcttcagactggccccttncagcaccacaataagcctacnggctncgatcttgntttctgcccctagtcggggccgtttgggtggcagagcatcccaatcctg

SEQ ID NO: 2016 - DNA, 489 bp, Homo sapiens
  misc_feature (1)...(489): n = A,T,C or G
gnnaaccgntggagagngnttngatnnnggaattgtnaagtaaccgtccnaaaacggnngggggcaatcagctgnncggnacactgagngtgtganggaagntgnacgatgagcccccanaagcgntcaaaggntctgggaagtngggtctggggattcacttcaatcagaacattcttctgtgtatggatatnaacctgtagcaagccanctcggntcnggggactatccatcagcatcancaaactctggtgggtgatatctggccgcgcttccccagggtcccgtccattcttcgacaatatagacttgtgcttgtcacaggtgagtagctcatatgtcttccctaccntgnctgtctccagactggccccttccatcaccacnataagccnncggcctccgatcttgtttcctggcntcgtgccgangnangntctggcacatcataagggtaggagcatcnccacccanctaaaccncagnaan

SEQ ID NO: 2017 - DNA, 366 bp, Homo sapiens
gtatagaaattagcagacctaatttctaacccctctcccagcacttagcagtatgacttcaggtaggtggcttatcacaggcccaagtgttccatccacagattgtaatggtaactctttgcctgcctcaaggaagggccaccagctaaccctttgcatactgtgccattaggctctttggtttaacccactatccaggagcagagtcacttcaaggcaagacagaaaagcaacttagaatgagttaaagaacctaagcctaggccaggcaaagtgctgggattacagacgtggagccaccatgccctggcaggaaaacacacttttgaatgttgtgtgacctggagaatggtaacactgttaatt

SEQ ID NO: 2018 - DNA, 1035 bp, Homo sapiens
gtggtgcggagggaggccttgcgggcggttcgtctcttggcagcggaggtggtgggaggcttttttcgggagcgcgggtcacgccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttatcgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacacgggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggtacagtaatggactgcattcctgagcagactcatgagcttgcattatcttgctgtgtgtaggtcccttatatatgtgttttccatggatgccttttgagttgttcagctttagccactgtacatttttttgctctctccacagtctgtctaattaaga

SEQ ID NO: 2019 - DNA, 555 bp, Homo sapiens
cggcacgagggtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgaaatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacgac

SEQ ID NO: 2020 - DNA, 1157 bp, Homo sapiens
cacttgctctttcctcttaagaaagtgctccattccttccggcgcccagagcttgctggcccaaaggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggataggctgaccaaggagctgtcaatggctgcaaggtctcatctggatgaagagagaaagcacgagaaacggaagtacctccaggagaagaccagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaaaaaaaaaaaaaa

SEQ ID NO: 2021 - DNA, 404 bp, Homo sapiens
atgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagaaatcttgggcaattctgtaagaagagaattgaagtaactgagaggaattttagggcacaggtttgctgaagactgtgctgaaaccacctttacagggaaatgatcttttaatttatttccacatctttctctattaaaaaaaaatcaatg

SEQ ID NO: 2022 - DNA, 3426 bp, Homo sapiens
ctaaagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcaccaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggcttctaggaatggaggagcccaggccccacccccttccctataggaacagcccagcacaggtatttcaggtgtgaaagaatcagtaggaccaggccaccgctaagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggccccccaccccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctcggggccaggccccatggagggtatactgaggggtctataggtttgtgattaaaataataaaagctaggcgtgtttgatgcgcttttaactttggcaaaaaaaaaaaaaaaaaaaaaaaaaaaaaa

SEQ ID NO: 2023 - DNA, 2418 bp, Homo sapiens
ccacctccctctcatggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggaacccggaacaattccttcacagaacaattgaggcgaggcctttgggagtactttgtggaacgaaccccggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggtgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcctgtcgggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccagccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctgctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaaaaaaaaaaaaaaaaaaaaaaaaaaaaa

SEQ ID NO: 2024 - DNA, 2699 bp, Homo sapiens
acaggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggtttgaaaagaggagatggtggtgggggaagagggggagagcttcctgcaggtggaggcagagagagagcaggccagggtttcccttcctggcatacttgggggatccctgggcttcccagatcacacgatgatgatagtgataatgataaataataatcataatattaacaaggataataatattgctaatgtacatagcatttatcttgtgctctgtactgtgacaagagctttatatccactaacttattcaatcctcagaattctatgagataggggccattattttatttatttatttatttatttatttttgagatggagtttcgctcgttgcccaggctggagtgcaatggcgcaatctctggcttcaccgcaacttccgcctccccgggttcaagcaattctcctgtttcagcctcctgagtagctaggattataggcatgcaccaccacacccagctaatttttgtatttttagtagagatggggtttctccatgttggtcaagctggtctcgaactcctgacctcaggtgatccacctgcctcggcctcccaaagtgattacaggcgtgagccaccgcgcccagcctaggggccattattatatacccactttacagtttgcgactctgaagcttcagagatgttaagcaccttgcctaaagttttggaactagtgagtagcagaagctgaattccaacccagggaacctacccttttcaacctttatactcctctgcctctgagggactctgaaccctacttatcctgcacccaacccctattttttacaggaactagaactgcaggcccagatccatggcctgccagtacctcccactccagggctgctttccttggccacgacttcaacttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtccctgctgtctccaaggccagcagccgccgcagcagcttcagcatggaagaggagtcctgatcaggcctcacccctcccctggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggcttctaggaatggaggagcccaggccccacccccttccctataggaacagcccagcacaggtatttcaggtgtgaaagaatcagtaggaccaggccaccgctaagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccatacctatatctggagtgagaggccccccaccccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcat

SEQ ID NO: 2025 - DNA, 1205 bp, Homo sapiens
  misc_feature (1)...(1205): n = A,T,C or G
ctctcctgccatctctgtggttggcgtctctgctgggggccacacattgagccgtccaccccctgctcagatgcccagggaggtgctcaaggtaaggtgagatccagaggccctgggagggggctcctggtgactgaggagtgatcctaggagctagggatggcctcgatgcactggtgatttgggggcaaggtcttaggggctctaaggaaggtccctggtactgtttaaattatctgtgttcatgtctcatgtgttttgggtttctgagatgatcttgtgaaattgcgaggagttcgtgggggccatgaggatgtcttggtggaccatggaggctcatgagtgccccaagtgggccctggctttgtaggaagagcttcatgtgtgtgggatacattagttctttggccattagggggtcttgggaagcattgtatggttcccaggtctattaggtggtgtcagagactagtggggaatcttggggactgtgacagggttttccagaaactacgagggatcctgtcagtcatgggtggatcttggcagctgtgaaggatttctgagaaagagagtttgggtcctgggggagactcgctaatatttnttggggtgttctcagattctgggcccagcttgtctgcgtgagtctaggcaccaatgagttaggagggtcaggctggggctcagaattcacccctttgagtcctgttctgccttgtcccctctctttccttgtntaccttatttcacaggtgcagacccatctggagaacccaacgcgctaccacctgcagcaggcgcgccggcagcaggtgaaacagtacctgtccaccacactcgggcccaagctggcttcccaggccctcaccccatcgccggggcccgcaagtgcccagccactgcttgcccctgaggctgcccacactaccggccccacaggcagtgcgcccaacagccccatggcgctgctcaccatcgggtccagctcagagaaggaggtaagaggctacagccaaacctcctcccacattcccctcccaaattcttctaaacctgtataatatttacttcttcccctagattgatgatgtcattgatgagatcatcagcctggagtccagttacaatgatgaaatgctcagctatctgcccggaggcaccacaggactgcagctccccagcacggtgattgtaactcttgg

SEQ ID NO: 2026 - DNA, 699 bp, Homo sapiens
gatcggggtctgccggcacgggaccggtgctcccggcttcacaacaagccgacattcagccagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaaaaaaaaaaaaaaaaaaaaa

SEQ ID NO: 2027 - DNA, 1112 bp, Homo sapiens
ccagctgcctgtgtcagggaatctgcttgatgtgtacagtagtcaaggcgtggccacaccagccatcactgtcagcaactcctgcccagctgagctgcccaacatcaaacgggagatctctggtaggtgatagggtcttggccccatggccctacactttaccccaggtgagccctgtgcctaccaggtctagagatgggcctgattctgaggggaatggtttggacatatggaaatggaggctgtttgtcccctttccccctatggcttgtggtcttgctttcaccccacttcagttcctctcgtcttggatttaacaaccagcctatcaccatggcttaaaatagtaaaaagaaggcactttttaaaaaaggcatttcccctgcttttggctaccaaaccctaccttagtatctgcatgtgtttcttgccttcctgtgctcagaggccctgatcactccactcttttccagaaaccgaggcaaaggcccttttgaaggaacggcagaagaaagacaatcacaacctaagtaagccaaagagcgtgtgcattgcccgggtgctgtgcaggcctgcctcaccccgagtcctggccccccatggggaactccttccctgcaacagcctcccaactccctactttctgtctcttccatttttggctaattgacaactctttctcccactctttcttcctctcctcccctctccaaagttgagcgtcgcaggcgattcaacattaacgacaggatcaaggaactgggcactctcatccctaagtccagtgacccgtgagtctgggctgggaccctcaggccagcgggagtggggcaggcgtcccatgctactaaaattgtgccttggtgggctcaccaggcagtctcggcccaggcatttctcctctgtctggttctttctcagcctgagcatggtgcagacctcactatgtcagcactataatttaggcacataatgttatggtctgtgtgcccatctggtcccgtaggatatatgcactactttctgtcacttagtactcagcttttttttttcttttttttgagatggaaactgggccccagagcgagactccatcccccaccgaaccgcaa

SEQ ID NO: 2028 - DNA, 938 bp, Homo sapiens
  misc_feature (1)...(938): n = A,T,C or G
caaactgcagacggatcacactgtagtaagggaccaggcctgggcaaggtgaacaggcagaaggctacactctgattccaccctgcccgcccccaccccaggtcatgtgagtgacgtggaggtgcaggagcactttgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggcatcaacttgcttttgctgtggtttggcatttccctccacccacacatgtgacgaaaaggggaaacaagactgggtcctggccacaacttcagctgaggaacttggcacggccagcttgggacccaggaccctaacgtgtagcagaggcgctgtgtttggaagtcccgctatccacggccccccagatggggcctggacgatgcctctgacggccttgttgcttctggccctggcgccaccgccggaagcctcccagtactgcggccgccttgaatactggaacccagacaacaagtgctgcagcagctgcctgnaacgtttcgggccgnccccctgcccggaactgtccagtctggcgt

SEQ ID NO: 2029 - DNA, 450 bp, Homo sapiens
ctagcaggagtcacctgcggccttagccttagcccaagtgacagcactgagaatggcaaagacaatattcaaggcaagtatggtatcccctctcaccagcagcgtataatgtagccgtcacccagcaggaggaagctcgcactatgtttgtaaaagcatacagacaccgtcctccgtgcatctgatgttgcgactgctaggtggcattagtatgcagtcccccccaccgtttgtccaccaaccagtttttcacaagaagatctccccccagttcaaaggtagcaatagacactccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaaaaa

SEQ ID NO: 2030 - DNA, 805 bp, Homo sapiens
gcttgggtaaaaatggctgaatatttagcttcgatattcgggactgagaaggacaaatcggggtctgccggcacagggaccggtgctcccggcttcacaacaagccgacattcagccagccgctgccacatgagctcaggccccgccccttttaaatcgtgtgcagaccatagtgctgctcaacctgtaccggaatccacagaacacagcccaaactgcagacggatacactgaggtgttcacagaactgcaggagaagtatggggagattgaagagatgaatgtgtgcgacaaccttggggaccacctcgtgggcaacgtctatgtcaagttccgtgaggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactgcatggccgcttctgagccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaaaaaaaaaaaaaaaaaaaaaaaaaaa

SEQ ID NO: 2031 - DNA, 652 bp, Homo sapiens
cttcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccagagatggggtttcaccacgttggccagcctggtctcgaactccggacctcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcgagaccttcttctaccgcccctgttttaataaagctgggtgtttcccttcggcatcaaaaaaaaaaaaaaaaaaaaaaaaaaaaa

SEQ ID NO: 2032 - DNA, 517 bp, Homo sapiens
  misc_feature (1)...(517): n = A,T,C or G
agaaaggggtgctgggatganggccactccgaggtcacatttgacatggagatcttggcatcatctccaccatttacaaatttcaggggatgtctgacttccagtacttggctgtcatacggaagcaggcggcaagatacgttaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggccttgagcagagcccggcgcccccacaatgccatcttttgtcaattttgagggatgagggagggtgcccaaggagccattgggagggtttaaggcccaagaagttggnagggagagtttttgcatttaaccccttgggaccggaagttgggagggaggagtttnagggaagtnttttttnaaattcct

SEQ ID NO: 2033 - DNA, 335 bp, Homo sapiens
gcatctggtcctgaggggttagggacatcccctaagggtataccctggctttgccacccatgaaccagctcagcatacagccagtgagtgggcacccaatgcctctcaggatgagaccagtaaatgtcgcaggtgaagttggccagctgtggagccacaggccacaggccagtctagcttggcttccccctccattcccacccctcatacctacacccaaggttgtcagctttggattgctggggccaggccccatggagggtatactgaggggtctataggtttgtgattaaaataataaaagctaggcgtgtttgatgcgctttaaactttgg

SEQ ID NO: 2034 - DNA, 496 bp, Homo sapiens
gtggcaaacgtctatgtcaagttccggagggaggaggatggagagcgggccctggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgagccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaaaaaaaaaaaaaaaaaaaaaaaaaaa

SEQ ID NO: 2035 - DNA, 413 bp, Homo sapiens
gacaccatgtccctcatgatccggcagaccatcccgctcccaagaggcctgctctcttttcccagcccacccaaggctgatggcggaaaagagcagctgacgtacgagtctggggaagacgaggaggatgaggaggaggagaaataggaggaggaggacttcaagccatccgacggcagtgaaaacgaaatggagacagagattctggactacgtgtgacagggcccaaggctgggcctccctgaactccgcagactggtgtctggcctaatgagggagcctcgcccatggtctcacgtggcaagaagtgcctttagctctggatcccaaccgtttggcacagctttggccacagccaggcccctctggaattgtccttattaaaccagtttcccgaaaaaaaaaaaaaaaaa

SEQ ID NO: 2036 - DNA, 505 bp, Homo sapiens
cagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatc

SEQ ID NO: 2037 - DNA, 511 bp, Homo sapiens
ggctcaagtgatcctcctgtcttggcctcccaaagtgttgggattacaggcatgagccaccacacccagcccctgctttacttctaatgacggttctaattctccacaataaccctatgagacaggtgctatcattgtcttattttagggatggaaaagggagggtgggtgggtgaggacacggcagaggtgggatatgcattcttgcaatctagatccgcagccctgttagtcccctagtggccttgtgggcttctctgataaccggctcagttgggggatgagggctcgggggtagattcccggcttccgaagaggcgtgagaattctgttcccccacatcaccgcgtcctttcttctgcccgatttccccggaaagtgtagcagaggcgctgtgtttggaagtcccgctatcacggccccccagatggggcctggacgatgcctcctgacggccttgttgcttctggccctggcgccaccgccggaagcctcccagtactgcggccgc

SEQ ID NO: 2038 - DNA, 540 bp, Homo sapiens
ggcccagaatgaaacatgagcctcctggcctttcctggatcaccggcaggcttttattgagagaggagcagctccccactggctgcttggcttgtcattgcttcactctgtctcctttggccttgccacagatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcagggtaactgaaatctgctcttgcaatgtctggttatttcagggctggccatcctagctgcctgcaggagctgtgtgggtcatctgcaccagtggagggggccaggatatgcccaggggctgtggggacacagcagggcacaggccccatccaggaggcagcctttctttccttcagccaacagttccccag

SEQ ID NO: 2039 - DNA, 470 bp, Homo sapiens
  misc_feature (1)...(470): n = A,T,C or G
taaccgctggttcaacggcaaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttntgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcaaaaaaaaaaaa

SEQ ID NO: 2040 - DNA, 556 bp, Homo sapiens
cgggactgagaaggacaaatcggggtctgccggcacggggaccggtgctcccggcttcacaacaagccgacattcagccagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggaaagcgggccgtggctgaactcagtaaccgctggttcaacgggcaggctgtcacgggaatgtcccgaggtgctttgaacttatgcatctggggccatttccaaaactcagag

SEQ ID NO: 2041 - DNA, 626 bp, Homo sapiens
  misc_feature (1)...(626): n = A,T,C or G
cggcgctcgtagaggcggtgccctatagaaagccgtggctccaatctgcgcagagacagttcttactgttatgtccttgctcctcttccactgtccacataaaggccccatgaggtggttctcaatcccaggacccatcagatcccagaaaccttttatcgacttgttctcagtgatgtttaaagaattgcagggaaagggcactcactgggatgagaggagatgggaacacatcaaatacatcttgaactctgctgaaagccatggttcaccagaagcatgtgcagtggtaacacggccagcttcatgtgtgtgaggcggtccagggagcacacaggtttagggccccagctgggaacacacagcttgtgtttccagttcctctctgtagacttcgctcacggggctgcctttgatctcagtacagctctgcctctggaaaaaccaacactggcatctcttagcagagacccgncctgggactttatgtcccaaccctctccccacccccaggttgcagaagatcattcaccgcaatgacggggcagagaattcctgcacagaacgggatgggtngtgcctncccaagaccagcgacgagcttagggacaccatgtcccttcatg

SEQ ID NO: 2042 - DNA, 409 bp, Homo sapiens
cgctggttcaacgggcaggctgtgcacggtaatgtacccgaggtggcttctgcaacttcatgcatctgcggcccatttcacagaaccccgagaggaatctctatgggcggggacccaggcgcaggtcacccccgaggttccatactggccaccatccccgagagaggaccaactgtgttcccctgatcaattgcatggccgcttctgagcgctggcccccttacccttcacccctaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaaaaaaaaaa

SEQ ID NO: 2043 - DNA, 440 bp, Homo sapiens; identical to SEQ ID NO: 1184

SEQ ID NO: 2044 - DNA, 402 bp, Homo sapiens
  misc_feature (1)...(402): n = A,T,C or G
cctatagtgagtcgtatgnnaanngttcatcactaaatccagtntangnncagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggncaccatccccgagagaggaaccatcgggtnttcccctgatcactgggcatggncgcttctgaagggcctgggccnccttanccttc

SEQ ID NO: 2045 - DNA, 476 bp, Homo sapiens
  misc_feature (1)...(476): n = A,T,C or G
atcaggccccacccctgtaatcaggcaaggaggaggagtcagatgaggccctgcaccttccccaaaggaaccgcccagtgcagggcaagaggatgaaggaaggggctatcctgggacctccccagcccaggaaaaactggaagccttccccccagcaaggcagaagcttggaggagggttgtaaaagcatattgtaccccctcatttgtttatctgatttttttagtngtccgcatactgagaatctaggccaccccaacctctgttccccacccagttcttcatttggaggaatcaccccatttcagagttatcaagagacactcccccctccattcccacccctcatacctacacccaaggttgtcagctttggattttctggccaggccccatggagggtatactgaggggtctataggtttgtgattaaaataataaaagctaggcgtgtttgatgcgcttttaactttggc

SEQ ID NO: 2046 - DNA, 466 bp, Homo sapiens
  misc_feature (1)...(466): n = A,T,C or G
gagctgtctcctgtcactgactccgggagtcatgctgtcgccagtatgagatgggggaatgtacccgaggtggcttctgcaacttcatgcatctgcggcccatttcccagaacctccagaggcagctctatgggcggggacccaggcgcaaagatggggtttcaccacgttggccagcctggtctcgaactccggacctcaggtcacccccgaggttccatactggccaccatccccgagagaggaaccatcggtgttcccctgatcactggcatggccgcttntgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttc

SEQ ID NO: 2047 - DNA, 376 bp, Homo sapiens
  misc_feature (1)...(376): n = A,T,C or G
gagaaggacaaatcggggtctgccggcacgggaccggtgctcccggcttcacaacaagccgacattcagccaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccncaaccttcatgcctcactctctgttcatgcagccctggcntctgagcttnaggccccgcccctttttaaaattgctgtggaagancatagtg

SEQ ID NO: 2048 - DNA, 413 bp, Homo sapiens
ggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttgggggaccacctcgtgggcaacgtctatgtcaagtttcggagggaggaggatggagaacgggccgtggcttaactcagtaaccgttggttcaacgggaaggctttgcacgggtgagctgtcttccgttaactgacttccgggagtcatgctgtcgcagtattagatgggggaatgtaccccagggtagttctgcaacttcaa

SEQ ID NO: 2049 - DNA, 316 bp, Homo sapiens
atggctgaatatttagcttcgatattcgggactgagaaggacaaatcggggtctgccggcacggggaccggtgctcccggcttcacaacaagccgacattcagccagaccatagtgctgctcaacctgtaccggaatccacagaacacagcccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcaaaa

SEQ ID NO: 2050 - DNA, 330 bp, Homo sapiens
gcgccatattccagggttccatgagtccctccccaccgcccggcgtttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttcacccccaaccttcatgcctcactctctgttcatgcagccctgccctctgagct

SEQ ID NO: 2051 - DNA, 244 bp, Homo sapiens
  misc_feature (1)...(244): n = A,T,C or G
ntggcatgccgcttttgaggccctggccccccnttacccttcacccccaacagggacaaatgttcctggcaggacctttcctcaaagcccccttcactttcctgccccatccttcccaggctcccgggctccataatgtaatttgttcagcatggagacctttttttaccgcccctgttttaataaaactgggtgtttcccttcggcatcaaaaaaaaaaaaaaaaaaaaaaaaaaaaaaaaaa

SEQ ID NO: 2052 - DNA, 231 bp, Homo sapiens
aggaaccatcggtgttcccctgatcactggcatggccgcttttgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcgg

SEQ ID NO: 2053 - DNA, 200 bp, Homo sapiens
ctgtcttggcctcccaaagtgttgggattacaggcatgagccaccaccacccagcccctgctttacttctaatgacggttctaattctccacaataaccctatgagacagcagaggcgctgtgtttggaagtcccgctatcacggccccccagatggggcctggacgatgcctcctgacggccttgttgcttctggccct

SEQ ID NO: 2054 - DNA, 199 bp, Homo sapiens
  misc_feature (1)...(199): n = A,T,C or G
ttagcttcgatattcgggactgagaaggacaaggttaactgctctttttactttaagatnggggtcttccggcacgggggaccggtgctcccggcttcacaacaagccgacattcagccaggtgagacccggcacgnagcctcgggggttaacggctccctggnccttccccttctggggccgtcgtcaccatgtcccg

SEQ ID NO: 2055 - DNA, 568 bp, Homo sapiens
  misc_feature (1)...(568): n = A,T,C or G
ggnctatcggggggtgaaacctggtgtcccngatgccaaangggccagcaaccttggggaccngaaccctccagtagctgcagctgctgcagctatntctggtggttttggtttttcaaaccattccctttncctcgctgttctggnaatttcttngccctttccaaccttctagctaaagcttcctgtgcatccattgctgtgtttctgcctctgaagggaggtggacttggagtccggcttaaacntcngnggaaaaannttnccgggcctttncaaattccccctcctttggttttgctataacgaggcagactggaaaagtcttaagtggttaaacttctaaaggttttaaagtttatttcaaaccagtttttcaaacataacattactattaatttaaaaaaaacattaaaacccttaactgatttaagatatatttaagggaaataggagttgaatgactaatagttaccttatcatgaagtaggcttattattttgctatctgagtctgcagcgtcttcagttcagtcctctctcgtgcataagcacgctgagtatgattt

SEQ ID NO: 2056 - DNA, 2099 bp, Homo sapiens
ttttttttttttttttttttttttttgttataaggcactttattaaaataaaagtgcttacatccctttaatgcattaatctatctcctgaataacacatgtaatatttgacaaatactgaataccaagtctgtcccttataataggaaaacatactattttaataagttttctccttccaccttttacatttttgctcaccacggtattgactgtagtatagttaactggccttaaaaagggtggtggggaggggatttctagctagtgttttctaacagcaattgccaaatgctacagaaactataaaacaaattcaaagaaacatcccaggtaacttaaattaacaccagttttgagaaaaccatttttattatcattaccacccagcttatctgtgctggattatgtaccaaatggccagatcttctaaagaacatctacataacatttctttcatgtttcaagagatgaaaataactgtacaaggttaagtacaaaagtacacaagacagcggacacgaaaaaatccatgtatgagattttatccccacctgcagcttttatatatttgaaaagtagaattcatgaactaaaaaatattatccttctatagtcctgtcaagtttaatggaagtgggtttaacctgattacaacactaacaccagtatcactgatctgatatttacaaaaatttgtatttttcaataaattaaagtcaatgcaacacccatgcaagctagagtgctagctgtttggtgaacaaggacgtgacatcagaacaagaagtctataagtcccaaactttacaagtgtgatcattttcaaactgcatccattcctcgcattgaagatgtgaaacccaaacccattcctctttgtgtgtgggtttgtgatcttgccatttcatactgagcatctaaatttcgaaatacttcttcctgctgcttcagagtcttgtaactttcttcatcaactgagctacatccagcttcatcttcactcttaatacccatcaatttcctaaatttgacattttggtccttgtttccaaaattcaatttttcccatatttcagcagattgggatttgtccccttctttcttgccctgccaaagcattttcctttttttctcttgttcagcaaatttcattggattaacagcggctgggttatagtagctaggaacagctattcctgtctctgccaaagctttagcttgcagggctgccatctgagctgccatggctatctgaggtgttacttgtgttcctgatgccaacagggcagcaacattgagaacagaacctccagtagctgcagctgctgcagctatttcttgttgtttttgtttttcaaccatttccttttctcgctgttcttgtaatttctttgccctttccaaccttctagctaaagcttcctgtgcatccattgctgtgtttctgcctctgaagggaggtggacttggagtccggcttaaacttctgctaaatcttctcggcttttcaattctcttctttctatctcgactcctactccttgtcctactcctgcttctagtcctatgcctgtgtcttgatcttgagcgggaacgagacctgatccgccgttttctttccctgcttctggatctcgatttcttcctctctctgcttctggatctcgatttcttccgctccctactcctggatcgagacttcttccgctccctgcttctactacgatggcgtctttcacgagacctagatcttgagtgacttctgcctcttgatgactttctttctttgcgtttgtgcctgtcctcaccattttccagatgaatttagtcgctctcttcctttatcagaagaatgttctttgtcattatgttcctcagacttatgtttcttagaggatttatctttggattcatgtcttcttccctgttcttggaggaggctggttctttcaggaaaatagtgcaacaaagagagttagtatgggtatcagtagacaaaaatgttgtgatgcaacattagtaaccttaggagtgtgtggcaaataaaaaaaagatctagtttcacatcacccaaatgttgcagatgtaattactat

SEQ ID NO: 2057 - DNA, 409 bp, Homo sapiens
agcagacaaaaccccgtctctctctctctctccaagtgtgtgtgtagggaggacagtgggtaggggagatggaaatgtttcagaatgggattgcttgttatttcacaaaaggtggtgggaaagaactcaaaaacgctgacacctgagtaaagaccagaactaagaaaatgagggaagaacagtgcaggagggctaatagctaatacaaagatcccctggcacatgtgaaactcaccttaatacccatcaatttcctaaatttgacattttggtccttgtttccaaaattcaatttttcccatatttcagcagattgggatttgtcctgttaacaaacactgaactttaaaatatgtaaaatttaaatattttttaggacatgaaatctctcaacaatgtctaaattaaa

SEQ ID NO: 2058 - DNA, 330 bp, Homo sapiens
  misc_feature (1)...(330): n = A,T,C or G
ctcccaaaaggcccatagcatgtntctttccactcacgattaatgtttcttaaaaataaaaccttggccaatcattttggaacatgcatgatgatttatctgaaaatgatcatagtacataatttattatttgcagaaaaataagagacctggagacacaattaaattttagtttcattgccagttctctataggagctttagaaaagaaattttccttggttttgctataacgaggcagactggaaaagtcttaagtggttaaacttctaaaggttttaaagtttatttcaaaccagtttttcaaacataacattactattaatttaaa

SEQ ID NO: 2059 - DNA, 402 bp, Homo sapiens
  misc_feature (1)...(402): n = A,T,C or G
ctcttgttcagcaaatttcattggattaacagcggctgggttatagtagctaggaacagctattcctgtctctgccaaagctttagttgcagggctgccatctgagctgccatggctatctgaggtgttacttgtgttcctgatgccaacagggcagcaacattgagaacagaacctccagtagctgcagctgcntaatnttcttgttgtttttgtttttcaaccatttccttttctcgctgttcttgtaatttctttgccctttccaacctggcaaaattaatttcaatgaatttaaaataacacaatataaaaccattatgtatatatctctctatatgtggcatgtacagagacaagccaacttccataaattttaaattttnggctccctccaccgag

SEQ ID NO: 2060 - DNA, 388 bp, Homo sapiens
taaaccttttaaatttcaagttttgtacttaccttgacaacgtcttatattcatacaaatctttctaccagacactttataagtattttaaagtacctattcactacaaagtgttaattacctctttgcttctgctccggctcctgtgttttcttccttcattatctgactttcgttttctttctcttgaccttgatcgtgatcttgaataatgatgttttgaagctctaggagaaacagatacttctgactgctcttttttcttatctctatctggtgatgtcttttctggggctagtccatctcgctctgtatcactagccgccatagttcagagtgccccgctagagcggcgcctccacttgtcgctttcaacagtaccggccgc

SEQ ID NO: 2061 - DNA, 1039 bp, Homo sapiens
tttattttttttttttttttttttttttttgttgtttttgtttttcaaccatttccttttctcgctgttcttgtaatttctttgccctttccaacacttttgctgctgttcagctgcagtttctgtcaggctgggttcccagggaagcacatcaggttacactgtgttaccagcctgggcaacatagggagaccccgtcttctcttctagctaaagcttcctgtgcatccattgctgtgtttctgcctctgaagggaggtggacttggagtccggcttaaacttctgctaaatcttctcggcttttcaattctcttctttctatctcgactcctactccttgtcctactcctgcttctagtccgatgcctgtggcttgatcttgagcgggaacgagacctgatccgccgttttctttccctgcttctggatctcgatttcttcctctctgcttctggatctcgatttcttccgctccctactcctggatcgagacttcttccgctccctgcttctactacgatggcgtctttcacgagacctagatcttgagtgacttctgcctcttgatgactttctttctttgcgtttgtgcctgtcctcaccattttcagatgaatttagtcgctctcttcctttatcagaagaatgttctttgtcattatgttcctcagacttatgtttcttagaggatttatctttggattcatgtcttcttccctctttgcttctgctccggctcctgtgttttcttccttcattatctgactttcgttttctttctcttgaccttgatcgtgatcttgaataatgatgttttgaagctctaggagaaacagatacttctgactgctcttttttcttatctctatctggtgatgtcttttctggggctagtccatctcgctctgtatcactagccgccatagttcagagtccccggccgctagagcggcgcctccacttgtcgctttcaacagtaccggccgctccgaagcttcgcctcagactaaatcgctcgcgcgagagacccggatggc

SEQ ID NO: 2062 - DNA, 554 bp, Homo sapiens
tttcatttttttagctaaatataattattactaaggactaatattttctataatttcaaattattttacacagagatgcagggtcccttttacagttatactgcctgctacatcctctaaaagacagctcttgattttcctcccaatgtctaaactgtgaagcaatcacttttcatcttgcagtatcccaataggcttagaggagtattacacttcatgtacgattaatgtttcttaaaaataaaacttggccaatcattttggaacatgcatgatgatttatcttatcatgaagtaggcttattattttgctatctgagtctgcagcgtcttcagttcagtctcttcgcgcataagcacgctctttgcttctgctccggctcctgtgttttcttccttcattatctgactttcgttttctttctcttgaccttgatcgtgatcttgaataatgatgttttgaagctctaggagaaacagatacttctgactgctcttttttcttatctctatctggtgatgtcttttctggggctagtccatctcgctctgta

SEQ ID NO: 2063 - DNA, 435 bp, Homo sapiens
  misc_feature (1)...(435): n = A,T,C or G
aatttagtcgctctcttcctttatcaggaagaatgttctttgtcattatgttcctcagacttatgtttcttaagaggatttatctttggattcatgtcttcttcccttatcatgaagtaggcttattattttgctatctgagtctgcagcgtcttcagttcagtctcttcgcgcataagcacgctctttgcttctgctccggctcctgtgttttcttccttcattatctgactttcgttttctttctcttgaccttgatcgtgatcttgaataatgatgttttgaagctctaggagaaacagatacttctgactgctcttttttcttatctctatctggtgatgtcttttctggggctagtccatctcgctctgtatcactagccgccatacgttcangacgtgcncnctcgctagagcggcgcctccacttgtc

SEQ ID NO: 2064 - DNA, 277 bp, Homo sapiens; identical to SEQ ID NO: 1180

SEQ ID NO: 2065 - DNA, 491 bp, Homo sapiens
  misc_feature (1)...(491): n = A,T,C or G
tggccagggtgctaagcagttgtttttttttttttttttaaaaagaaaggccttacatatttattactgaatccagccaaccaacgtgttcataacagattcagagaggaaaacacgtcgaaatctccagatagtggtgacattttcagcttgatatggtaacatgatcgtgaccttcagacagcataaatatgtgtgccatctcatgtgcaattccttatagacccagcttggttcttctccaatgtctccttttggagttgtacctgattttatttccagttttcatccgaatccactggggaatgggacgattttgcttttgtttcttggccaggaatcgcttaatcctgaaagtcttgtgagaagacatggcgagcagcggagtcaagaacacaccacgatggcgggcggtcgaattttggatcgagggcaaattcctatagtgagcgtattaaatcgtaacatgtcatantgttccngtggaaatg

SEQ ID NO: 2066 - DNA, 557 bp, Homo sapiens
ccccacaccagaacagctgggcaaagtaaaaaattaccttcctgtgttcttgccaccagaaacaagtgttagccggtctggtgttatttccttcctgccttttctgaggcagtgttcctctcctcaactacttcaggggaacttcctccatttatagttatgattggcctggaactgcattgttgaggaaggcagatgcgaagataacaaaagagcgcctgactatctctttatcgaatcctgaggtgagcgtctttgtaacttggctatggaacctgtgcacctcttagcatcacagattgcactatgacacagcctgaacatcgtgaattctggattcactgcatgggtcactgacacacccaacacaccagggccgacagctgggcaatgtatcaaaggaagagatgagctggtctctgaatgtgtcttaaacatgttcaggttttagcatcctcaaactgacacaagcagatacctctgcatactttaatacaaagagttagcatacactgaatacccaaccgagtcccgggcactatggaggcactttacac

SEQ ID NO: 2067 - DNA, 521 bp, Homo sapiens
  misc_feature (1)...(521): n = A,T,C or G
ctgatctgaaagatgtccgtccaggttggctccacgaaaaacatccaacatcagcctgaggaggccgggcaaaagtagagaaaaaaaacagaggcagctgctacaacccggaaagcctgaatctaatgcagtcactannacagccggccaattgcaagtgcacaganacaacctgcgggaaagtccagatagtctccaaaaaagtgagctacagccatanttcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagagggcatcccagctaggccttgggatggctgcagtgaggagaaatcccgggaactgtattgacacaaagattcttattgcacttgtattttttgtattaaagtttgcatggtttctaataaaggattcaaacat

SEQ ID NO: 2068 - DNA, 753 bp, Homo sapiens
gccacaatggcacctcacctgtcatgaggtggtgtcaaagggaggcacagacttggacatcaagatccagaagtctagcatctaatgatgacattctggtctcgtcttccgtctccccagtgttcccctcttgtctcccctgttcgcctctcccttccctcctcccatgtcactgcagattgagacatacaggctgacgttctgggcaaatgccagggcccgcaccgaccacggggccgacattgtcttccgcccaccacacttccctggcggccccaactcgggctcccgggtccttggccccctttcccgggctgtccactagaccagtgagcgcttgggcgccgtgctgggcagcccgttaggcttcgctttccttcttgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctcccagctaggccttgggatggctgcagtgaggagaaatcccgggaactgtattgacacaaagattcttattgcacttgtattttttgtattaaagtttgcatggtttctaataaaggattcaaacataaa

SEQ ID NO: 2069 - DNA, 356 bp, Homo sapiens
  misc_feature (1)...(356): n = A,T,C or G
cagacacctaaaattgtggcagataaagattattctgtgaccgccaattcttaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactagatttcgctaccttatggctgaaaaacttggcattcatcccagcagctgccatggatggattttnggggcacatggcgactcaagtgtggctgtgtggagtggtgtgaatttggcaggtgt

SEQ ID NO: 2070 - DNA, 484 bp, Homo sapiens
agcagctgccatggatggattttgggggaacatggcgactcaagtgtggctgtgtggagtggtgtgaatgtggcaggtgtttctctccaggaattgaatccagaaatgggaactgccaatgatagtgaaaattggaaggaagtgcataagatggtggttgaaagtgcctatgaagtcatcaagctaaaaggatataccaactgggctattggattaaccagcgttatcaaccagaagctaaaggatgatgaggttgctcagctcaagaaaagtgcagataccctgtgggacataggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtgaaa

SEQ ID NO: 2071 - DNA, 375 bp, Homo sapiens
  misc_feature (1)...(375): n = A,T,C or G
ggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttctatgaagctgttgcttatggtgcagctgtccaggcagccatcttgtctggagacaagtctggagaatgtttcaagatttgctgcnncttggatgtcactccnctttncccttggtattgaaactgctggtgggagtcatgactgttcctcat

SEQ ID NO: 2072 - DNA, 464 bp, Homo sapiens
cccttttttggtcctggcatccctggagaaggtaggggtcttgacctaagtttaaatttgatctccatgtgcaaaggacctgctgcctcccctgggtctgtcctggggtcatgaggatgctgaggttgacgacaggttccaggtcctttcactcctttggccaaaggttgggggtgggtggcccaaatggggtgctttttaggtaaacaacaggagtggtcagagttccctcaaaggatcctccactccagagcccctgaaaaggccgggaccaaaggccctgtgtgatgtgtactccgcagctgtttggggtgggacatttttgtacttttcgatttgcttatgggtcagccattacctgtgtcagtccatgattttgttgtaacagttttaaaagtaaataaataaagctgcctgatgtcccctcaaaaaaaaaaaaaaaaaaaaaaaaaaaaaaaaaaaaa

SEQ ID NO: 2073 - DNA, 643 bp, Homo sapiens
gggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttga

SEQ ID NO: 2074 - DNA, 358 bp, Homo sapiens
gtgaagagcagggccagggtgggtcgagggctcttttaagtacttagggagatgaccttgtctttgaccagactgagatagcagcttacagagggagcgagaaaccctgaacatggagaagatttaaaaggtagcatggggttggctctgacagtataccttctctctgaatgagtcttttgtgtccttctcttcaggttcagattcagaacaagaaagtggacatctctaaggtctcctccaagtgtgggtctaaggctaacatcaagcacaagcctggtgagtgggtgcctcccttgcccactggggtctccaggggtatttcgtcctgcccatggggtcaacttgggcaagccag

SEQ ID NO: 2075 - DNA, 472 bp, Homo sapiens
gcctgacaggtcatccccctttctgaggtagcagtgcattgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggagctgccccagacttggcctcctcatgccc

SEQ ID NO: 2076 - DNA, 436 bp, Homo sapiens
caccagaaaccgtcacaggaacggggaaaaagtgcagcttgccggccgaggaggattctgtgttagaaaaactaggggaaaggaaaccatggcaacagtcaaccttctgagctttcttcagagacctcagccaacttcatgtattgcggtacccctcccacacaagccaaacaagtttgcagacccaagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatg

SEQ ID NO: 2077 - DNA, 728 bp, Homo sapiens
  misc_feature (1)...(728): n = A,T,C or G
gcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtggaatggtctagatgaaagcaaaatccaaagataaaaaatgagtttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaaganggtcatgggtgttctggccatttatggctttnagattttcgaggacaacagctttgagcagttcattattaattnttgtaacgaaaagctgcaacaaatcttcattgaacttactcttaaagaagagcaggaggagtatatacggggaggttatagaatggactcaccattgactacttcaataatgctancattttgtgacctaataggaaattaaccacaat

SEQ ID NO: 2078 - DNA, 739 bp, Homo sapiens
gaggatttccttgcaatgagtagaatttcccttctgtcccttgtcacaagtttaaaaacctcacagcttgtataatgtaatcatttggggtccgcttttaacttggactagtgtaactccttcatgcaataaacctgaaaagagccatgctgtgtagtcttgaagtccctcatttaaacaggttgagcagtaagccctggcagtgtccaccctggaacaaagcaatgacaaggtttcagccaaagccaagaacccccaagatcacaggaggctatgtctgacccagaaggctcccttgggggctcccttggacaagagtcccctggccctaaggagagtgtcaccacttgaaacagaatggggtaacactgcccccagctatgtcaactagaggggagtctcttggccctggtatctgaccagggtagaattcagaaaggggctaccttttccagaggaagtcaatgggacatttagttcaccaccagggtggtcttttgaagcagatctatcctagccgggaggtgttgcgacatgaagggtgaggccagcccggaacaaatgccaagctggtgccattggctgtgtggctagctgtagaggcttcaactcagtacgagccagtgccatgtgaaggaacaagctggtcttttggttttctttccccctccagtttcaatgttatgtaatgtatttaaatccttatttaaataaagcttgttttcagaaaaaaaaaaaa

SEQ ID NO: 2079 - DNA, 2765 bp, Homo sapiens
aaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaaggtgtaaaaaatacagggaccaatttcacagacccagcagaaacttatttatgaagagaaactagaagccagtgaactcttcaaagacaagaaggctttatacccatctagtgttgggcaaccattccaaggggcttacctgggaaatcaacaagaaccccaagtataagaaactcaaagatgccattgaagaaaagatcatcattgctgaagtcgtgtaacaaaattaaaccgtggctaatggggagagtacatctcggattttcctcttaacaaacaataatctccttcgttgctgaccaaaagtctggacaaatcaagtcagaggttccactggtggatgtgacccaaggtatccaatgagctcacaaaatgatggcttcttcgccgtcccacctcaaagagggctcagaagcagttagtaagggaacttttcttttcaggagggatccacttggtttgaaatggcccacccaggttcttccgcaaaaattttaggccaaacccaaccggaggctcaatattgagatttcccgatgaagttcctggtacagttcagacaaggacaaaagtatgtgtgaagtttaattccagggaaacccagaaaaattgggagtgtccccaacatgtaaacgaaaaaacaaccgtctccttgaagttgcctgtccccttaactggcgcctcctctctactttcatggacttgttcctttgtaatagtgcaatttggttttggttttatttggggttcattgtatgtttgggaatcaccaaaggctttttagagtttctttggcaaaataaaaatatttgactaatcaatttttattattggaatagttttaacctttcaaatacatgttctgtcctggagcaggattgtaggaaactaccagtgtctattttccatgtctgatgtgttcttcctttagtcatcatgttaggtctgtgtaccctaaatccagcatattactcataaatcattaattaatataaagcataggaaatggtcttaaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaatacccatatatgatcctcgaaatgataatatctccagaatattgttttcacccaaatttgagtagatattttaaacacctaacaaagtaaagggctaaaagcccattcagatagccagtgaaacattctgtatgatgtgccaattaaaccatcccaagatctttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccattttcctgaatcacaactgtatttttgtatctcaagctattttcatatgttatgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacata

SEQ ID NO: 2080 - DNA, 5472 bp, Homo sapiens
gagcttgaaagttccagaacgctgcggtgagtgcgttatcgtgaggcggcgcggtggggtgggtgcggaagggggcgaggcgaggagtggagccgcgttgtgattgtgattgggtcttgtaagggcagccggactctattggccgggaacctaatgcaggaagcaggcggaccccttctggaaggttctaagatagggtataagaggcagggtggcgggcggaaaccggtgctcagttgaactgcgctgcagctcttggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcatggccccaggggaggctgggagacgcccggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccggggggcactggcacctggcgagggaggggaacagacagtgctcagttcggggtaagaccacgtgttgagcaacgccccacgccgtctgggtcgatgggtccttcatctagggcgtgctgtgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttggtgagttcctaattttaaatgacagaacaaatataaacagggctaggaagcacaaaagtttatgaaacgtgaggagggaactttttgattttagaaaaactgagctgagagacttgttatcaagtctgttataaaacaggttgtagaaacctttcaggctgaaatctggataacgtaggaggttgaagtttgaacctttgctaggtatatggtagttgaattcacctacctatgaactgttaggtatttgagtaatcatggacttgagttttatctgaagagctatgaaattgaaagtgttttcatttgacaccttttacagatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggtgaggttggtttttcagtatggggtgcattccggagtagttaaaagcccgatgactcccgggggcactggcacctggcgagggaggggaacagatggggctcagctcagggttaagaccacgtgcccaacagtgccctaggctctctaggtagatgggtctgtcaacaccagaaaccagtgaatcttgacaattacacagtaatttacattttggtggggggggtgctccagctgttgtttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagccagaaagaaacgtgctcatctttgaccctgggaggtggcactttttgatgtgtcaattcctcaactatttgaggatggaatctttgaaggtaaagtttaccagctaggttgacacccacttgggtggaggaagattttgacaaccagaatggtcaaccattttaattgctgagtttaagcgcaagcataaagaaggacatcagtgagaacaagagaagctgtaagacgcctccgtactgcttgtgaaccgtgctaagccgtacccctctcttccaggcacccagggccagtatttgagatcgattctctctatggaagggaatcgacttctattacctccatttacccgtggcccgattttgaaggaacttgaatggttgacctgttccgtggcaccctgggacccagtaggagaaagcccttccgagatgccaaacttaggacaagtcacagatttcatgatattgtcctggtttggtggttctacttcgtatccccaagatttcagaagcttctccaaggacttctttcaatgggaaaaagaacttgaattaaggagcatcaaccctggatggaaggctgttggtttattggtgcaggtaacaatggtatctcaattaaccctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggtaaggaggcactgtcatctggtcttgacagggataatggtatttcaattgagttactggtgaataagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggtttgtgtttttttttttttttttcctcccccacgcaatggaggggaaggggatggtaaaccaagcttgagctggatttcagtgtagggtcacaatgatgaatggtccaaaacagttcagcggtttccaccagaattcaaggtgttggcaactaccttccttggatgtctgagtgacccaagatgttaaggaagaataaggccctattttaatgttggtagtggccctcttgtaagagtttgcgccagacttttagtatcagattgcgtcagggagaaagaagggttattaacattaaaagaacttgcagtaattcctttttctcttcctcaggactgccgaggaagggaaggaatttggaacattcaacagaaaggggctgggagaaagtttgcaaccccattcatcaccaaggctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttatacactgtattgtaagtggaaaatgcaatgtcttaaataaaactatttaaaattggcaccatacaattgctttgagtctttaaataatctcccaggccagcggtgggagaagtaggcttaggtgattatgtgactcttactttctccttcctcttaagcttgagttaacaagggctgggtggcaagttgcccttcagagcatgtggatggtacattttggaattcagagctttgagaaggggagcataagaaattggatctggatcaaactaaccttagtccttaggctggagaggcagaagctgacttaatggtgttttctaaacttattctgtgtgtaagcctgcctaggagcagaggctttcctggagggttgtgctagatgagtaagaatttagatacagaatcaaataatgggcagtgaatattaagctacatggcagaggtatctgaatgtcaatcccttatatgagccactgccctgtgggcttccatttcttctgagttaagattattcagaaggtcggggattggagctaagctgccacctggttaattaaggtcccaacagtgagttgtgatagcctaggggagcaggctg

SEQ ID NO: 2081 - DNA, 1430 bp, Homo sapiens
  misc_feature (1)...(1430): n = A,T,C or G
cggaggagacgcacgcagcctgactttgtcttctccgcacgactgttacagaggtctccagagccttctctctcctgtgcaaaatggcaactcttaaggaaaaactcattgcaccagttgcggaagaagaggcaacagttccaaacaataagatcacctgtagtgggtgttggacaagttggtatggcagtgtgctatcagcattctggggaaagtctcctggcctgatgaactttgctcttgtggatgttttggaagataagcttaaaggagaaactgatggatctgcagcatgggagcttatttcttcagacaccctaaaattgtggcagataaagatttatttctgtgacccgccaaattctaaagatttgtaagtggtaacttgcaggaagtcccgtccagccaagaaagggagagtccggctcaaatctgggtgcagaaaaaaatgttaatgtccttcaaattcatttattcctcaagatcgtccaagtacagtccctgatttgcatcataattggtggtttcccacccagttggacattcttaccgtatgttaccctggggaaactaagtgggattacccaaacaccgccgtgattggaagttggatgtaatctcggattctgctaggatttcgctacccttatgggcttgaaaaacttgggcctttcatccccaggcagctgcccatggatgggattttgggggaaacatggccgactccaagtgttgctgtgtggaagtggtgtgaatgtggcaggtgttcttctccagggaatttgaaatccagaaaatgggaacctgaccaatgataagttgaaaattggaaggaagtgcataaggatggtgggttgaaaagtgccctatgaagtccatccaagcctaaaagggatatacccaactgggggctattggattaaggtgtggctggatcttattgaatcccatgttgaaaaatcttatcccaggattccatcccgtgtcaaccaatggtaaaggcaggggatgtatggcattgagaatgaagtcttccctggagccttccatcgtatcctccaatgcccgggggattaaccagcggttatcaaccaagaagctaaaaggatgactagggtcgctcagcttcaagaaaagtgcagatacccctgtggggacatccagaatggaccctaaaaagancctgtgactagtgagctggtaggctgtagaaatttaaaaactacaattgtgattaactccgagcctttaagttttcaatccatgtaccatgggtcacagtttgcctttgatcttcttcaaatattgtgaatttgggctcacagaatcaaagcctatgcttgggttttaatggcttgcaatctgaagctcttgaacaaaataaaattaactattggtagtgtgtaaaaaaaaaaaaaaaaaaaaaaaaa

SEQ ID NO: 2082 - DNA, 2364 bp, Homo sapiens
gggggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtggggcaccgcctggcagcccggactcccccgacatgtgatcggcttcccagggagggcgggaggcccgggcgttccccgagcctggggaagctggccgtcccggactgacctgctcggggagagccagcaaaggacacattcggcctggtcccaagccctgacgatttcagtgttgttttctgcacgcgcaaaacacctggggaccgaggggatggcagtggtcatcctatctttgacagctctgaacgagtcttaaccttttttttcagacccctttgctgatgcaagtaagggtgatgacctgcttcctgctgggcactgaggattatatccatataaagaattcaacagagaaacggcaggaagacccttactactgtccaagggatcgctgatgattacgataaaaagaaactagtgaaggcgtttaagaaagtaggtcttcagtgagattttgggaaggtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatgggagaagtaattccagctacagggtgaccaacgcaagaacatatgccagttcctcgtagagacttggactggctaaggacgatcagctgaaggttcatgggttttaagtgcttgtggctcacctgaagcttaagtgaggatttatttcccttgcaatgagtagaatttccccttctctccccttgtcaacaggtttaaaaacctcacagcttgtataatgtaacccatttgggggtcccgctttttaaacttgggacttagtgtaactcccttccatgcaataaacttgaaaagaagccatgcttgtctaagtcttgaaggtccctcattttaaacagagggtcaagccaatagggcgcctgggcagtgttcaagcctggaaaccaaggcaataccgtccatgttttcaggccaagcccaggagccctaaggtttacaaaccaacctattgggccgggaaccttcctcaagctcctccctcttgcaagagtttccctaacccttaaagagaatgttacccacctggaacaggttcctcgcgtgaatctgaggagggagaggatgggggtaagggcaggaaggcaccagctgttactaattaggaaggggagcttttgggtgggtagattcccctggggtgtctcccaaaccctgaattagggtgggacagagcctcaaagagggggcgcccccccttttcttacccgctaaagcggaggtgataggacatcttggcttgcccacaaaggtttttttttcgacccagacaatatccctagcttaaggggatgttccaaacattcagaatgttgagggccaacccttctatccagagttaaaacttttttgacaagggggaccaaatcttcaaactgatccgatcagtcattgtagctagctgtagagcttgccaacttaattagcagcagctggcccaaatgccatgtgaagtaaccaaactggtttttggtttttttttgccccttacagttttgaatgttatcgtgtaactgtatttaaacccttgatttaagataagaacttgttttcagaaataaaaaaaaaaaaaaaaaaaaaaaaaaaaaacctgcccgggcggccgctcgagc

SEQ ID NO: 2083 - DNA, 6188 bp, Homo sapiens
  misc_feature (1)...(6188): n = A,T,C or G
tgcgaccgcctccctgcgccccgcccctccggctagctcgctggctcccggctcctcccgacgtctcctacctcctcacggctcttcccggcgctctcctggctcccttctgccccagctccgtcttcggcggcggcgggcagttgcagtggtgcagaatgggctgacctcagtcttgcagatgcattaacagaaccatctccagacattgaggggagagataaagcgggacttcattgccacactagaggcagaggcctttgatgatgttgtgggagaaactgttggaaaaacagaccaatattcctctcctggatgttgatgagaaaaccgggaactcagagtcaaagaagaaaccgtgctcagaaactagccagattgaagatactccatcttctaaaccaacactcctaggccaatggtgggtcatgggagtaggaagggagcgatactacagggtctccaacttgaattccttggaaggaggaaaatgggcctaccaggggattaccccaaataggcccagaactggccagaagataccaacttttgtttccaacctgagcaagtggttgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccaagaggctgttgcagatcactcctcagcccaactgcagttcccttagagctagccaaggagatagaaatggcatcagaagagaggccaccagcacaagcattggaaataatgatgggactgagaactactgacatggcacccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatacacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaagggatggggttctgaccctggccaacaatgtgactccagccaaagatgttgcgccgactctcagaaacagaggcaacaccagttccaattaaagacatggaaagggcgcaaacacagaaaggagtaagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatgcgaaagccaaaacacagcccacttctctccataaggcagccagctccacaccaccattggtgggttgaatacaaaaacccatgagccttgcgtcaggcttagtgccagctgccccaccgcaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaaactggcccaaggagtaggagcccctccacgctcctggccaaggaaggccactgccattaagactgagggaaaaccctgnagaagtcaagaagatgactgcaaagtctgtaccagctggacttgagtcgtccaaagagcacctccaccagttgcatgaagaaaaccaccactctcagtgggacagcccccgctgcaggggatggttcccagccgagtcaaggccacacccatgccctcccggccctccacaactcctttcatagacaagaagcccacctcgggccaaacccaagctccaccaccccccggctcagccgcctggccaccaatactttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctggtgaagactgagggcggtggcagcgaggctcctctgtgtccgggtccccctgctggggaggagccggccatctctgaggcagcgcctgaagctggcgcccccacttcagccagtggccttcaatggccaccccaccctgttcaggggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgcgatgtctgggcagcccgctaggctcgccttccctcctgctttgcgtgcccggggcagcagcagccctgccccacacctccctctcactccccagcctgggcccatcttccctgctttggtcttgccccattcacttgcggccactggttccgtgggagggaggttggggagggggttgggggtggtttgagggtaaagttggggatttagggagagggagaaccagattctaatcctcatctttttttgggttctttgggtccaaacccaaaagaaactgacatgccctcccttctccctggatctacctggagggaagagtggaggtggattccgagtggtgacaggacgctgaccgtggagcttaagccactgcctctccctctggtcccacaaatgggcgccccccccctccccatgcaggtggtgtcgggcccttcttgctgccctgccccaaagtggggggtcaagtctgccttgtccccatgcttaacatactggccaaggctgctgtcacatttttcttgttttgtccttttatttttttctaaaaacccaaaaacctggcaaaataagttctgcagggttgaaggccatgtcttacatggaaagtccttcagtaagtgttagaaggggaccaggggcgggagatatccttatggccaacccccgctgggagggatgtggggcagccttaggggccctgaaggcggtgcggcaaggaagaggggtgcagagcatgtggctgctgagccggtccaggcaacacaagggggccccttggcagcgttgactgggttgggttttgcccattttgttgtgtgtatgcctgcttttctttttctaacccaagaggctgggtttttggcatctctggtccccatttccctggggatcttggtggtcaaccccttgggataaaaaagccagggcttggagaacaagaaaagggccccaggagatggaaattcccttcaaggcccgggcaaccaacaccccttaggacatgtaaagcccttacatgtcacagagggagccctcatgccagatagctaggaaactcaggtctcggtaaatttaaaaataaaaggcatgatgactaaggctatcctgcttcccttatgcccctgactggggaggggaggggggagaaggcaaggcccaccgagggcatcccagttatggccttgggatggctgcagtgtgtatgaaatcccgggaactgtattgacacaaagattcttattgcacttgtatttttttgtattaaagtttgcatggtttctaataaaggattcaaacataagtttgtaggtgaaatggcctgggagattccaagggcttctctggagggggattggctgcagtgtagatttgcctctgaagggaggcttgccccagactttggcctcctcatgccccctcctgacctctgcccttctcttggtcctggcatcccctggagaaggtaggggtctttgacctaagtttagatttgatctccatgtgcagggaggctgtcctggggcctgacaggtcctccccctttctggaggtaggcagtgccttgtgggaggttttgacaccatgttccctaggttccccaaggcacacaccagggaaactgcagggggctcacggaggaagtgctgcctgggccagggggaccagcatttcctccgtagagaccatgtgcagaacacttctgctgtgccaagaacatgagggagcccagtgttttgtcagcaggaagaaagggcctgctgggatgaaagtgggaaggaaaccagggtttgccgtaagtccaggagacacctgcagggggcaaccagcaacagcccccagagtaccctgcctgccctcccactgcggtcttgtccctgggggtcactgaggatgcctgaaggttgaacgaacaggttccccaggtccctttccacctccctttggcccaaaggttgggggtaaggtggcccaaagtggcgttctctctaaggtagaccaacaaggagttggtcaagagttccctcaaaaaagggatccctcccactcccagagcacctgagaaggcccgggaccgagaggccctgtgttgatgttgtacttccgcagcttgttttggggttggacattttctgtacttctcgatttgcttcatggctcagcccatttacctgtgtcagtcccaatngattctgttggtaacagttttaaagagtaaataaaataaaagcctggcctgaatggtcccatcaaaaaaaaaaaaaaaaa

SEQ ID NO: 2084 - DNA, 2509 bp, Homo sapiens
gaaaccggtctcattgagcttgccctgcagctctcagggttcctgtgactttcttcatcgttggagccaggcctacaccccagcaaccatggtccaagggaccttgcagttggtattgatcttggcaccacctactcttgtgtgggtgttttccagcacggaaaagtcgagataattgccaatgtatcagggaaaccgaaccactccaagcgtatgtcgcctttacggacactgaaccggttggatcggtgatgccgcaaagaatcaagttgcaatgaaccccaccaacacagtttttggatgccaaaccgtcctgattgggacggcagatttgatggatgctgttgtccagtctgatattgaaacattgggccctttattgggtgggtgaaatgatgctgggcaggcccaagggtccaaggtagaaataccaagggagagaccaaaagcttctatccagaagaaggtgtctttctatgggttctgacaaagattgaaaggaaatttgcagaagccctaaccttggggaagaactggttaccaatgctgtgggtcacagtgcccagtttactttaatgactctccagcgtcaggctaccaaagatgctggaactattgctggtctcaatgtacttagaatttattaatgaggccaactgctgctgctattgctttacggcttagacaaaaaaggttggagcagaaaagaaaccgtgctcatcttttgacctggggaggtggcactttttgatgtgtcaatcctcactattgaggattggaatctttgaaggtcaagtctacagctggagacacccacttgggtgggaggaagattttgacaaccgaatggtcaagaatggtcaaccattttattgctgagtacaagcgcaagcataagaaccacatcagtgagaccaagagagctgtaagacgcctctgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaacttagacaagtcacagattcatgatatttgtccctggttggtggttctactcgtatccccaagattgcagaagtcttgctgccaagacttcttcaatggaaaagaactgaataagagcatcaaccctgatgaagctgttgcttatggtgcagctgtccagagcagcccatcttgtctgggagacaagtctggagaatgttcaagatttgctgctcttgggatgtcactcctctttccccttgggtattgaaaactgctggtggagtccatgactgtcctccatccaagcgtaataccaccattcctaccaagcagacacagaccttcactacctatttctggacaacccagcctgggtgtggcttattcaggttttatgaagggcgagcgtgccaatgacaaacggataaacaacctgcttgggcaagttttgacctcacagggcatacctcctggcaccccgagggtgtttcctcaggattggaagttcacttttggacattggatggccatgggtatccttcaatgtcttctggctgtggggacaaggagtacggggaaaagaggaacaaggttacttattcactaattgacaaggggccgttttgaggcaaggaagaccattgaaacgtatggttccagggaagctgaggaagttacaaagctggaaggtggaggaaggcaggaggggacaaggtgtcatcccaaggaattcactttgagtccctatgccttcaaccatgaaagcaacctgttgaagtatgagaaactttcaaggccaagattaaccgatgaggaccaaaccggaggattctggcacaagtgtaattgaaattatcaactgggcttgataagaactcagcactgcttgagaaggaagaatttgaacatcaacaggaaagagctgggagaaagtttgcaaccccatgcatccaccaagctgtaccagagtgtcaggaggcatggccaggaggaatgccctggggggatttcctgggtggtggagctcccccatctggttggttgcttcttcaggccccaccattgagagaggttgatttaagcccaacccaagtgttagatgtagcattgtttccacacattttaaaaccatttgaagggacctaaatttcgtaggcaaaatttcttttgggcaagttttaaaaaagtttaaggctgcttattagttaaggtttacttgggcattcttcaattactttgaattttgggaacatatggcacaggggagaggaaataacattgcaactttataaacacttgtattgtaagtgggaaaatgcaatgttcttaaataaaactatttaaaattggcaccttaaagagaaaaagaaaaaggtcgacgcggcgcgaatttggtgtagtagt

SEQ ID NO: 2085 - DNA, 670 bp, Homo sapiens
gccagctgttgcccagctcttgctgggcccgtttgtaggccctcctgcaggtcggctacctgcgtttgggaggcaactagcctggaaggccactgtcagtgctcaaggtgatagccacatattcctgaacccggtgtcgtccctgttgttagctgggaatactgtctcaggccagcagcatgacggcatcatcagcactggtgaggatcgtgagcggggtgagggctccaagggtgctgtgctcaggagctgttctctccaggcacgtgcctgctgtgccgcatgtatctgcagcagggcgggcgggtggaatccatccctcgtggtgggtctgcattcagaaacctgaacgtggtggtggtcactgatccggaaactgttaagggaagtcctgtgttgagaatgcaggcgcctgcccagagtttggaggtatttagcaggtggggccaggaagtgtccctctccatgagtgttgcaggcaggcattctctccttaaacacgaggtctgctgatctcacaggagtctcttcttgtcccaaccccttaatgtgtccaggagaggagataggacatgaacacatcccatcaaaatcaggggttaggacccatccatcctcatccctccactgtgtcgctgctgggatctcggggtactccaggccacctctt

SEQ ID NO: 2086 - DNA, 358 bp, Homo sapiens
gtcgtagttgcctttgctcttaaacagctgctggaagtggggtttgcagtagaactccccgtgcagcgcggcgtagctgcccaggctgagcttagtgtgacagtgcttgcagcagaagcaagagttgtggaaaatgagcttgtcggccaccagccgctccatggggtgcacggtcttctggcaggcggcgcaggtctccttcacctgggcccgcaggctgaaggacttggagcgctgcaccgtgctcctgaccgccgcctttggcgtcatgagagggggtgccctgggcggctcctgcagcctggaacatggctcgttggaggtggaagcctcgggtggagaagcggcacccgctggg

SEQ ID NO: 2087 - DNA, 1405 bp, Homo sapiens
tttttttttttttttttttttttttttttttttttgactaagcaaaatttgtacttgtttaataagaaaatcacttctttaaaaaaatagttctttacatgctgaggttcatctatgcaatgcaagagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtccccttcactgccttccaggggactgggcaccttggcgcccgtgccacctgccgtgagagcggtggcactgaagttgtggatgggcaaggtgctcagccactgggccatggagcgttcgtcccgctcggtgccgatgatggtggggtagatgtgctcctccttgaaggctgcgacctttccttcctcctgcgcccagtccagcggctcatgcagcccatcgttgccaaagcgctggttgtacttctcgaagtgcaccctctccaggaccaggccgagtccgggcgccttgggcacgtccaccttctctgtgccccagctgcgctccagcacgctctcaggggcataacccttcacaatggccaccaccaggccgaccatcttccggatctgatgcatcatgaagctctggcccttcaccctgatcaccgcaaactccaggccctcccgcacaaagggttcctcgcagtacatctccaggatgtagcggcaggcactgggatcctgcggccccttctgcgaggtgaaattgtggaagttgtgcgtgcccttgtagcaggccaggagcctgttgacctgctgcagcgtctcggcgctcaggcggtaggtctcatcctgaacgtcccggtccttgtgcgcaaaggcaaacgtgggcagcaggtagcaataggtcctggcatcacatctgttcttggagttaaacccgcccgtgacccgcttcagtcccagaatccgaatgtgagagggaaggtggctgttgatcttttctagaatgtcgtcaatcagccacaccttcagggataccacctggccggctgcggacacacccttgtctgtccgggcgcagcgctggaaggacattttcctcatgtcctcaccatgattttcaggaatacagcctgaccggacgagggcggacaccaagtcatcttcaattgttttgaattgtgaggacccgacattcctctgcatgccgtggtagcccttgcccgaataggccatgagcagcacgatcttccgcttgggcggcttctcgcgccgctcctcgtcgccaccgctcctgagcttcttcgccggatgttct

SEQ ID NO: 2088 - DNA, 1340 bp, Homo sapiens
  misc_feature (1)...(1340): n = A,T,C or G
tttttttttttttttttttttttttttttttttttgactaagcaaaatttgtacttgtttaataagaaaatcacttctttaaaaaaatagttctttacatgctgaggttcatctatgcaatgcaagagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtccccttcactgccttccaggggactgggcaccttggcgcccgtgccacctgccgtgagagcggtggcactgaagttgtggatgggcaaggtgctcagccactgggccatggagcgttcgtcccgctcggtgccgatgatggtggggtagatgtgctcctcccttgaaggctgcgacctttccttcctcnctgcgcccagtccagcggctcatgcagcccatcgttgccaaagcgctggttgtacttctcgaagtgcaccctctccaggaccaggccgagtccgggcgccttgggcacgtccaccttctctgtgccccagtgcgctccagcacgctctcaggggcataacccttcacaatggccaccaccaggccgaccatcttccggatctgatgcatcatgaagctctggcccttcacccttgatcaccgcaaactccaggccctcccgcacaaagggttcctcgcagtacatctccaggatgtagcggcaggcactgggatcctgcggccccttctgcgaggtgaaattgtggaagttgtgcgtgcccttgtagcaggccaggagcctgttgacctgctgcagcgtctcggcgctcaggcggtaggtctcatcctgaacgtcccggtccttgtgcgcaaaggcaaacgtgggcagcaggtagcaataggtcctggcatcacatctgttcttggagttaaacccgcccgtgacccgcttcagtcctcagaatccgaatgtgagagggaaggtggctgttgatcttttctagaatgtcgtcaatcagccacaccttcagggataccacctggccggctgcggacacacccttgtctgtccgggcgcagcgctggaaggacattttnnnnagngnncncnncangntnnnnaacaggcacaggaggacgatggacaggagggacaggtgcagtgctctataaggtgactgaatttacaaccatttattgtaattttccaatagtgagaagatacggaatgtctccaacacaaagaaat

SEQ ID NO: 2089 - DNA, 406 bp, Homo sapiens
gcggccgccactgtgccacctgcaagaatgtgtgtccctgagaacagaatcaacacaagagaaagcaaagaccagagagaacacagagtcccactggcagggagcatctagatccagctatacctgagccgaccaggctcctggacgtctcacctacataaggcgtaggctagtttgatttgtacatcattatgtgctcagaaacagcataacaagccagaacactgagctggaaagtgggccacgtgctgctcatagcagcgggggaggggcagagaaggccaccacccaccttgtctggtccgggcgcagcgctggaaggacattttcctcatgtcctcaccatgattttcaggaatacagcctgaccggacgagggcggacaccaagtcatcttcaattgttt

SEQ ID NO: 2090 - DNA, 464 bp, Homo sapiens
ctgaggttcatctatgcaatgcaagagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtccccttcactgccttccaggggactgggcaccttgtctgtccgggcgcagcgctggaaggacattttcctcatgtcctcaccatgattttcaggaatacagcctgaccggacgagggcggacaccaagtcatcttcaattgttttgaattgtgaggacccgacattcctctgcatgccgtggtagcccttgcccgaataggccatgagcagcacgatcttccgcttgggcggcttctcgcgc

SEQ ID NO: 2091 - DNA, 481 bp, Homo sapiens
  misc_feature (1)...(481): n = A,T,C or G
cccttgtaanaaccccagaaccctgttgaacctgctgcaaccttctcggcnctcaagcggtaggtcctcatcctaaacgtccccggtcccttgtccgcaaaaggcaaaacgtgggcaagcaggtagcaaataggtccctggcatcacatctgttcttggagttaaacccgcccgtgacccgcttcagtcctaggggggaggtggtcagggaggagaaaggcaggtgagaagtgccctggatgacccagggagcagcctgagcacggcgtgagccccagcgtctccttacccagagcaccgaccaagctccagcaagcatcggcttctctggggagggggcaccacaggctggggaacaggcacaggaggacgatggacaggagggacaggtgcagtgctctataaggtgactgaatttacaaccatttattgtaattttccaatagtgagaagatacggaatgtctccaacacaaagaaat

SEQ ID NO: 2092 - DNA, 1755 bp, Homo sapiens
  misc_feature (1)...(1755): n = A,T,C or G
gttccgcgtcgtcggcagagcggcactctgggaggcgttttgggcccgcggagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtgcccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtgngntngatcttttagacctgagactgtggcctcccagcccagcctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaaaaaaaaaaaaaaaaaaaaaaaaaaaaa

SEQ ID NO: 2093 - DNA, 427 bp, Homo sapiens
tccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggtttctagaaccccaggaaggggtggtcggcagcatggagggccccgacgatagcgaggtcacctttgcattgcactcagcatctgtgttttgtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaa

SEQ ID NO: 2094 - DNA, 340 bp, Homo sapiens
ccgaatcggaaagcggggctgctgctgacacccccccactggagaccctaagcttccatggtgatgaagagattatcgaggtggtagaacttgatcccggtccgccggacccagatgaccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaa

SEQ ID NO: 2095 - DNA, 468 bp, Homo sapiens
  misc_feature (1)...(468): n = A,T,C or G
gccaggtggacactaaggaggaggtctggtccttttgaagcgggagacctggagtggattggagtggcatcctcgggcacctgtcctgttggcgggcacagctgacggcaacacctggatgtggaaagtcccgaatggtgacntgcnaagaccttccagggtcccaactgcccanccacctgtggccgagtccntccctgatgggaagagagctgtggtaggctatgaagatgggaccatcaggatttgggacctgaagcagggaagcccttcagagggaggggtggacctgtttctctttcactttcgatttgctggtgtgagccatggggtgtgtatttgtatgtggggagtaggtgtttgaggttcccgttctttcccntcccaagtctctgggggtggaaaggaggaagagatactagttaaagattttaaaaatgtaaataaaatatacttcccagaaaaaaa

SEQ ID NO: 2096 - DNA, 375 bp, Homo sapiens
  misc_feature (1)...(375): n = A,T,C or G
agaccctaagcttccatggtgatgaagagattatcgaggtggtagaacttgatcccggtccgccgaccaggatgacctggcccaggagatggaagatgtggactttgaggaagaagaggaggaagagggcaacgaagagggctgggttctagaaccccaggaagggtggntcggcagcatggagggccccgacgatagcgaggtcacctttgcattgcactcaggtaggtctttgaggcgatccacctcaaatcagtttaggtgggcgtgtaagcattaaacatcagccatgggacagaacgttatggggggacacagagatggggcaagatgctggccttgcgcttggaggagtccacaggtgggaaagttttt

SEQ ID NO: 2097 - DNA, 977 bp, Homo sapiens
  misc_feature (1)...(977): n = A,T,C or G
gaagagagctgtggtaggctatgaagatgggaccatcaggatttgggacctgaagcagggaagccctatccatgtactgaaagggactgagggtcaccagggcccactcacctgttttgctgccaaccaggatggcagcttgatcctaactggctctgtggactgccaggccaagctggtcagtgccaccaccggcaaggtgtgggttgttttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgcgtngngtatatacctgcagcctggatggcatcgtgcgcctctgggacgcccggaccggccgcctgcttactgactaccggggccacacggctgagatcccggactttgccctcagcaaagatgcctccctggtggtgaccacgtcaggagaccacaaagcgaaagtattttgtgtccaaaggcctgaccgttaatggctgcagcccctgcctgtgtgtctggtgttgtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaaaaa

SEQ ID NO: 2098 - DNA, 286 bp, Homo sapiens
  misc_feature (1)...(286): n = A,T,C or G
ggaaagcggggctgctgctgacacccccccactggagaccctnnnnttccatggtgatgaagagattatcgaggtggtagaacttgatcccggtccgccggcagcatggagggccccgacgatagcgaggtcacctttgcattgcactcagcatctgtnttttgtgtgagcctggaccccaagaccaataccttggcagtnaccgggggtgaagatgacaaagccttcgtatggcggctcagcgatgngggagctgctctttgagtgtgcaaggccataaagactt

SEQ ID NO: 2099 - DNA, 271 bp, Homo sapiens
ccgtataaaaaattactgggaaaaattgataaataacaggtaagagaaagatatttctaggcaattactaggatcatttggaaaaagtgagtactgtggatatttaaaatatcacagtaacaagatcatgcttgttcctacagtattgcgggccagacacttaagtgaaagcagaagtgtttgggtgactttcctacttaaaattttggtcatgatggtgtagcttctgacatctggcttgatggttctctggattggagtctgccattgg

SEQ ID NO: 2100 - DNA, 2823 bp, Homo sapiens
cccaggtgacacgcatggtgtctggaccaatgttggtgaatcgcaggtcagtgggaggaggaacagctggtttcgaacaagaaggaagactcagttaatgtattttaaaattaaagctaacgaagtagctggaaaggtaaaatcaatatttcatgcataaaggaaacagaatcataatcatgcaaacagtctaatctaagtctattttaagttatagtgtactactgttaaaaataaaacactacacacagtactgttaggccccctttaacctttttgccatcattgatatatttaaaaaagattttaatctactttcaaatatgttgactttatgtacattattaataccactgcagattattttatcccaggccgaagaggcttaagttgccacacagcaaagagaaacatagcagtactttacaaagaaatacatgcacacagacaaaaagacaagagggtcctaaacttccccccatgtgagatatctagagctacagttccattcagtgaattctacttacaagtgaacatgttcatgcaaattggttctcagcatgtttcttttcccatgcacagcagagaacctttaaaatgttgcatgcttgtccccagactgtggttaaagaggtgtttctttacctagtgacagcaacaaaacctagaatggtcccaagtttacttttctcctacctcaaaacaatgcccatccactctaccctaaattttgatgggtttttagctacaaagaaggagcatggtagagtttatcaaagggtagaaggaagagcatgatggtacattttggtgatatattcttatcaattggtacttacgcaatttggtattcgtgtttggtatttaagaagaaaaattctaggtcttcaaattgaatgaacatttgctattttatatttaacagagcagacatctgtatttctctaggctttatatctacttgtggtttaaatgagagtgtactgaagatattgcatgtgtttttctccaatcagtttagcagatgcatttgattccttatccccccaattccacctatctgaatctttggccaattgctgacttcccccatgaaacatccatatttaaccggagtaactggtggcagcatgcaacaccatctatgtctcaaacgcagaagttttcaaaattcacccgtttgttgtgtcagtgtagtaggggcactctcgccgccattaatgagagtgataacgctgatatcatagtcaatgcccggctccagccctgtgactgtgtagtatcctactgaggagtccacaaaatcttcaaaaatagggataccttctcctgccgcaactactgtgatgcggtacccaataatggtggaagagtttagcggggtccacctcaggccgatgcttgaatcggttatatcaacaaagcttaggtcagtgagttggggcacctctattgagttacaaagcaaagggagggggaggcaaaaggaaaatagagggaaaaaaagaggaaaaaataaagcagtgtatatcaggttactagtagtaaaattggtggaatgttaaagcaatgatggtaatatgcaatctgttttaaattctctgaaaagacttcctaagcatcatgaacagtttgcttccctagaagaataaacaggaatattcttttagggaatatatatatatatatatattttttacattttgaaaacatccttaaagggtacaatttgaactgttcagattcctaaaaatcatatggctgtttaggatgtcgaaaccattcttagagcctagacataatatctgaagtaagtatcagcaatgcttttaataattccaaaactgttttagtagaaaataagcttgcatgaacaaccggaaaaaataataaatgggtgataaattgattttttttctcccatacaaaactcatgacaacatcatggccataacgctaatgcattatgaatgtatggtgtgaaatgtgccattcaaaagcacattcaggctgaggaaagacaggcctaggttaaggccattgccactattttaggttcattcataatcaaaacatgtaattagcgttagtaaaagcattctactgaagagtccaaagggggacacgatctgtccaatgctttcattatgttataacccaatggacaaacaagcctatccttaggacaggcctttgcaatgttgtctttcaaggccacaagaaagaacaaccctgaaggtgtgacttttacttaacttttttttaaaatccaattttcaaaaagaaggatttgaaactgcaagatgaaataggcagctgttggaaattgatatggattgtaaaatcgggcagaaatgtactgatgggatgcatttaccatattactttgagcctatcagtactgagtacagacacgtgacagtgttttagtcatacttccatgtgagcagacaatacagagttaaagccatggctgccactccattacatactcgctgcaacacacagcatcccagtgaagcacagacagtaaagcagtgttaacagcaagcattttgtccaaatcgctgctttgacttcttggttttggaaagtgcagctgggagatcggaattaaatcccaaatatagttgacacccttaagcatctggggattaagatgctaatccccactcttattggaatgtcactctcaggatagcagcttattttctattacctgggatgatggtatcagagatagggacactttccttgtcatccttgacagtgtaaacactgacattgtactccaggccgggactcaggttatcaaaagtgcag

SEQ ID NO: 2101 - DNA, 809 bp, Homo sapiens
  misc_feature (1)...(809): n = A,T,C or G
gcaatgttgtctttcaagccacaagaaagaacaccgtgaaggtgtgacttttgcttcttttttttaaaatccaattttcaaaaagaaggatttgaaggtgcaagatgaaaaactagatgtgtcaaccaaatgctgtttcagtgctcacatacagggacataactattttataggcagctgttggaaattgatatggattgtaaaatcgggcagaaatgtactgatgggatgcatttaccatattactttgagcctatcagtactgagtacagacacgtgacagtgttttagtcatacttccatgtgagcagacaatacagagttaaagccatggctgccactccattacatactcgctgcaacacacagcatcccagtgaagcacagacagtaaagcagtgttaacagcaagcatttgtccaaatcgctgctttgacttcttggttttggaaagtgcagctgggagatcggaattaaatcccaaatatagttgacacccttaagcatctggggattaagatgctaatccccactcttattggaagtgtcactctcangatagcagcttatttttctattacctgngatgatggtatcagagatagggacactntccttgtcatccttgacagtgtaaacactgacattgtactccaggccgggactcaggttatcaaaagtgcaggagctctgatcagcatggaccacttttttcaaagaaattncctgctggccgtttgtaggggttgtggtaatttctataccagtaatgttctgggtggtgctcctctcccaggagactgtgagca

SEQ ID NO: 2102 - DNA, 494 bp, Homo sapiens
tacatagtgagggtaatcacagggagtcagagcttaggaaataatccacaactttagtatcctcttcaaatgtcttgctttatggtcttgtgtataagccaggatactccaaaatttcttttaatctgacttgtttccttaaatatcacctaagttttattgtttcttaccattcctctttaaagaggatctttcctaataattctttttcacccttacacgggaatcaatagcccagtgaagcataattcattcagtagggcataaagccgctgctcccatgggcacctggtggtcaaattaaccatatacctgtggactgggttccaatcaggggctggctctccatatcatcgtgcaaggcaaccacactgactgtgtactcagaacccggtctgaggccttgcagctctgcagtgtcttcttcaccatcaggtgcagggaatagctcatggattccatcctcagggctcgagtaggtcacctgtaactgg

SEQ ID NO: 2103 - DNA, 423 bp, Homo sapiens
ttttcccctcagtctacaagtcaatttaattgaccacatattgtttgttcactaaacaaatatagtaaatgctataggaatagttaatcagagttgttggctcaaaagctgggaaaaaaagaaaccatcagaattgataagattaggagactcagtatccaaggtttctgggtgggatactcacaggtctccacctgagaatgtacttggaaatgtgagatggctgtggtgcattccactggatggggtgggagttgggctgactcggagtctcagtgataaatacttcgacaggaccacttgagcttggataggtctgtaaaggttggcaatgccactccccaatgccacggccatagcagtagcactggtatctgacaccatgcacatacttctcccatgaatctccaatttgataaaacg

SEQ ID NO: 2104 - DNA, 632 bp, Homo sapiens
cgtttacaattttggcctttattaagggggattgttttcttttatattaactatgctttttaatgctaagatctatacatcactgttttttatttcttttagttttaaaccttatgttacaattttttaaataagaaagggcacaatgatggaagatcaaacttgttgattgacacttacgcaatttccatgacaaatattacacaaaatcaggcattcaaaggacaaaactatttctgatcatagcatgaaaataacgttctaaaactgggttatgatgataacactgaaaataaattttatcagtgtcagtcgtagaacagttaataagcccgtttacattgtgggtatttgttaacaaatgtggttagtgcaatgagttccctgacctgtgatggtgtagcttctgacatctggccttgatggttctctggattggagtctggccattggctggaacggcatcaacttggaagccagtgatcgtctcagtcttggttctccagctaatggtgatggtggtctcagtagcatctgtcacacgagccccttcttggtgggctgacatttctcagagtggtgacaactccctgagctgggctgctttgtcaagtgtccctaagagcatagac

SEQ ID NO: 2105 - DNA, 1241 bp, Homo sapiens
tgcaggttgttgctcattaaaaaggaaaatctattctacaattagaaaaataccttgggagaacattgcaaaacagtatctgaataagtaaaagctggtgtcaccccagagtagaagtttgtacctgttcggtaattaatggaaattggcttgcatgcttgcggggctgtctccacggccagtgacagcatacacagtgatggtataatcaactccaggtttaaggccgctgatggtagctgtagacttgctcccaggcacagtgaactcctggacagggctatttcctcctgtatgaaaaagggttagttcagagtgtgaggggtttagagctacttgggtattactgattaattgaattaccacatttatagcagcatgtaaatcacatcttcttgcttattcccttttaaagagcgctatcttgaacagaaaggggtatttatgcatgtagcaaaccttggtaaagtgtataaacattgagagaaaattacagttagcgctgttttaacatttcagctttaaaatgtcactgagtagtagagtagcattagaagtgggagaaggtaagccctcaacccaggattgcatgcattgtgtcctttttaaaacttttaacagaatacattccttttaaataaaatttggaaaatacagaaaagtaaagagaagaaaaaataaaaatcactttatttccaccactgataatatgtttgagaatttacaatccttttatttcctcagctctgccgttccccctctagttgtagtatataaacaactttttatttgggttttagaacaaattatatcatctatatcttaccgtattttcttggaaaaaacaagggctccgttgaatggacttgccaaagtttctttaattctttgttcactgttgggctttcaggttatccacaaccagaatctgatttaatcagagtgtaaaatagcattttactggctgtacctgtttctccgtaagtgatcctgtaatatctcactgtgacagcaggagcatcccagctgatcagtaggctggtgggggtcgcagcaacaacttccaggtccctcggaacatcagaaactagaaaaaaaagggaaacttttcacatccgtaattttcaaacaatattcagatttactgtttgttcattttccagataattgtcttaatgattcttccatacaatcatgtaaatactatgtgtaattagcagaattttatattatgacgaatt

SEQ ID NO: 2106 - DNA, 477 bp, Homo sapiens
ctcgttgacagagttgcccacggttaaaacctctcccgaaccttaatgcctctgctggtctttcagtgcctcccactaatgatgttgtaggtggcacctctggtgaggcctgtcagagtggcactggtagaagttcccaggaaccctgaactgtaagggttcttcatcagtgccaacaggatgacatgaaatgatgtactcagaagtgtcctggaatggggcccatgagatggttgtctgagagagagcttcttgtcctgtctttttccttccaatcaggggctcgctcttctgattattcttcagggcaatgacataaattgtatattcggttcccggttccaggccagtaatagtagcctctgtgacaccagggcggggccgagggaccacttctctgggaggagacccaggcttctcatacttgatgatgtagccggtaatcctggcacatggcggctgccatgataccagcaa

SEQ ID NO: 2107 - DNA, 528 bp, Homo sapiens
ctgaaaaatttaaaacttgacattaaaaaaagttttaacaaccaataatgtgtaaattatcttaggttattagctgaaacactgcaaattatcctcaaatggcatgtcaaaggaaagatggatttgcggaaatatttcttgacctgcttccccatttcccgcccctgctcgtcctgtgcctcaccgctcgatgtgggtctgcacagagggtgtgcctctcacacttccactctcctcggccgttgcctgtgcaggatgcactgggaggcagggtttcctcggattatccttcttgctccaggtgtctccaattctataggatgtccttgtgtcctggatcgttgcatctatttctagaagtgcaagtgatgcgtccgctgccttctcccaggcaagtacaatctaccatcatccagccttggtagggcttctcccacgtttctccgaccacataggaagtcccagcagcatgatcaaaacacttctcagctatgggcttgcaggtccattctccttttccattaccaa

SEQ ID NO: 2108 - DNA, 864 bp, Homo sapiens
tttagatatgttgtagatagtggggttcttcaaggacaaatcgtaaaggtagtgttttagacttctgcacacaaatggaaattcaggtagaatatctttctttcttttctagaaccatctatcttactcaaaaaggaacctcaaatgtgtgaggaataagaggaaatagtttcattttctctatggaaataaaaggctaggtgactctctgggtatgtccctccaaagtagagccatattggggatttaaaaaaaaaaaaaagcaggggctttaaatgtgcccatcttctaaggagggttctaaaagtggagccactttttttttttttttttcaagagacgaggtttcaccatgttggccaggctggtctcgaactcctaacctcaaatgatccacccgcctcggcctcccaaagtgctgggactacaggcgtgagccatcacacccggccatgaagccactttttattcgagggctggtcacttcagttacctaacttattcctttctgtgctgccccatgagaagtgaagagaacaattaattacctgtaagggttcttcatcagtgccaacaggatgacatgaaatgatgtactcagaagtgtcctggaatggggcccatgagatggttgtctgagagagagcttcttgtcctgtagaggcatttggattgagtcccggaccgtgtgggtacaggtgatagtctacatcttccctggggatgtgaccaatttggatttcctcacctacattcggcgggtatggtcttggcctatgccttatgggggtggccgttgtgggcggtgtggtccgcctaaaaccatgttcctcaaagatcatttgttgcccaacactgggttgc

SEQ ID NO: 2109 - DNA, 2455 bp, Homo sapiens
  misc_feature (1)...(2455): n = A,T,C or G
ttactctcgggaatcttctctgtcagcctgtacatctaaaggcatgaagcactcaattgggcaattaacattagtgtttgttctctgatggtatctctgagaatactggttgtaggactggccagtagtgccttcgggactgggttcacccccaggtctgcggcagttgtcacagcgccagccccgctggcctccaaagcatgtgcaggagcaaatggcaccgagatattccttctgccactgttctcctacgtggtatgtcttcccatcatcgtaacacgttgcctcatgagggtcacacttgaattctccttttccgttcccaagacatgtgcagctcatcatctggccattttctccctgacggtcccacttctctccaatcttgtagttcacaccattgtcatggcaccatctagatgaatcacatctgaaatgaccacttccaaagcctaagcactggcacaacagtttaaagcctgattcagacattcgttcccactcatctccaacggcataatgggaaactgtgtaggggtcaaagcacgagtcatccgtaggttggttcaagccttcgttgacagagttgcccacggtaacaacctcttcccgaaccttatgcctctgctggtctttcagtgcctccactatgatgttgtaaggtgggcacctctggtgaaggcctgtcaaaagtggccactggtaagaagttcccaggaaccctgaactgtaagggttcttcatcaagtgccaacaggatgacatgaaatgatgtactcagaagtgtcctggaatggggcccatgagatggttgtctgaaaaaagagcttcttgtccctgtaagaggccatttggattgaagtcccggaccgtgtgggtaccaggtgatagtactacatcttccccctggggatgtgacccaatttggatttccctcaccctacattcgggcggggtatggtcttggccctaagcccttatgggggtggcccgtttgtgggccggtgtggtccgccctaaaaacccatgttccctcaaaagaatcattttgtttccccaacactgggttgctgaccaagaagtgcccaggaagctgaataccatttccagtgtcaatacccaggggtggggtgacggaaaggggtcttttgaaactgtggaaaggaacatcccaaaaatctctggtccatgaagattggggtgtggaagggttaccagttggggaagctccgtctgtctttttccttccaatcaggggctcgctcttctgattattcttcagggcaatgacaaataaattcgtaataattcggttccccggttcccaggccagtaataagtagcctcttgtgacacccagggcggggccgagggaccacttctctgggaggagacccaggcttctcataccttgatgatgtagcccggtaatcctggcacgtggcggctgccatgataaccagacaggaattgggtgtggtggccaggaaacgcaggttggatggtgcatcaatggcagtggaggcgtcgatgaccacaggggagctccgagcattgtcattcaaggtgtacaggtagatcttgtagtcagtgcctggttgtaaacctgtgatggtgtagcttctgacatctggcttgatggttctctggattggagtctggccattggctggaacgggcatcaacttggaagcccaagtgatcgtctaagtcttggttctccnagctaatggtgatggtggtctcagtagcatctgtcacacgagcccttcttggtgggctgacattctccagagtggtgacaacaccctgagctggtctgcttgtcaaaagtgtccttaagagcatagacactcactttcatatttgggtggcctaccattaagtcctgatacaaaccacggatgagcttgtcaggagcaaggttgatttctttcattggtccggtcttctccttgggggtcacccgcactcgatatccagtgagctgaacattgggtggtgtccactgggcgctcaggcttgtgggtgtgacctgagtgaacttcaggtcagttggtgcaggaatagctgtggactgggttccaatcaggggctggctctccatatcatcgtgcaaggcaaccacactgactgtgttactcagaaccccgtctgaggccttgcagctctgcagtgtcttcttcaccatcaggtgcagggaatagctcatggattccatcctcagggctcgagtaggtcaccctgtacctggaaacttgcccctgtgggctttcccaagcaattttgatggaatcgacatccacatcagtgaatgccagtcctttagggcgatcaatgttggttactgcagtctgaaccagaggctgactctctccgcttggattctgagcatagacactaaccacatactccactgtgggctgcaagccttcaatagtcatttctgtttgat

SEQ ID NO: 2110 - DNA, 2873 bp, Homo sapiens
  misc_feature (1)...(2873): n = A,T,C or G
ctgtcagagtggcactggtagaagttccaggaaccctgaactgtaagggttcttcatcagtgccaacaggatgacatgaaatgatgtactcagaagtgtcctggaatggggcccatgagatggttgtctgagagagagcttcttgtcctacattcggcgggtatggtcttggcctatgccttatgggggtggccgttgtgggcggtgtggtccgcctaaaaccatgttcctcaaagatcatttgttgcccaacactgggttgctgaccagaagtgccaggaagctgaataccatttccagtgtcatacccagggtgggtgacgaaaggggtcttttgaactgtctttttccttccaatcaggggctcgctcttctgattattcttcagggcaatgacataaattgtatattcggttcccggttccaggccagtaatagtagcctctgtgacaccagggccggggccgagggaccacttctctgggaggagaccccaggcttctcaatacttgatgaatgtagccggtaatccctggcacgtgccggcttgccatgatacccagcaaaggaattgggtgtggtggccagggaaacgcaggtttggatggtgcatcaatggcagtggaggcgtcgatgaccacaggggagctccgagcattgtcattcaaggtgtaccaggtagatcttgtagtcagtgcctggttgtaaacctgtgatggtgtagcttctgacatctggcttgatggttctctggattggaagtctggccattggctgaacggccatcaacttggaagccagtgatcgtctcagtcttggttctccaagctaatggtgatggtggtctcagtagcatctgtcacacgagcccttcttggtgggctgacattctccagagtggtgacaacaccctgagctggtctgcttgtcaaagtgtccttaagagcatagacactcacttcatatttggtggccaccataagtcctgatacaacccacggatgaagctgtcaagaagcaaggttgatttcctttccattggtccggtcttctccttgggggtcaaccccgcactcgaatatcccagtgaagctgaaacattgggtggtgtcccactgggcgctcaggcttgtgggtgtgaaccctgagtgaaccttcaggatcagttggtgcagagaatagtggttactgccagtctgaaccagaggcctgactctctcccgcttgggtttctgagcatagacactaaccacatactccactgtgggctgcaagccttcaaatagtcaatttctgtttgatctggaccctgcagtttttagtttttgtggtccctggtcccatttttggaagtgggtggttactctgtaaccagtaacaggggaacttgaaggcagccacttgacactaatgctgttgtccctgaacatcgggtcacttgcatctgggatggtttgtcaatttctgttcggtgaattaatggaaattgggcttgctgcttgcggggctgtctccacggccagtgacagcatacacagtgatggttataatcaactcccaggtttaaggcccgctgatggttagctgtagacttgctccaaggcaacagtgaactcctggacagggctatttcctcctgtttctccgtaagtgatcctgtaatatctcactgtgacagcaggagcatcccagctgatcagtaggctggtgggggtcgcagcaacaacttccaggtccctcggaacatcagaaactgttgattgttggccaatcaataagggactttcctctctgccattaagagcaacgatgctgaccacatactctgtgcctggagtgaggttggtgagggtgatggaattccgagagtggggcacccgatcttctcgaggtctcccactgaagtgctcgggatgatgggcggatcctgtagccagtgatgggtgggctcgaggagcaatcccagtgcacaagtaaaagagttgggcagtaatatcaggaaaagtcaatgccagttgggggaatcaagacctgttttctgtcttcctctaagagggtgtgctctcatgttgttcgtagacactggagacactcactacatattctgtaccaggcaggagatttgttaagaccactgcattgtctgaaggagaaattgacaactctgcaacatcttcctcatttttcacaggtgagtaacgcaccaggaagttggttaaatcaatggatgggggtggagccccaggttgacaccgcattggntgtcctggaccaattgttggtgaatcgcaggtcagtgggaggaggaacagccgtttgttgtgtcagtgtagtaggggcactctcgccgcccatttaatgaagagtgaataacgctgatatcatagtccaatgcccggctcccagccctgtgactgtgtagtatcctactgaggagtccacaaaatcttcaaaaatagggataccttctcctgccgcaactactgtgatgcggtacccaataatggtggaagagtttagcggggtccacctcaggccgatgcttgaatcggttatatcaacaaagcttaggtcagtgagttggggcacctctgggatgatggtatcagagatagggacactttccttgtcatccttggacagtgtaaacactgacattgtactccaggccgggactcaggttatcaaaagtgcaggagctctgatcagcatggaccacttcttccaaagaatttccctgctggccggttggaaggggtgcggtaattctataaccagtaaatggactgggtgtgctcctctcccaggagactgtgagcaactcagtgtcatgtttgcctcaaaatgcaagtttggtgtgggagaaaatgtgt

SEQ ID NO: 2111 - DNA, 2806 bp, Homo sapiens
ttttttttttttttttttttttttttttttttttttttttttttgggcaaacctggaagtttatttgctcaatgtacgacaggtgacataatgactcacattcatgatattccatcactgaggaaactgcttaaagatggtcccgtgtgtgaaataattccttagagaaaccacgggagctggaaaaataatcactcgattagaccttaaaaaatagttcactggcataacatgacaaaaagcacaaaggctcattcagaggaacatatttgttgttctccaacactggtaataggttataatttcaccatgacaaacaccagaccatttaggattaaggctaacactgggtgtttcttttggctcccccccttttaaaaacaaaatatataactgcatgtcactataggcaacatccaaaacaggatccaatttgttacaatcactatttgggtagagcaaactttacccccaaaaggaaaaattaaattaaaaaaaaaaaaacctttaaaaaatttgaagacttaatttttttttgtcataggaatacataacaccctacagtataagttaatccaatttccaagcctactgtataggaaatacaacacttagcatgcacaatattgtatcaattagagtaatggaggagtaatcatttcactggagagacagtatcataggcaagtgcatttctttaaaaataaagaaaagaaaaaccattcaagctgcttaaatatcaagtctcccattccctctccgttttcagccctcaggtgtgatttttatcttgcattattctaaaaagcagccagagccaaagctgaaatttaaaggaaaaataggttttgtaattccagtaaatcatttccaaatgctacaaggaaaaacgcaacactgctcactggacatgaagataaattagggaaagccccacctaccctgccccccccctccccccccaaatcgtcttcctcccatggcaatgactttaggcgcctgtgagaggcacaaaagcggcaaagcttcttcctactagttcttctggtaggctttcacttaactgggacttttactctagcgtgaggagggggcctcctaaggaaagtcatgctgggtaaactgtgcgatgttacagagcacattgagtctgtggtcatcgtggttcttctatcttcactgtcacctgtatcctgttacacatactcagttcctaattgtaagctcaattttggtattaggaaaagcatctgtcagtttttcctcaattactcacacctcttcttgcctaaataaaacaaagaaacaaagaaaacaagtgtggtgtcattacacgtctcgggagttcctcgtcactgactttatatatataaaaaaaagaatgcacatgcgggccacgttcacagatagacagattcacccgaaattgaggaatgaggggccttaaaggctgcccgaaaaacaaatgggtggaaattagcaacgttgttttccggtcaattccaattgtgcactggctgcgttgagacaagccaatctccaattcctatgcttttttcattaaaaagaaaaaactatctcgagaggaaaaagttctggtcaaataggagttcagtgtttgttatctggtaacagtttttttatcttcctacaattacttggggaaaggagtgtccttcggggaggaaaaaactgacacactggacaaggctccccgaaattggacagaatggtttaaggatatagctccttcccttttgggtttttcctaccagtaggcttcctagcacctgaattttcacacactgcaccacagaccttctccaaacgcctctccgaccccacagcttctgcacccagctgcgtccgccagcacgaggcgcagtaggaaacgccccagtgcagagtgggtgacggcagtgttgatccctgaggagggagctgcagcagctttcagaagcgggatgttctctgaaaataccaacacgatccatgacatacagacctgaattttctctatttttgtggcgtttcacgtttctctcaagaggattaataattttggtggtggatttacgttaagaggaaagaaggaccaaaaaaaaaaaatcccacagccacctgccgagcacctatgaaccaaaaacctgaagtcgctttcattctcatttagcctaggagaccgatcaacagcaaaaccaacctggataaggctgaataaggatgttaaagcccaaacaactagcaaaggaaaagtacacaatcgatggcttgatgttacatatggctgtaatgtagaaatactgtaaactgcaatttagtgttaatactgtcaactaatcagagacttcggaaaactggcaaggcctaaaccataaggatgaatgaagacctcaggttcctaagtctgtcagtctgggatttacactgttccatgtctgtaggctacaccctggaaaacatgcagagccggagacagatgagatagaaagtacccaaaacggagagagacgagagcgtatgtacataaaaatccttactggaaccacagaacttactgaatgagggccattcctcttttaagttttcttttcatcatgaaaaccctattatctagcaataagttaaattagagacagacagctccacttgcatgaatctacagaacagtccagacgccagtgtgaggctgctattccaataccagcacagctagcctgactttccactagtggtattttggcaaaaatgtcaaagaggcgatcaaagacaggacaggtcgtgggtttctccctgggagggatga

SEQ ID NO: 2112 - DNA, 8339 bp, Homo sapiens
  misc_feature (1)...(8339): n = A,T,C or G
gcacgagtattcaaatacttttaatatcttagtcatttttatttcccttgcaggcaatctctttgaacagaggtttattcaatgaaggaaaggtggagggaagaagggaagaattacaatggttagaaaagagcaactaaagattatttctattatacttctgaacggtaaactagcaattttaataaatattggggtccacttaaatctattaaagcagaaagtgtaaagctatctccattagtgaagagatgaagtgacaaaaaccaatcagtttttgtaggcaactgatttaggaaaatcttgtactgaaatcaacaattagacttgcacatcataggattttcaaatgtttgctgaattgaaaaagaatattcacaggaattatttcccccgaaggtgtcttatatcaaatagatgaacttcaagttgtggaatgtaaatcttttattaaaacagttggtcctttccccacagtagtaaaagcctttgggccacatacagtaataaaaaaataatcaccccacccataataatacccaaattccctccttatcaaactgccatacctaaggtgttttcaaatacaattgtgtgtgtgccgtataaaaatactggggaaaaattggataaaataaacaggtaaagaagaaagatatttcctagggcaattaactaaggatccatttggaaaaaagtgagtacgtgtggatatttaaaataatccacagtaaacaagatccatgccttgttccctacaagtattgcgggcccagacactttaagtgaaaagccagaaagtgtttggggtgactttccctacttaaaattttgggtcatatcattttcaaaacattttgcatcttgggttgggctggcatatagctttcctattgatccccaaaacccaaaaatctttagaatcacttcattttaaaatactgagcgggtattggaataccttcgaaagcagaacagggcaatggtgcagcccctcatttatggagaaaacccctcaggaaacttcccaggggtgatgcttgggagaagcctgtgaagttggagctgaagctgggagaacttcctccagagcaaaggggcttaagaatagaaagaagaactcctaaactgggtctgcctaaacatcaactcccagtttaagagggaatcttggccagagagacatgcttgttccctctggaatggaaaagatgattttactctcggggaatcttctctgtccagcctgtaacatcctaaaaggcaatgaaagcaactcaaattgggcaaattaaacaattagtgtttgttcctcctgaatggtatctctgaagaatactggttgtaaggactggccaagtagtgccttcgggaactgggttcaccccccaggtctgcggcagttgtcaaagcgccagctcagctgcactccaaaagcatgtgcaggagcaaaatggcaccgaagaaaatcccttctggccaactggttctccctacgtgggtatgtcttccccatcatcaataacacgttgcctcatgaggggtcacacttgaattcccccttttccgttccccaagacatgtgcagctcatcatctgggccattttctccctgacggtcccaattctctccaatcttgtagtttcgcaccattgtcatggcaccatctaagatgaatcacatctgaaatgaccacttccaaagcctaagcactggcacaacagtttaaagcctgattcagacattcgttcccactcatctccaacggcataatgggaaactgtgtaggggtcaaagcacgagtcaacccgtaggttgggttcaaagcctccgttgacagagttgcccacgggtaacaacctcttcccgaaccttatgcctctgctgggtcttttcaggtgcctccacttatggatgttgtagggtggggcacctctggtgaaggcctgtcagagtggcactggtagaagttcccaggaaccctgaactgtaagggttcttcatcagtgccaacaggatgacatgaaatgatgtactcagaagtgtccttggaatggggcccatgagatggttgtctgagagagagcttcttgtcctacattcggcgggtatggtcttggcctatgccttatgggggtggccgttgtgggcggtgtggtccgcctaaaaccatgttcctcaaaagatcatttgttgcccaacactgggttgctgaccagaagtgccaggaagctgaataccatttccaggtgtcatacccagggtgggtgacgaaaggggtcttttgaactgtggaaggaacatccaagatctctggtccatgaagattggggtgtggaagggttaccagttggggaagctcgtctgtctttttccttccaatcaggggctcgctcttctgattattcttcagggcaatgacataaattgtatattcggttcccggttccaggccagtaatagtagcctctgtgacaccagggcggggccgagggaccacttctctgggaggagacccaggcttcctcaatacttgaatgaatgtaagccggtaaatcccctggccacgtgccggctgcccatgaatacccagcaaggaattgggtgtggtgcccccagggaaacgcaaggttggatggtgcatcaatggcagtggaggcgtcgatgacccacaggggagctccgagcattgtcattcaaggtgtacaggtagatcttgtagtcagtgcctggttgtaaacctgtgatggtgtagcttctgacatctggcttgatggttctctggattggagtctggccattggctggaacnggcatcaacttggaagccagtgatcgtctcagtcttggttctccangctaatggtgatggtggtctcagtagcatctgtcacacgagcccttcttggtgggctgacattctccagagtggtgacaacacccttgagctggtctgcttgtcaaagtgtccttaagagcatagacactcacttcatatttggtggccaccataagtcctgatacaaccacggatgagctgtcaggagcaaggttgatttctttcattggtccggtcttctccttgggggtcacccgcactcgatatccagtgagctgaacattgggtggtgtccactgggcgctcaggcttgtgggtgtgacctgagtgaacttcaggtcagttggtgcaggaatagctgtggactgggttccaatcaggggctggctctccatatcatcgtgcaaggcaaccacactgactgtgtactcagaacccggtctgaggccttggcagctctgcagtgtcttccttcaccatcaggtgcagggaataagctcatggattccatcctcagggctcgagtaggtcaccctgtacctggaaacttgccccatgtgggctttcccaagcaattttgatggaatcgacatccacatcagtgaatgccagtcctttagggcgatcaatgttggttactgcagtctgaaccagaggctgacgtctctccgcttggattctgagcatagacactaaccacatactccactgtgggcttgcaagccttcaatagtcatttcttgtttgatctggacctgcagttttagtttttgttggctcctggtccatttttgggaagtggtggttactctgtaaccagtaacaggggaacttgaaggcagccacttgacactaatgctgttgtcctgaacatcggtcacttgcatctgggatggtttgtcaatttctgttcggtaattaatggaaattggcttgctgcttgcggggctgtctccacggccagtgacaagcatacacagtgatggtataatcaactccaggtttaaggccgctgatggtagctgttagacttgcccccaggcacagtgaaactcctggacagggctatttcctcctgtctctccgtaagtgatcctgtaataatctcactgtgacagcaggagcatcccagctgatcagtaggctggtgggggtcgcagcaacaacttccaggtccctcggaacatcagaaactgttgattgttggccaatcaataagggactttcctgtctgccattaagagcaacgatgctgaccacatactctgtgcctgggagtgaggttggtgagggtgatggaattccgagagtggggcaccccgatcttctcgaggtctcccacttgaagtgctcgggatgatggcggatcctgtagccagtgatggtggctcgaggagcaatccagtgcacagtaaaagagttggcagtaatatcaagaaaagtcaatgccagttggggaatcaagacctgttttctgtcttcctctaagaggtgtgctctcatgttgttcgtagacactggagacactcactacatattctgtaccaggcaggagatttgttttaagaccactgccattgtctgaaaggaagaaaattgacaaactctgcaacatccttccctcatttttcacaggtgagtaacgcaccaggaagttggttaaatcaatggatgggggtggagccccaggtgacacgcatggtgtctggacccaaatgttggtgaatcgcaggtcagtgggaggaggaacagctgggatgatggtatcagagatagggacactttccttgtcatccttgacagtgtaaacactgacattgtactccaggccgggactcaggttatcaaaagtgcaggagctctgatcagcatggaccacttcttccaaagaatttccctgctggccgtttgtaggggttgtggtaattctataaccagtaatgtctggggtggtgctcctctcccaggaaaactgtgagcactccagtgtcagggtttgcctccagatgcaagtttgttggtggaaacaatggtgtcacccactttgtttacaattggcgcatctctttcctgtccatctctcaggacttggatggtgtagacgtattctactccctggaagtcaaagccggacacaacgaatgcttcctgagtctgaagtcacttctcgtggtgcctctcctccctggcttggtcgtacacccagcttaaaaccaaatcttggagcaggcgtccatgtgatcacaatggtggtctcagtcacctcggtgttgtaaggtggaatagagctcccaggctgcagtgtggtaaagactccagtggctttggggctctcttggttgccctttatggccacgagggatacggtgtactcagatgcaggctgcagattcctcagtgggtacttggagacagagggacccacattgtactgcctgggctgtcctcttcgggtaaggcccacggtcagtcggtatcctgttatctgggcccggaagtggagtccatctcaaccaaggacagtagaatcagttttcatttgacaaacttggaggttagtgggagcatcccagtttggttgtctgttgagcagtcagaagcttgctctccctcccagtggctcactggccaaagactttgaagtaataggtgaccccaggggacagcccggtgacttctgcgaaaggtgttcctgctgagtggcagcctctgcccgtgctcgccaggcaggttgacggggatcacatccacacggtagccggtcactgcactctcaggcggtgtccacatgatggtgaccttcacgtctgtcacttccacaaactgcaggtccctgggagagggcactgtatctgagcgtggggtgccagtggtttcttgttgaatgacaacaggtgtactttcttgattttcttccacagcatagatagtgatgttatactgaacaccaggttgcaagtcactgagggtgacggagtttgcagtttcaggaaggttgagttctgtgctgctaccttctactgatggcgaatagactattctgtaccctgtgatgggagcctggggtctgctccagcgaacaacaattgaggtgtcatcaacttggtccacagtcgggtcaggaggggcatcaggcgctgttgtttgtgaagtagacaggatcaaactctgctccccatcctcagatatctgatagacatttacaatgtattttcggccaggaagcaggtccagggatgttccacagaagtggctgtgcttggaagaaccaggtactgtggctcatctccctcctcactcagctcatattccacccggaatcccgacacggtgtcggaagctgagacccaggagaccacaaagctactggctgtgatttcggtcacagattcagaagtggccacaagaggagaaaagggagtcgtctctcctgtcacgggtgttgctggtcacaggtgtgctggtgctggtggttgtgaagtcaaagcgagtcaattcttggtggccgtactgctggatgctgatgagctggccctcgtatacccacacccaggcttcaggcctttgatggtgtaggagtttaagtggcctggtatggtagcttccttccaacggcctaaaagaatttttaggtctcccacctgagaatgtacttggaaatgtgagatggctgtggtgcattccactggatgggggggaagtttgggctgactcgggagtctcagtgataaatacttcgacaggaccacttgagcttggataggtctgtaaaggttggcaatgccacttccccaatgccacggccatagcagtagcactggtatctgacaccatgcacatacttctcccatgaatctccaatttgataaaacgtcccagtctctgaatcctggcattggtcgacgggatcacacttccacctgccccgaccctgaccgaagcatgtacagttcagcatgtgcccctcttcatgacgcttgtggaatgtgtcgttcacattgtaagtgatgtcatcaacaatgcactgatctcgaagttgcgagtaggcaatgcatgtccattccccacgaccattcccaacacacgtgcacctcatcatgtgacccatgtcatgctgcttatcccactgatctccaatgcggtacatgaccccttcattggttgtgcagatttcctcgtgggcagccatggggcagaacccaaacttctggtcggcatcatagttctgtgtggtcccacaccacttcatgttgtctcttctgccctcagaagtgcaatcagtgtaattgtggttgttgtataggaaggggaagtggcacaaggcaccattggaatttcctccttgagtctgaaccaaaacagtgtggtctgtgcagaaagagtatttctggtcctgctcataattcgaagttgtgctgcaccaaagatgtccgtcctgtcgcccttccgtggtgcaggagtagaacgtcctgccattgtaggtgaatggtaagacacatggctctccatttaagttgccaccgtaagtctgggttacagctgtctcttggcagctgactccgttgcccaggcacgtgcaaagcatttgcttatttccttgtgtcttcaaccactgcatccccacagagtagaccacaccactgtctgtgacacagtggccatagggaggaggcttgggggtgaggctgcgggttggtaaacagctgcacgaacatcggtgaaggggccagatccgctcgatgtggtctgcacagaggtgtgcctctcacacttccactctccctcggccgttgcctgtgcagatgcactggagcaggtttcctcgattatccttcttgctccaggtgtctccaattctataggatgtccttgtgtcctgatcgttgcatctatttctagaagtgcaagtgatgcgtccgctgccttctcccaggcaagtacaatctaccatcatccagccttggtagggcttctcccacgtttctccgaccacataggaagtcccagcagcatgatcaaaacacttctcagctatgggcttgacaggtccattctccttttccattaccaagacacacacactctaacatgtaaccaccagtctcatgtggtctcctccaggtgtcaccaatcttgtaggactgacccccttcatggcagcggtttgcgatggtacagcttattctccctcgcccagccccgatgcaggtacagtcccagatcatggagtctttaggacgctcataagtgtcacccactcggtaagtgttcccagtgtacttgtcaaagcaagtctcttcagcttcaggtttactttcgcagttaaaacctcggcttcctccataacaagtacaaaccaacacattacctaggtaggtccgctcccactgttgatttatctgatagtgttttccattgtcataacaaccgggcttgctttgactgacagccaccggggactggggctgaaccatttgctgagcctgcctcttgctcttc

SEQ ID NO: 2113 - DNA, 1521 bp, Homo sapiens
  misc_feature (1)...(1521): n = A,T,C or G
ctaaaacgtcgaaaacggcttttcaacggaaagcttccccaacagcaacgcccctgccccctggctttgccttctcgccttcctcaaaagcaggactgctttcttacccgacaaagaggtggggaaaacaccgcgttccccccattgtccgtaaaggaaatcccaacaggcaatgcaaaacaatttcaagtattcaagtggaggttctccccaggcaaaattcccactaaggaagaggaacaaggaaagactgcacgtcctcatgtgacatggatgacatggaatggggcgaggccaccattaccatgatggcgcggctggccccggactgacctcgctgtgtggctgcaaagccctgcagacccaagctccatcctccaaaggctggaggctggtgacccttccgacatccatccccgggtcccctgatgtgggaaaggggaagagcccacccctggaccccaaaacctcaggcctcccatctcaagggtcaacgcgggcgatttgccaggctaatgccgtgacgtggcgcttgttccttccctggttttcccactcaaattcagcccaagaggtgggcgggggctgcgggcagccctggcccacttttcctaaaaagcacaactttcaattcccaccattgaaaagtgagctgtgccgggcgtgagctcactcacagcgctttctagtgttcagagaagcctcgggtcacccacgtgcctgtcagagtcctgagatcacaacaaaaatcctgcgaggactcggctcagctgacacgtctgttttgcttttgcctttcaaactggcaacgatggggagaggttggtcagaaggcaggcgggaggagtctgaaccatgactgcttgaaaataagcctctattgtccacaccaaagccctaaggcaggtaatcaaattctctcccaaattccctgaaaaccagttcccctttccctgtcccagtcaacccagtcactcatgcacctccatcaggactggctggtgaacacgcctgggacagcatctgaacgcacagaaggatatgggatgaatgcagtggctctggggactcacgactaacattttctaggattccgctgaggctggttttatttgaactgcactgggcccacgtgatccagaactctgtctctgagtgtgcacccagagctgtgtgtcagagagcaggtgtctgatgaggcggggccctcaatcttcagtgcttccttccagcttcctgatgagctgttggtaggtgtctctttccacctgccatgaatgatacattctcacgtattcccttccgttcactacgatttccttttctaatgcaggatcactaaccagtctctttgccagatgaacaaactcctgagggattgggaaaacagtaggccctgtggactttcatgcttcaccacgggcaggcnttcccgggggatgttcngggggccaataccgggnacttctaaatccattgcctccaaaattgcaggctggacatggccttcaggggacaggg

SEQ ID NO: 2114 - DNA, 1961 bp, Homo sapiens
ttttttcatagtacaagattttatttgctaagctttacaaattaaactctaaaaaattattacaatgatactgaaagatattttattggccttttaaaagacaaacacaaatgagaattatcttatttagaaaattaactttgaaaattatcttaaatgaaataaatataatatctaatacaatctcttcctgcaagatctcttaagatgggcaatcctaaaaatgcagcttcccatctgaaaatccctaaaactagtatgtcccttaaaataaaatttatttttcttataaaggacatttggtattcccacattttcttaaaatttgtcctaaaacaaattctatctttaaacactcacgtttctaaatatatatatgtgtgtgtgtatatatatgtgtatacatatacacatatatatttagttcacttaatttaaaattagtgaaagctatctggacacaatttctaagaaaacattgcagaaagtaagttatgcatggttatttacaggaagagttttcctaaataataatgtaaatatcatgttcaaaaatctgacaaatcctttctaataatcagcactgcaggtttcaatacaccttatataacaaaagatgtttcatgtgtagaactgccagatgagtctaagagccagaaactaaatcatttgacatggttaagaatttcatttttattatactaaatgtcaggtcagaagtcaatggcatttacaagctggaagactgtttatccactcaactctttcaattatatcaaacactgattaaccaaatgtgactggacttaactgctacaactttatggtttctatcaagtatatgcaaatatcttaaatgggcacatatgcatatgtgcaaaacaaatgaaatatagatacttaaagaatgaacagaaatggcttgtaagcaaaaaccaccctgccattcaatttcgaaactctgtcttttcttcactaatttgtcttctgttattagtagtcttctattaaagttgtaggtttacagatgatctggaaatttcacattggtataagaaaggaatgtcgggttgatgcagtctctacaataagaagaaataccttgttctatgagcagctgccatactttcagacatgtttctgacttttagataattaacaaatcctctgaagaaaaggagcaggccaagtacaagaaatatccaccaaagccaatactgtccattgaaatatccagtaaaataatcagaaaacctgacaataaggatccatttgatcaaggaaaggccaaatccgcagatagcaccataccttccagctatggtattggtgatacagaaggataaacaaaatccaagccagttgaaaataaatgccatgaaaaatgccagcatgaaaatgccatcattccccactctgagctggtctgcatcactgaagtcatctcttggtggacactcttcctcctgaattctttgagatgtttctgctgctgcagctgccattgcagcagctttagccttctcagcttcatcgtatgtaggaagagaggtagcaacgctatagggaggtggcacgggataaaactcaccgtaaacttctgtatctgaagttgtaggtacttccacagtaatactactatatggtggaggggaagagtcagtttcaagtgctggtgctgaagacgcagcctgcacaatctgcggtgctgggtttgaagtaggtggctgctctatagccgatgattctgagttatcctcttcattaagaagcacctggtagcgcccagtccccggctggtggtgatccatcctgcccggctcgggatccggcttccgagagagggagtcttctccgtgctcagctcccacggccacccccgtcgacgacgtcgtcgccgcagggccccttccgcctccgttcctgcagccgcggtctcccggcggaagctcttcacttcc

SEQ ID NO: 2115 - DNA, 302 bp, Homo sapiens
gaagacgcagcctgcacaatctgcggtgctgggtttgaagtaaaaaaaaaaaacccccccgatgattctgagttatcctcttcattaagaagcacctggtagcgcccagtccccggctggtggtgatccatcctgcccggctcgggatccggcttccgagagagggagtcttctccgtgctcagctcccacggccacaccacgtcgacgacgtcgtcgccgcagggccccttccgcctccgttcctgcagccgcggtctcccggcggaagctcttcacttcctgtgctcccgcagcggcgca

SEQ ID NO: 2116 - DNA, 273 bp, Homo sapiens; identical to SEQ ID NO: 1230

SEQ ID NO: 2117 - DNA, 6134 bp, Homo sapiens
caccttgacacataggccacttcctgagcctggacccagtctcagagctggggaactggcccaatgcaaaagggtcgggagcatctgcaacagagactgagctctatcagcttcggtgacatagcctccattcacgctccccaactcagcagagagagcacaccatcagacttctaagacttagtagccaagaagtgttgaattaaactctctgagacctctctttagtctgaccctggcagcctcagtctcccagagcctgtgggaactcggcagccgagaggcagaaggctgggcgacgtccggagaagaagaaacgggggaagaacttttctcttacgatctggctttactctcacgcgcacagccgagtccctggggacccagcagaggtccgaagcggagcggggcggggcggggctacggaagctggcgaggccgagcccctcctagtggttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcggggtgagtgagggtccgctgcactgtgggaccgggcgcgtgggcgggaagtgccgagcggctggggaccggctctagggacggttccctccttagggctatctctcacaggagggcctgtgcatgcctgtgtgtgtgtgtgtgtgtgtgtgtgtgtgtgtgtgtgtgcgtgcgccggggtggggggggggtgcagtgcagtgtagactaggggctcacctggtgcagagaaagtcaccaagtcagggaccctccatctctgacacgacctgcgggccatctcttccagctggcccacgccatgcgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatcctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaaggagggctgggtctctggggaggtttgttttcacttcttcttccccacggcagctcctgactatgacagaagccagtggctgaatgaaaaattcaagctgggcctggactttcccaatgtaggtgcaggggaaggggcggttttgggggaaagtgcgacgtgtctctgactgcatctcctctccccagcttagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggccccaactgagcttccccggtttcccatctatccagctgccctacttgattgatggggctcacaagatcacccagagcaacgccatcctgtgctacattgcccgcaagcacaacctgtgtgagtgtggttggctgcagtgtgtggggggaaggtggcatcctccttggctggattggggtgctatgctcagagtgagtctgtgttttgtgggtggcaggtggggagacagaagaggagaagattcgtgtggacattttggagaaccaggctatggacgtctccaatcagctggccagagtctgctacagccctgactttgtgagtccctccctggtctggaccagaagccaggcttgtattcccatctactctggtcctattcacaatttgaactcctcactgctattgatcctctgagggttccctgtactgtagcagagtgactgtcatatcattaaacttataaaataaaaacttgaaatcagtccccaccaatcataggaagtcctttgaatcaaagctagcaattcagttcctagacaataaagtcatgcgttcaagaattcccttcacctctgacccctgacctctgccacgggccatctaacccagctggttcatgccatctgcctgttcggggaatacgcagactcacactatggggtaaagaagtatgtagtgggatgtaatagcaccctcctctgtggaattccgtgctattcttttcctagtgcttctccttgacacgcacagggatgaatgcattttcctaacaggcagctcaggggcggccagagggcctttgttcctctgtctccttccatgcagcctctcaaaatctcatctctccagaaactactcaatgtccattgtattattctgccactgcactaggaggaactttcaacttctttctctgagctcctttagttctttgtatccttgattttgctcgtgtctgggtccagagcctgccaggtactcaggtgctcctgggctgacccagaggagggtggttgggaggtcagtggggacagattcagggatagtgttgcattcctctctgccttcccatcaccacaaaagcctccagctacccatttggagtgtaataaatgctggtatgtccagctgaagccagttccagctgtggggaagatggctgcttgctcgtggccagctggggccatacacagccctggggaggccacatctgtgcagggagcttgtgtctgagggtggtgacagctgttttctgcctcaggagaaactgaagccagaatacttggaggaacttcctacaatgatgcagcacttctcacagttcctggggaagaggccatggtttgttggagacaaggtaatgggggcatgtgatgaggacactagagatttgccatacatcctatgttacagagattccagcccacacattcttggccttctgcagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggatctgcataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggctcatccagcctggatttcacagcccagggcactttggaagaggcagagaactttaggagcatggatgcagctggcaatagtaggactgacacacggtggcattgacgtcgagtacgaaacccacaggcagtattcatagctactcccagaagctttgcacgatcagacccccacgtggggaatcctgagagccagagctgtggccagagctggattagggtacatatgtgggtgcccctgttgaaggagtgtatgttgaagtgctctgtgctggggcactctccttctttatcttttttcctctcttttttccctccagtgttccaagtgttccccctgtgagatgagtagcacactgattttactgctattcaccgaccttctcctctgcatgaggcagggtgtgaggcacagtgggagttgcatagatgactgccccatcctggaaatgagtgcagtgagaggcctgcaggcagagcagcctgtgaggtgtgtggcaccacctgggtaccaggcctggggcctgcccctcactcatggggaaccatccctcacccgtgctgaatttgtttgagagcagcaaatcctacttttagtacagatgtgagaatttgaggcattagtccaacaagtttttcagcctagaatttgttttcctttcccactacccatcaagggatctggttactcagctagttcccatcagctctggctgtggtctcggctgagtggccttggggttatgtaagaggtagtgggaggggaagagagctgagggctgcagcatatggtccacctgggcttggcctttgggaataggcagccctggctctctctgaatccttagaaattacacggctatttgatcctggaaagatcgtgcagagcacacctgagtgtcatacagcctggtctgaggtagtggggttggagatgaggtgggttggggcacagtggtgtttagctcaggtaccaggtggggaggtttagactttctgctttaaaaggaatgattagagcctggtctggcgtttcttttgctggtccaacacaccttgaccactttcatccaggttttgccaggtccttgggtgagatctgggctctcttccaggctgcacagacattttcagaggtcccctctgtgtgtgcaaacctaggcaagccaggtgcctccctgtgaaacaggagaatgttgtgtagtcagagagtgacaggacctcctgagggatttgggggaggatggggatttgacagaaagaggccagaactggagagagacagaaccagtctacgttgcagctctgtcccccttagtagctatttgagtgtgaggaagttactgaacttctgtttcccacatgagaaatggtgataatagattcagccttgcagagtagtcgagtgggttttctaagcttatgttgtaatttctcttgggtacagagcacccagcaccgtgtagaatcttcataagtgttagctgttactgtggtacaacattacttaaaggaagttggaagagttaactccgcaaatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctgtctcaagggcttggagaagatctctgcctacatgaagtccagccgcttcctcccaaaacctctgttcacaaagatggctgtctggggcaacaagtagggccttgaaggccaggaggtgggagtgaggagcccatactcagcctgctgcccaggctgtgcagcgcagctggactctgcatcccagcacctgcctcctcgttccctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaaaaaaaaaaaaaaaaaatgctcctggcaaaaaaaaaaaaaaaaaaaaaaaaaaaaaaaaaaaaaa

SEQ ID NO: 2118 - DNA, 4593 bp, Homo sapiens
atgcccatgatactggggtactgggacatccgcggggtgagtgagggtccgctgcactgtgggaccgggcgcgtgggcgggaagtgccgagcggctggggaccggctctagggacggtaccctccttagggctatctctcacaggagggcctgtgcatgcctgtgtgtgtgtgtgtgtgtgtgtgtgtgtgtgtgcatacaccggggtgggggggggtgcagtgcaggtagactaggggctcacctggtgcagagaaagtcaccaagtcagggaccctccatctctgacacgacctgcgggccatctcttccagctggcccacgccatccgcctgctcctggaatacacagactcaagctacgaggaaaagaagtatacgatggggggcggtaatggcaccctcgagtctgggccctgccctcacactaagttggcaccaagcaaccgatagtggccacctgtcggtgactctgcaggcctcccttgctggaactgcaggctgtcccttccctgagccctggtgagggagctccttgcaaggcagaatgctggggcgggatgctgggcccccgtctggtaattatgatgggtgtcctcaggcttgcctaaccctggaagccttagctgtgtggggtccagagccctcactggaattctttttctctgaatcctgggatgtggggctgagtggtcagattctagatccacctgtctcaggggtcttcgcactggctccttgggagggtccccaggaaggagggctgggctttggggaggtttgttttcacttcttcttccccacggcagctcctgactatgacagaagccagtggctgaatgaaaaattcaagctgggcctggactttcccaatgtaggtgcaggggaaggggcgttttgggggaaagtgcgacgtgtctctgactgcatctcctctccccagattagaggtgttcggatcaggagtcttctgcccaattcctctcactcctggttgtctacacagcccctgcatgatgttctgtgtcccagctcatttgttcatgtgacagtatttctatgtcaggcctgccatgagcggcacagtggtgcctggtctcccctctgcccttgatatgggaaggagatgctggggagcctgctggcccaactgagcttccccggtttcccatctatccagctgccctacctgattgatggggctcacaagatcacccagagcaacgccatcctgtgctacattgcccgcaagcacaacctgtgtgagtgtgggtggctgcaatgtgcggggggacggtgacctcctccttggctgggctgtgatgctgagattgagtctgtgttttgtgggtggcaggtggggagacagaagaggagaagattcgtgtggacattttggagaaccaggctatggacgtctccaatcagctggccagagtctgctacagccctgactttgtgagtccccccctggtctggaccagaagccaggcttgtattcccatctactctggtcctattcacaatttgaactcctcactgctattgatcctctgagggttccctgtactgtagcagagtgactgtcatatcattaaacttataaaataaaaacttgaaatcagtcccaccaatcataggaagtcctatgaaagctagcaattcagttcctagacaataaagtcatgcgttcagaattcccttcccctctgacccctgacctctgccacgggccatctaacccagttcggttcatgcggggaatacgcagactcacactatggggtaaagaagtatgtagtgggatgtaatagcaccctcctctgtggaattccgtgctattcttttcctagtgcttctccttgacacgcacagggatgaatgcattttcctaacaggcagctcagggtggcagagggccttttgttcctctgtctccttccatgcagcctctcaaaatctcatctctccagaaactactcaatgtccattgtattattctgccactgcactaggaggaactttcaacttctttctctgagctcctttagttctttgtatccttgatttgctcgtgtctgggtccagagcctgccaggtactcaggtctcctgggctcacccagaggagggtggttgggaggtcagtgggacagattcaggatagtgttgcattcctcgccttcccatcaccacaaagcctccagctaccattggagtgtaataaatgatggtatgtccagctgaagccagttccagctgtgggaagatggctgcttgctcgtggccagctgggccatacacagccctggggaggccacatctgtgcagggagcttgtgtctgagggtggtgacagctgttttctgcctcaggagaaactgaagccagaatacttggaggaacttcctacaatgatgcagcacttctcacagttcctggggaagaggccatggtttgttggagacaaggtaatgggggcatgtgataaggacactagagatttgccatacatcctatgttacagagattccagcccacacattcttggccttctgcagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggatctgcataaagaataacttgcatttactgagtgctggacttcatgcaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaccctcatccagcctggatttcacagcccaggcactttggaagaggcagagaactttaggagcatggatgcacctggcaatagtaggactgacacaccttcgcattgacctcgagtacgaaccccacaggcagtattcatagctactcccagaagctttgcacgatcagacccccacgtgggaatcctgagagccagagctgtggccagagctggattagggtacatatgtgggtgcccctgttgaaggagtgtatgttgaagtgctctgtgctggggcactcttccttctttatcttttttcctctcttttttccctccagtgttccaagtgttcaccctgtgagatgagtagcacactgattttactgctatcaccgaccttctcctctgcatgaggcagggtgtgaggcacagtgggagttgcatagatgactgccccatcctggaaatgagtgcagtgagaggcctgcagcgagaccagcctgtgaggtgtgtggcacactgggtaccgacctgggctcccctacactcatggggaacatcctacaaccgtgctgaatttgtttgagagcagcaaatctacttttagtacagatgtgagaatttgaggcattagtccaacaagtttttcagacctaaaatttgttttcctttcccactacccatcaagggatctggttactcagctagttcccatcagctctggctgtggtcgtcggctgagtggccttggggttatgtaagaggtagtggaggggaagagagctgaggctgcagatatggtccacctgcttggcctttgggataggcagccctggctctctctgaatccttagaaattacacggctatttgatcccggaagatctggcagagcacacctgagtgtcatacagcctggtctgaggtagtggggctggagatgaggtgggttggggcacagtggtgtttagctcaggtaccaggtggggaggtttagactttctgctttaaaaggaatgattagagcctggtctggcgtttcttttgctggtccaacacaccttgaccactttcatccaggttttgccaggtccttccctgagatctgggctctcttccaggctgcacagacattttcacaggtcccctctgtgtgtgcaaacctagcaagccaggtgcctcctgtgaaacaggagaatgttgtgtagtcagagagtgacaggacctcctgagggatttgggggaggatggggatttgacagaaagaggccagaactggagagagacagaaccagtctacgttgcagctctgtcccccttagtagctatttgagtgtgaggaagtactgaacttctgttccacatgagaaatggtgatatagattcagccttgcaggtagtcgagtggtttctaagcttatgttgtaatttctcttggtacagagcacccagcaccgtgtagaatcttcataagtgttagatgttactgtggtacaacattacttaaggaagttggaagagttaactccgcaaatctggggaccctaagaggctgtgtgatgcctcagcacttgagcccacgtgga

SEQ ID NO: 2119 - DNA, 2667 bp, Homo sapiens
atgcccatgatactggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactagggctggcctggtgcagagaaagtcaccaagtcagggaccctccatctctgacccgagccgcggccatctctcccagctggcccacgccatccgcctgctcctggaatacacagactcaagctacgaggaaaagaagtatacgatgggggacggtaatgacacccttgtgtccgggctctgcactcacgctgagttggcaccaagcaacccatggtggccacctgtcgtacctctgcaggcctcccctgctggagctgcaggctgtcccttccctgagccccggtgaggagtcctgtggccttgcaaggcagaatgctggggcgggatagtgggtccctgtttaattgggttgggtgtcctcagagcttcccaaaccctggaagccttagccgtgtggggtccagagcctcagcgggattatttgtccctgaaccctgggatgtgggactgagtggtcagattctagatccacctgtctcagggatcttgccactggttccttgggagggtccccggaaggagggctgggctctggggaggtttgttttcacttcttcttccccacggcagctcctgactatgacagaacgcagtggctgaatgaaaaattcaagctgggcctggactttcccaatgtaggtgcagggggaaggggcggttttgggggaaagtgcgacgtgtctctgactgcatctcctctccccagattagaggtgttcggatcaggagtcttctgcccaattcctggttgtctacacagcccctgcatgatgttctgtgtcccagctcatttgttcatgtgacagtatttctatgtcaggcctgcatgagcgggcacagtgagtctggtctccccttgcatataggaaggggatgctggggagcctgctggccccaactgagcttccccggtttcccatctatccagctgccctacttgattgatggggctcacaagatcacccagagcaacgccatcttgtgctacattgcccgcaagcacaacctgtgtgagtgtgggtggctgcaatgtgtggggggaaggtggcctcctccttggctgggctgtgatgctgagattgagtctgtgttttgtgggtggcaggtggggagacagaagaggagaagattcgtgtggacattttggagaaccagaccatggacaaccatatgcagctgggcatgatctgctacaatccagaatttgtgagtgtccccagtgagctgcatctgacagagtttggatttggggccaggactcttgcatcctgcacacattggtcttaagtccctggtaccattcatcctccaagtgctttcccatcatctagcagtatctctacgactccaatgtcatgtcaacaaaagcagaggcaattcccaaccaaccttaggacacgattccaggcattcccagggtagaaatttcagttcctgtatggtaaagtttgtgttcagaatctccttcatcagctctggcctctgacttctgtcctgggtcatttctgtcagccagttcacatcacctgcctgctcctagaatatgcagactcaagtagaagactcaggaatgtaatggcaccctcgaattgcatcttctcctcaacagttttctgagtgctgtcattgacatgcacagggatctgcgcatcttcataacagacagctcagaggcagtcagagggcctttattcctctccctccttcctttcaacttgaacttctcatctccctggaaactagtcaacgttcattgttttcttctgccaccccattagaaggaactttctactttccctgagctcccttagttctttgcatccttgattctgctggtctggatccagaggctgccaggtgcttgggcgctcctggggctgacccagaggctattgggaggtcagtgaggacagattcagggacagcatctcattcctctctgccttctgatcagtttagatagggtctgacactcagtcagagtctaaaatgctgagtatccaattgaagcctgcactgccccagttccagacttggggaagatggctgcttgcccgtgccagcctggccgtccacagccccggggaggccacgtctgtgcagggagcttttgtccgagggtggtgacagctgttttctgcctcaggagaaactgaagccaaagtacttggaggaactccctgaaaagctaaagctctactcagagtttctggggaagcggccatggtttgcaggaaacaaggtaaaggaggagtgatatggggaatgagatctgttttgcttcacgtgttatggaggttccagcccacacattcttggccttctgcagatcacttttgtagattttctcgtctatgatgtccttgacctccaccgtatatttgagcccaactgcttggacgccttcccaaatctgaaggacttcatctcccgctttgag

SEQ ID NO: 2120 - DNA, 1546 bp, Homo sapiens
tccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgtaaaaaaaa

SEQ ID NO: 2121 - DNA, 1130 bp, Homo sapiens
accaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcgggggaatcagaaaaggagcagattcgcgaagacattttggagaaccagtttatggacagccgtatgcagctggccaaactctgctatgacccagattttgagaaactgaaaccagaatacctgcaggcactccctgaaaagctaaagctctactcagagtttctggggaagcggccatggtttgcaggaaacaagatcacttttgtagattttctcgtctatgatgtccttgacctccaccgtatatttgagcccaactgcttggatgccttcccaaatctgaaggacttcatctcccgctttgagggcttggagaagatctctgcctacatgaagtccagccgcttcctcccaagacctgtgttctcaaagatggctgtctggggcaacaagtagggccttgaaggcaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaaaaaaaaa

SEQ ID NO: 2122 - DNA, 1324 bp, Homo sapiens
ggctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgccttcccaaatctgaaggacttcatctcccgctttgaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctaca

SEQ ID NO: 2123 - DNA, 1138 bp, Homo sapiens
gggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatgtggggagacagaagaggagaagattcgtgtggacattttgggagaaccaggcctatggacgtctccaatccagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaaggcctacctggcccctcgcctgtggagctcagccctgagctgtccccgtgttgcatgacagcattgactggtttacaggccctgctcctgcagcatggcccctgccttaggcctacctgatcaaaataaagcctcagccaca

SEQ ID NO: 2124 - DNA, 1245 bp, Homo sapiens
cactaggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctagactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgagggcttggagaagatctctgcctacatgaagtccagccgcttcctcccaaaacctctgtacacaagggtggctgtctggggcaacaagtaatgccttgaaggccaggaggtgggagtgaggagcccatacttcagcctgctgcccaggctgtgcagcgcagctggactctgcatcccagcacctgcctcctcgttcctttctcctgtttattcccatctttactcccaagacttcattgtccctcttcactccccctaaacccctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaaaaaa

SEQ ID NO: 2125 - DNA, 726 bp, Homo sapiens
atggtgagctctactcacagtttctggggaagcagccatgcttcttggggaacaagatcaccttgtggatttaatcgcttatgatgtccttgagagaaaccaagtatttgagcccagctgcctggatgctttcccaaaccctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgttgcagcgcagctggactctgcatcccagcacctgcctcctcgttcctttctcctgtttattcccatcttaactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaaaaaaaaacataaa

SEQ ID NO: 2126 - DNA, 811 bp, Homo sapiens
  misc_feature (1)...(811): n = A,T,C or G
ggttcatggcctggctngcttcaggantgaagctgcagaccttcatagtgaatgttatagctcataaaggtagttcaaacccaaagagtgagcaacagcaggatttatnggtgacgagtgaaagaaaatacacttccacagcctggaagacaacctgagcagagtgctgattggtccgttttacagagtgctgattggtctgtttttacagagtgctgattggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcacgtggactcgtgcatcccagcacctgcctcctcgttcctttctcctgtgtattcccatctttactcccaagacttcattgtccctcttcactccccctaaagcccctgtcgcatgcaggcgctttgaagcctcagctacccactatccttcggtgacatcccttccatcattacccttcctgcactaaagccagctgaccttccttctgttagtggtgtgtctg

SEQ ID NO: 2127 - DNA, 461 bp, Homo sapiens
tactctgttcactaccttctcctctgcatgaggcagggtgtgaggcacagtgggagatgcatagatgacagccccatcctggaaatgagtgcagtgagaggcctgcaggcagagcagcctgtgaagtgtgtgctgaacttgtttgagagcagcaaatcctacattactacagatttggggatttgaggcatttgtccaacaggcttctgagccttgaatctgtttcccttttccactccccatcaagagatctgcttgctcagctagttcccatcagctctggttctgcggttctggtccaggctgagtggccttggagttaggtaagaggtggtgggaagggagggatggaggagagctgagagctatggcccgttatgtgccagggtcaagcctgtcacccaagatcgtgccactgcattccagcctgtatgacagagtgtgactccatctcaagaaaa

SEQ ID NO: 2128 - DNA, 468 bp, Homo sapiens
  misc_feature (1)...(468): n = A,T,C or G
agctctactcagagtttctggggaagcggccatggtttgcaggaaacaagatcacttttgtagattttctcgtctatgatgtccttgacctccaccgtatatttgagcccaagtgcttggatgccttcccaaatctgaaggacttcatctcccgctttgagggcttggagaagatctctgcctacatgaagtccagccgcttcctcccaagacctgtgttctcaaagatggctgtctggggcaacaagtagggccttgaaggcagggaggtgggagtgaggagcccatactcagcctgctgcccagggtgtgcagcgcagtgggaacttctggcatcccaggcacctgcctcctcgttcctttcttcctgttttatttcccatgttttacttcccaaggatttcanttgttccctnttttcaattgccccctaaaaacccctgttcccatngcaggggccctttgnaa

SEQ ID NO: 2129 - DNA, 579 bp, Homo sapiens
  misc_feature (1)...(579): n = A,T,C or G
tgactatgacagaagccagtggctgaatgaannattcaagctgggcntggactttcccaatgtaggtgcaggggaaggggcggttttgagggaaagtgcgacgtgtctctgactgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttttgaggcctttagcctctgaatgataccactggctttcctgcttctctatcctgcagtcggcagatcatgggacttcttcactccaaaattgtgtgagccaattcccataacagatagataaatttataaataaacacacaaatttcctacagccttaaaaaaa

SEQ ID NO: 2130 - DNA, 417 bp, Homo sapiens
  misc_feature (1)...(417): n = A,T,C or G
ggggaaaaaggggggggnaaaaaggccccccaaaaaaccccttntgctgccttgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatg

SEQ ID NO: 2131 - DNA, 412 bp, Homo sapiens
tggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagccctttgaagcctcagctacccactatccttcgtgaacatcccctcccatcattacccttccctgcactaaagccagcctgaccttccttcctgttagtggttgtgtctgctttaaatgcctgcctggcccctcgcctgtggagctcagccccgagctgtccccgtgttgcatgaaggagcagcattgactggtttacatggccctgctcctgcagcatggtccctgccttaggcctacctgatggaagtaaagcctcaaccac

SEQ ID NO: 2132 - DNA, 324 bp, Homo sapiens
aaaacttctaacacagtgatgactggaagaagccagggacagggagtccatactgtatgattccatttatgtacatttcagacacaggcaaatgaatccatgccactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacatttaaaaaaaaaaaaaaaaaa

SEQ ID NO: 2133 - DNA, 209 bp, Homo sapiens
  misc_feature (1)...(209): n = A,T,C or G
acttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttggcttggngaagatctctgcctacatgaagtcc

SEQ ID NO: 2134 - DNA, 169 bp, Homo sapiens
ccacgccatccgcctgttcctggaatacacagactcaagctatgaggaaaaaaagtacccgatgggggacgcccctcgcctgtggagctcagccccgagctgtccccgtgttgcatgaaggagcagcattgactggtttacaggccctgctcctgcagcatggtccctg

SEQ ID NO: 2135 - DNA, 14 bp, Homo sapiens
ccctgcactaaagc

SEQ ID NO: 2136 - DNA, 13 bp, Homo sapiens
  misc_feature (1)...(13): n = A,T,C or G
ggccatagnttgc

SEQ ID NO: 2137 - DNA, 462 bp, Homo sapiens
ctcctgtctcttttaagacactgtaagtcaatgtggttttgtactaagaggcgctggacgtgacctagaaaagctccagccctccaaagtgtctagctgatacctaaagggtgtgttcattcattgagctctgcagttaacagagaaagacatgggctgaagcagagtgcactcccgtcggatgccacgaatagtggtgagattcagggtgttaaatctgttgtatgccatagtctttccaataagaattataacatttccaaacatcgactgcttttcagggtcaagtattcaatttaattacacttctgaatacagaactaggaggggactaaggcgatttcatgcttgaggttgactatttcctgcagtgtgactagggcgcgtgctgaagattgggagatggatctgagaagtgggcgagaggtcaagtcttgggacacattaaaattcttattggaa

SEQ ID NO: 2138 - DNA, 3662 bp, Homo sapiens
aggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataataaaaaaaaaaaaa

SEQ ID NO: 2139 - DNA, 3802 bp, Homo sapiens
atccttcctagtactcacactcatactatttcttaaatcttttctagtattcacattcatactattttttaaaaagaagatttgcttgctctccaaaattggtctccttaacccaattaccaaaaattaaattatatctataaaaatccttattgtccctggtgcttaccctgtatgaccagttcctgctgatttgcatgttcttatctagggatcaaatactcaactgacttatggcgcttctgaatgaatataccagtcagttactataactgaagcaagtttagggaactctggtggggttgatagaacacaaccaaaacagttacatgtaatccagtttataatctgatccactttcaggatagctggacagtcagggcagggatctggttccatcaagaatggcctaaaagtcttggatgggccatacctcagaagggatcgacagggaaggtgaacacagcctctgctagggatattaacgtgtcatttgctaacatgactgcctcctttttatttccatatagaataaaggagagttaataaacaagacttagtaagacagcactttaaaaaattgcacttgtttatggaagcaaacagccattattgttttgccatgtctgatttgtaggtaatcctccatctttcaccatttgttaaaataaaggaagaaggaaattaaaaggaagtttctgccttgtttgcaccacatacgtacctttgatacaggaagcatattttcaagggaccaatctttaagacacatcctaccctggcgaacaacccttggctgttcttgtttttaaatacaaagcaactataattggattccccagaaagagttttaaaacagttatattatccttttttttcctgctgggatagcattgtccaaaagtgctttgttagcaatttcttagaaaaccctcatgaactataaccccctcccaccccatcccccaatgcctaaatataaaacacaaccccaacacaatactctgcaagttttctggctttaggttgtaaggaaaagagccagaaaaaaaagaaagtctttgctttctacaggagctgcttttcctcttaaggaaggacaggaaatgataggtttccaaacctatccctttgctgcgtagcaagcaggtgctaggagaggaggcagctcactgctccactgctcctgattagaaaggtagggtgtccaggaagagcttgtcaatgatggaaggtggagacaccaagtcttccagcttcaggtagaagatgcgctggaggcccagggtgcagatcttcctcagttctaccagggcacccaggaccttggactcggtgggctccagagcctgtcccttactctggtggtcttttaaactgcttgtgatcttgttgcatagctcttcgactctctttggttcttttaacccatgtctttctgtgatcatgctcagtgctgacaggcaggctaaggcttggatatcaaggttcaggctctgcaaatttaaggaaaagtctttaatagagtcgagccactccccaaatccacgaaggcactgaagtcgatgcaggacaagtccattgcagaacacaaacttatcttcagcagtgtttgacctgatggaaagtctgaggacaaacagctccaaaaaggctgattcaataagtaatgtctgatcttctttggggagatcagtaaatcccggaatcctttctgcccagcttctggatacatcaatggaggctgtcaggaggttgtagaattgttgcacatgctcagcatctgtgcctgcagcagcctggtcagtgggacagtatctggaataatcaagatctctgggtgttgagtctgttaaagctcggacaagggcattcatcatgcagattggaggagaaggtggagagggctgagaaggttcctgttgtaatgggctctttggtttggaaggcagacgacctctcctccctttcagactatctgtacggacaacttcttttaccattccaacactgagacacttctgaaatcgacagtactgacatcggtttcgacgtctcttgtctactgggcagtttttatttgccaggcaaacatattttgcatttttctgcactgttctcttgaaaaagcccttgcagccctcgcaggttcgcacgccgtagtgctggcaggcggcgttgtccccgcacacggcacacgtgccctcgccagacgacgagctcctgctgggcggcgacggcaggctgggactctcgcccagcaggctggacgcggtaggggagggcgtgaggccgagaggcgggaaggccagcggggccgccctcttggccagcggcagcccgtacgggtggccctcaagcgcggcggcctggctgcccgcggcggctgcggctcccagcggcaggctgagcgcggcagcggccgtcgggtcgtagccgaggtggtggccgccggccgggctgggcgcggggggatgcggcggcgagggcttgaagtggaagagcgggaagcgcgcgccggccaccgtggggaccgccttcatcggcgggtccagcagcgggccgggtgcgatgcagccgggcgccgagggcagtgcctcgtcccataacgcccccgcctgcggggggaaggccggcgtggtgggggtggacggtggggactgcttgaagtacatggaggtgctgggcagcacctcgtcctccgggctggaggctggaggaatggatggctgctgatgctgctgctggtgatggtggtggtggtggtggtggtggtggtgatggtgatggtagctgggcgcccgcccctcctccactttgatcaagggccgctgcatttggtacacgcaggaaggcttgagttcgtagttgctcgagtagccctccacgaaggtactgatgctgggcagggacgtggtggctgtagccgtgatctcagtgctgccaaggtccatggtcagcttggtgtagtcggggttcatgatctccgtggtgtattccgagctgtatgtctgcgccgcataactggaacctggaggggaagggctatattgggcttggacgcagggcatatctggagggtatcttgcgcgctgaatggtggggctgggggtctctccagcggaggctgagagtgtaggaggagcggacgtccggcgaggcgaagcgccggcagtgctgcccggcaccgctaagggtccaggctcagggcccgggcttgccgggctgccctcttccgcagtgggctttgagtgctgtggcggttccgtctttagagcgagtttctagagagctgtcccgaaatctgcactgggggggagtcgcagctgctgtcccggaagggctgcggtgtacaagcccagcggctcccggaggcggtgagcggctggtgggggatgctgcgatcccgactcatgggagagcacagccgagaggttccgcgggcgtcctggcttgggctgtgaccaggggggaggatgccgccgctgttcccacctccacggccactgccggcaccgtcagcgttgcaaagtgagcccgggaggggcgtccagctgcggcgccgcgctgcaccggcaagggctcagggcaagaggggtgtgagcgcgcgggagagcgaagtgtgtgtgtgcggagcctgtgtgcgcgcttgtgtctgtgtgttcgtgtgaggggccgcggctgcgcgcgtctgtgtatggggagcggaggaggagcaggagctggaggggtggggggcgggaggcaggagactccgctctcccggctgcgcgttcgctcgctctctcggcacgtcatttat

SEQ ID NO: 2140 - DNA, 2181 bp, Homo sapiens
ttttttttttttttttttttttttttttccacaaaaacaagcagcctttattgcagtattacaaaacacttttcattttggcaatattttacaacgcatttagctccaagggttggggagaaggttggaaactaaagggggaaatctcaacagacatttctagaagaaaaactgtcccagccctcccacccaaataaaaatccaaatgtcacttaatttcactacccaagaagaggccacgaggaaagcagcaggcaaaactctggcaatttcactatggatcatgtcagagacaaaggaacattcaaaacagtcatcagtatggtcggttgcgctgatcatttctgtagtcgtttcttcctcccattttgcctccatagccacctcggtctcctccgtagcccccacctcggtctcctccatagccgccaccactcctgtctcctccatagcctccacttcggtctccaccgtagccactgccaccaccacggtctcctccatagcccccccggcttctgtctcctccatagcctcctcgatctcctccataacctcctcgatctcctccgtaacctcctcgatctcctccatagcctcctcggtctccaccatagcctccacctcggtctcctccatagccacctcgatctcctccatagccacctcctcggtctcctccatagccgcctcctctgtccccaccatagccgccgcctctgtccccaccatagccacccccacttctgtctccaccatagccgcccccacttctatctccgctgtagccaccaccgctgcttctgtctccaccatagccacccccacttctgtctccaccatagccgcctcggtctccacctctgcccccacgacctctgtagcccctctctccaccgtagcctctcccccggaaatctcctcctgagggacgagagtcctctggtctaggctcattgcactgattgcaggaattccttcgagcaaagttcatatttccgcatgacggattagggcaaacccaatccccacttttggggtctccacctctcccttgaaagcctccacgacctctatatcctccacggcctcgccgcccacctccacttccacctcctctcatgaattcaggtcttctagtggcaaaggacactttaatgatgttgccatggaattcttttccatcaaaccagtcaatggctgccttagctgaaggagggtcatcaaatgacactgttgcctccccctttggctttcctgtgtccttgtctgtataaagatttatcattggttttccggtcttcttatttgtcttgataattcctatttgtttaaagaactccccaacttgatctgtagacacaccctccccaagtccttgcacaaagattgtgttgttatctgaattatcagattctgaatcagcatctgttctgggtccataatccctgtgaccaccaaaatttttgaagccaccgcggtcaccaccacttgatcctgtcataggacctcttccatccttgtcatatcccccacgccctctacctcctccctgtgacccgccatatcctctattatcttctccatacctactcacatcacgacggtcatcttgtgtgtggtggctgtagttttccctttgtgaatgataggactgctggttttgactataggaatcatgctgctgatcataatttgactgctcatcatatgagccttgatgttgatcatagcctgactgctggtcatatgaatcttgttgaccatagtctggctggtcataggaaggtgctcttccaccttggcttcctgatgattccatgttttgctgctgtccctggttattatatggttgctggctatatgagctctgcttttgattctcataaccaccataggactgtgaataacctgactgactttgtccataactggagtaaccgctgtagttctgtccataagaggaatcagtcgtttgcccatagccagaatagctttgtgatgcttgtccatagccttggctgcctggatttccataggtagaataactttgctgctcacccccagactgaccgtaacttccagaatccgacatgactaacggccgcggcgcggaggccccacagcccgccgagaacaacgaatacgaaagccaggcggcgcggcggccggagctgtact

SEQ ID NO: 2141 - DNA, 965 bp, Homo sapiens
tcgtagttgctcgagtagccctccacgaaggtactgatgctgggcagggacgtggtggctgtagccgtgatctcagtgctgccaaggtccatggtcagcttggtgtagtcggggttcatgatctccgtggtgtattccgagctgtatgtctgcgccgcataactggaacctggaggggaagggctatattgggcttggacgcagggcatatctgcagggacagagagaagggtctttcagaagcaagttaacacttgttttctagccaacaggcagcattgggttcactgttctctaatctgggaaacagagaggaagtgtcatcctctcctccttctggtagcatagacacaaagccccacacttattttcttcatccctagtaaggaagctgaattcctgacaaaggggtgccaaaacctggcctcctgtggactcctgtacctatctttcctcccttgccctgtcctccactagatttgggaaacttgaagtctttcctcataagctcagagatgtttttaaaaagaggctttgaatcctataaactaattggagtgggctcctcagctataacctagggggacaaagagaaagccagtggtttatttgggaggaaagaggccattggtcccccaaggcatacacattgatttgtaaacctgagttaggcaagaaaaactaccctgtgagagatttagtggccaagggagagagttgacattctaacattttatgagtgccaattgaggttgcccacacacgttgtggttgctttctcccacctcgtccccactcttccaatagggctagcagcctgcacaaactggacccctgttgataacttcagtcagctaggtggggacataggcccaggaaattgactcgggagagtttgtaccatctgcaaagaaaaagatcagcagctgcaacaaaacacccacccatatatatatatatacaca

SEQ ID NO: 2142 - DNA, 1213 bp, Homo sapiens
  misc_feature (1)...(1213): n = A,T,C or G
ttttttttttttttttttttagattagaataaaaatttatttttgtaaagaattatattttgtatttgcaaaagctgaaaatgctcataaaaattaccagcccagagcttggatttccaccggatccaccacgtgagacaaaagagtctgtcacttcttcttgccaggtttgagggccttttctagaccttggatgtgttttcgagggagctgatactcttcaagcaatagccagccgaggtggtggacctggtttccctggatctgcacctgaaggctgtccttggccccaggggcaggattgacggtggtgctagcctggcatcgctgctgaaggatggcagccactgagtatgggtccagaccataggcctccaagttccggaccacggtcacctttttattagacgctctttgtgctagggtgatgtcaattggacagattctccctttcttcacaatgggctcttgtccgggaagggtcacttgataggcaggctgtaatttttccaaacacctggtcagaagactgtcccatggaagcttcatgactgtatgctgttcatttttctctaagatgcagtcacataggatgggatccaatctcacaagatttttgttgtctgcatcaaccaggtcatttttctttgcgtagttaatgacgatcgttcggacctcactgccctccagaaagctccccctcttgtggccagactcctggaagagcaggtcatgctggctgggacacagtagaggggttttatatctggagggtgatagggctgttccctgctaccctcctggatagtcttggaagtcggggagggctcggtatgaacaaaagatgtaatcctcgggtgtttccagtccacagccacaatgctctccacccctttgctcagctccttcacctgtataatctgctcctgctgcatttgctgcaggaacttagagagctttttgtagcttgacttctttatgtccagttgtcgtcttcggggcagcaggagaacatgtggctgccaaggaaagtgctggtgagtaaagggaggtcagcctttttgactcggcacttcaaggcatgtaagaagcattgctgtaacagctcatccatttgttcttgaagcgttttgctatctgtggagtcttggttcaggcccctggtgctggtgtcttctggggctttctgagagagacttgtcttncancnctg

SEQ ID NO: 2143 - DNA, 969 bp, Homo sapiens
  misc_feature (1)...(969): n = A,T,C or G
ttgtgtgtgtgagacgaagtttcgctcttgttgcccaggctggagtgcaatggcacgatctcggctcaccacaacctccgcctcccaggttgaagcgattctcctaccttagcctcccgagtagctgcctcggtctccacctctgcccccacggcctctgtagcccctctctccacaatacggcacgagccggaaatctcctcctgagggacgagagtccctggtctaggctcattgcactgattgcaggaattccttcgagcaaagttcatatttccgcatgacggattagggcaaacccaatccccacttttggggtctccacctctcccttgaaagcctccacgacctctatatcctccacggcctcgcggcccacctccacttgcacctcctctcatgaattcaggtcttctagtggcaaaggacacttttaatgattgttgccatgggaattctttttccatcaaaccagtcaatggctgccttagctgaagggagggtcatcaaaattnacactgttgcctccnnctttgggcttttnctgtgtcctttgtcctgtaataaaggattttatccatttgggnttttcccgggtnttncttnattttggnctttgaataaattncctaattttggtttaaaagggccttccccaaactttgaacccttgtaggcaanaacccntccccaaaggcccttttnaacaaaaggtttgttgttggaaccttgaattaancaaggntcttggatnaagnaatcttggancttgggccaaaaanccctgtggccaccaaaaattttttaaggcaaccgggggnnaacaccaanttnacccctgaaaaaggggccttttccatcccttggaaaatcccccaagggcntnacntccanccttnnccccgcaaaanccnantannttgccaaaccntntaaaaaaggggggacnntgnatgtggggggtaaggn

SEQ ID NO: 2144 - DNA, 785 bp, Homo sapiens
gcagcaggtcaatcaatgctgatgcaattggataaactgcttagtaataacttgaggctcacccagatggtttgaacacaatatgaaaaaaaacagtagtcactttgtctagatcacgagataaatctacaaattgtagtttgtctgtgcagattttcattggcacaaccaccaggaatcctgcaacaatgtgtatgacaggtgcagcactgtcagggtcacttgttaaggcatttagagattcaataaggcaaaaattatttgctgcaatggatgcactgaattgctaaatgaagcgagaaatatagaaaaagtatgaaaactgtctaacatggtgccagacacaaaatcattcaatcaactcttattactagtagccataaatagagaccctgatcattcatttgaaagcaggaaatcataaaacttactctggaataatcaagatctctgggtgttgagtctgttaaagctcggacaagagcattcatcatgcagattggaggagaaggtggagagggctgagaaggttcctgttgtaatgggctctttggtttggaaggcagacgacctctcctccctttcagactatctgtacggacaacttcttttaccattccaacactgagacacttctgaaatcgacagtactgacatcggtttcgacgtctcttgtctactgggcagtttttatttgccaggcaaacatattttgcatttttctgcactgttctcttgaaaaagcccttgcagccctcgcaggttcgcacgccgtagtgctggca

SEQ ID NO: 2145 - DNA, 673 bp, Homo sapiens
  misc_feature (1)...(673): n = A,T,C or G
gaattcttttccatcaacccagtcaatggctgcctaagctgagaagggtcatcaaatgacactgttgcctccccctttggctttcgtgtgtccttgtctgtataaagatttatcattggtttcccggtcttcttatttgtcttgataattcctatttgttaaagaactcnccaacttgatctgtagacacaccctccccaagtccttgcacaaagattgtgttgttatctgaattatcagattctgaatcagcatctgttctgggtccataatccctgtgaccaccaaaatttttgaagccncggcggtcaccaccactgcagaggaaaaattgaagaaatgatttcttccttaagtctctaatgtgctgagccctgggctcaatctacacttaactgtcacaagtagagtgcttaggaaaacagtagcacctctaagttttcagtaaattccatttcacagagttctaaatgttgtttccatctaagtgttttcccaaggatctatttccacaagatgtcttttcaagcttattacatatctaatatactcttatttctaaatcttcccaaccccaagccaaagggatactattaaaccataacataaagctggaggcacagcatgaaaaatactaaactagagtaagtattttttccaaacggttattttc

SEQ ID NO: 2146 - DNA, 563 bp, Homo sapiens
tttttttttttttccacaaaaacaagcagcctttattgcagtattacaaaacacttttcattttggcaatattttacaacgcatttagctccaagggttggggagaaggttggaaactaaagggggaaatctcaacagacatttctagaagaaaaactgtcccagccctcccacccaaataaaaatccaaatgtcacttaatttcactacccaagaagaggccacgaggaaagcagcaggcaaaactctggcaatttcactatggatcatgtcagagacaaaggaacattcaaaacagtcatcagtatggtcggttgcgctgatcatttctgtagtcgtttcttcctcccattttgcctccatagccacctcggtctcctccgtttcccccacctcggtctcctccgtagcccccacctcggtctcctccatagccgccaccactcctgtctcctccatagcctccacttcggtctccaccgtagccactgccaccaccacgggtctcctccatagccgcaccggcttctgtctcctcgatgagctcctcgatcgtgctcata

SEQ ID NO: 2147 - DNA, 494 bp, Homo sapiens
aagtctcttaactaaattagatgctggaattgatccagccaaggtaccccttaaaaaaaaaaaaaaagaggaagaagaagaaatgtacgcttctttatctacatacttaccttgatcctgtcataggacctcttccaatccttgtcatatcccccacgccctctacctcctccctgtgacccgccatatcctctattatcttctccatacctactcacatcacgacggtcatcttgtgtgtggtggctgtagttttccctttgtggaatggataggactgctggttttgactataggaatcatgctgctgatcataatttgactgctcatcatatgagccttgatgttgatcatagcctgactgctggtcatatgaatcttgttgaccatagtctggctggtcataggaaggtgctcttccaccttggcttcctgatgattccatgttttgctgctgtccctggttattatatggttgctggctatatgagctc

SEQ ID NO: 2148 - DNA, 463 bp, Homo sapiens
tgtctctctaggaatagggtctgtttcacaggccatttctgtgaaccctactccattgtggtttctgccactatcaaagttccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccatgggcagaatataataaatattctgagtgagaaaaaaaa

SEQ ID NO: 2149 - DNA, 892 bp, Homo sapiens
gcctgataaaaggtgggagggacccccctaaggggttttgcgagccttctcgaaagtcggcgtacccccccgaggggtccagaaagttccaagaggctcaaagatcaccgggatctcacttccagacagttggaagatatcaggagcagcacagcgtaagggccaaaatatgtgagcactttgaggcagagccccccacagacagtgaaccactcaaaaggctcgttttgagatggtgctggatctttatgcagcagctacaagatttaggccatcctccaaaagagctggctggagagatgcctccgggcctcaactttgacctggatgccctaaatctttcgggcccaccaggtgccagtggtgaacagtgtctgatcatgtgaaacacgacacgttttcctctctgattcccagctatggggaacatctggagtcagcagaaccattgggacctgaggcaggagtgtcacctgcgggagaagtctgcccgctgccctctgtcatcccattcaagattgtgccataccagttaaggttttcctctttctctctagaataggtctttcacaggccatttctgtgaaccctactcccattgtggtttctgccactatcaaagttccagcccccggcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctattgtgattagatgcaaaagccctttccctttagagaattcagaatggtctgtctgaaggcaagagagcatagtgacaggtcga

SEQ ID NO: 2150 - DNA, 488 bp, Homo sapiens
tctcacaagatttttgttgtctgcatcaaccaggtcatttttcttggcgtagttaatgacgatcgttcggacctcactgccctccagaaagctccccttcttgtggccagactcctggaagagcagggtcatgctggctgggacacagtagaggggttttatatctggagggtgatagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcacagcttgagct

SEQ ID NO: 2151 - DNA, 413 bp, Homo sapiens
gggccaatgaaatgtgagcacaggtgacacatgaagctccagacagacactgaaatgcccatgagcagttccgcagtgtctgccttcccttccctcagcaaatgctgatgtcccagggacagagcctctgtcaagcctgggccgcctcctctgtctccaccatagccgcctcggtctccacctctgcccccacgacctctgtagcccctctctccaccgtagcctctcccccggagatctcctcctgagggacgagagtctactggtctaggctcattgcactgattgcaggagttccttcgagcaaagttcatatttgcgcatgacggattagggcaaacccaatccccactttgggtgtcgtcacctctcgcttgagagcctccacgacctctatatgctcgacggcctcg

SEQ ID NO: 2152 - DNA, 474 bp, Homo sapiens
cagatgcccagactcactccctgctgagcagggaactttccttagctttcggcctctagtttcttcccttttcctgactgaagtgagcatgaccatgtgaagaataattacacgcagaaaagggtgagacctactcgttcatttagtccagaggaacttgcccagggaagaaggctggaagctggattttggagaaggggagaacaggggcagagcaggttttgccagtcgcaaaagagcactactcaggttgagaggaactgtaggccagaacaccaagcaggcagagaagggctgctctccaaaaactcacttgtggccagactcctggaagagcagggtcatgctggctgggacacagtagaggggttttatatctggagggtgatagggctgttccctgctaccctcctggatagtctgggaggtcggggagggctcgggtatgacgaaagatgtaatcctaaaacccag

SEQ ID NO: 2153 - DNA, 492 bp, Homo sapiens
tttgtccacaaaaacaagcagcctttattgcagtattacaaaacacttttcattttggcaatattttacaacgcatttagctccaagggttggggagaaggttggaaactaaagggggaaatctcaacagacatttctagaagaaaaactgtcccagccctcccacccaaataaaaatccaaatgtcacttaatttcactacccaagaagaggccacgaggaaagcagcaggcaaaactctggcaatttcactatggatcatgtcagagacaaaggaacattcaaaacagtgcatcagtatggtcggttgcgctgatcatttctgtagtcgtttcttcctcccattttgcctccatagccacctcggtcatcctccgtagcccccaacctcggtgctcctccatagccgccaccactcctgtctcctccatagcctccaacttcggtctcaccgtaggcagtgccaccaccacggtttcctccatagccccc

SEQ ID NO: 2154 - DNA, 467 bp, Homo sapiens
agattagaataaaaatttatttttgtaaagaattatattttgtatttgcaaaagctgaaaatgctcataaaaattaccagcccagagcttggatttccaccggatccaccacgtgagacaaaagagtctgtcacttcttcttgccaggtttgagggccttttctagaccttggatgtgttttcgagggagctgatactcttctacaatccaaaaagcacacactcctcagcggacgatgaccttgctccccggctggccctccaccagtccccgttgcctcacaatgtcattccacccagctcaaactcaacttcgggactgaccacttacgcctacacctcacagctgatgtgtatatttctgaaattttcacactgagagctactttctgggtgtatttcaggcatttataattttttcacgagagagaatgtgtctgttcagtctgtgctcctcgctcttgctc

SEQ ID NO: 2155 - DNA, 456 bp, Homo sapiens
ttccacaaaaacaagcagcctttattgcagtattacaaaacacttttcattttggcaatattttacaacgcatttagctccaagggttggggagaaggttggaaactaaagggggaaatctcaacagacatttctagaagaaaaactgtcccagccctcccacccaaataaaaatccaaatgtcacttaatttcactacccaagaagaggccacgaggaaagcagcaggcaaaactctggcaatttcactatggatcatgtcagagacaaaggaacattcaaaacagtcatcagtatggtcggttgcgctgatcatttctgtagtcgtttcttcctcccattttgcctccatagccacctcggtctcctccgtagcccccacctcggtctcctccatagccgccaccactcctgtctcctccatagcctccacttcggtctccaccgtagccactg

SEQ ID NO: 2156 - DNA, 409 bp, Homo sapiens
cattttaaatggttatataagtagctaaataatattctcagttttgcctcttggcctgcaatgtctaaactatttactttatggccccttaagaaaaagtttgctgacttggagacccctggggactttgaaggcatccactgggcatcttggaacataaccaccgaggataagggggcactactttgttagactccacagatgaacaagggtcagttgtccacactgaccactgtggccagcctggatcacatgcctgccctgcagtgaaatcagcaggacactggactcacctgggtcacttaggatggaaaagaacttctccaagtgaaccagaagaaggggaatgcaaaattctagaataaactgtaactacatattccagtcaaaaaaaaaaaaaaaaaaaaaa

SEQ ID NO: 2157 - DNA, 414 bp, Homo sapiens
  misc_feature (1)...(414): n = A,T,C or G
taccagcccagagcttggatttccaccggatccaccacgtgagacaaaagagtctgtcacttcttcttgccaggtttgagggccttttctagaccttggatgtgttttcgagggagctgatacctctatcaagccaatagcccctccaacacacaccacaccacacccacccccacacccacccccaccccgcaccacccaccccaccaccccagcccccacgcccccctcgcaacaggcgagggcaggccccaaacccccaacccgggctnnnncnnnnnnattncccccnccttggagatctgcacctgaaggctgtccttggcccaggggcaggattgacggtggtgctagcctggcatcgctgctgaaggatggcagccactgagtatgggtccagaccataggcctcca

SEQ ID NO: 2158 - DNA, 449 bp, Homo sapiens
tttttttttttggttttttttttttttacaaaagtccacaaaaacaagcagcctttattgcagtattacaaaacacttttcattttggcaatattttacaacgcatttagctccaagggttggggagaaggttggaaactaaagggggaaatctcaaagatgaacaagggtcagttgtccacactgaccactggggccagcctggatcacatgcctgccctgcagtgatatcagcaggacactggactcacctgggtcacttaggatggaaaagaacttctccaagtgaaccagaagaaggggaatgcaaaaattctagaataaactgtaactacatattccagtctgccagagtaaggaatttattctacattcgttaagtaacgagaaatttatgagcaggaaaatgctcttcattcaacaacattcaacaaatatttattaagcta

SEQ ID NO: 2159 - DNA, 410 bp, Homo sapiens
acaaaagtccacaaaaacaagcagcctttattgcagtattacaaaacacttttcattttggcaatattttacaacgcatttagctccaagggttggggagaaggttggaaactaaagggggaaatctcaacagacatttctagaagaaaaactgtcccagccctcccacccaaataaaaatccaaatgtcacttaatttcactacccaagaagaggccacgaggaaagcagcaggcaaaactctggcaatttcactatggatcatgtcagagacaaaggaacattcaaaacagtcatcagtatggtcggttgcgctgatcatttctgtagtcgtttctaggaatgaaaaataaagagccggactaaattctaattttctacgaagggggagcattagacacttcttcagg

SEQ ID NO: 2160 - DNA, 329 bp, Homo sapiens
  misc_feature (1)...(329): n = A,T,C or G
ttccaagaccttgaatgtgttttcgagggaagctgatactcttcaagcaatagcnagccaagttggtggacctggtttccctggatctgcacctgaaggctgtccttggccccaggggcaggattnacggtggtgctagcctggcatcgctgctgaaggatggcagccactgagtatgggtccagaccataggcctccaagttccggaccacggtcacctggggggacagtggggacagagactgacggtggtgactgcattcccttcccncgngagggccttccagagcctcagcagccttctgagcccctgtgttctctgatggtnc

SEQ ID NO: 2161 - DNA, 268 bp, Homo sapiens
cagtgtcactattttctccttaaagctccagccaaaaactggacaaggatagagaggagtagggaagaacaaaagagcccttctctatgaaccttgtgccttctgtcctaccagctttctgtatcatactcagccccaatcccaacacctactctcaccaaagtaaacaagacacttacggattagggcaaacccaatccccacttttggggtctccacctctcccttgaaagcctccacgacctctatatcctccacggcctagggg

SEQ ID NO: 2162 - DNA, 244 bp, Homo sapiens
ggtggctgtagccgtgatctcagtgctgccaaggtccatggtcagcttggtgtagtcggggttcatgatctccgtggtgtattccgagctgtatgtctgcgccgcataactggaacctggaggggaagggctatattgggcttggacgcagggcatatcttgtgtgtggtggctgtagttttccctttgtgaatgataggactgctggttttgactataggaatcatgctgctgatcataattt

SEQ ID NO: 2163 - DNA, 215 bp, Homo sapiens
  misc_feature (1)...(215): n = A,T,C or G
ctgtagtcgtttcttcctcccattttgcctccatagcacctggtctcctccgtaggccccacctgggtctcctccatagccgccaccactcctgtctcctccatnnnntccacttcggtctccaccgtagccactgccaccaccacggtctcctccatagcgcccccggcttctgtctcctccatagcctcctcgatctcctccataacctcctc

SEQ ID NO: 2164 - DNA, 1700 bp, Homo sapiens
ttttttttttttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaa

SEQ ID NO: 2165 - DNA, 2544 bp, Homo sapiens
ccccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaatacctttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaataaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtaaaaaaaaaaaaaaaaaaaaaaaaaattaaatgaatgtatatactttttttttgaagagtggagagtagtgatgtctagagggagctattttgtgctgaggccactatgtt

SEQ ID NO: 2166 - DNA, 1620 bp, Homo sapiens
  misc_feature (1)...(1620): n = A,T,C or G
nttttttccctgtaggggaatttagagtggttttttttnccatttncagagatagggtctcttttttgagcaaccatctgcttggagtgctgcctcttgctcctccccaccaccactgctgccctgagtcactgcctgcacagctccagccgcctggcttctcatagtagccactgatatttggagttcttacaacatggcagacattgacaacctgcctagctagggtagttaaaagacggagtgaatgctctcaaaaacctgcaagttaaaggtgcacagatagaagccaaattctatgaggaagttcacgatcttgaaaggaagtatgctgttctctatcagcctctatttgataagcaatctgagattactaatacaatttatgaacctacagagggaagaatgtgaatggaaaccagatgaagaagatgagatttcagaggagttgaaagaaaaggccaagattgaagatgagaaaaacgatgaagaaaaagaagacccccaaaggaattctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctcaaaaaaaaaaaaaaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaata

SEQ ID NO: 2167 - DNA, 1056 bp, Homo sapiens
  misc_feature (1)...(1056): n = A,T,C or G
cccaatggatattttacaaatgaagtgctgacagagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctccattatgagccagtttacctactatgtcatcttcatggatgccatttgacnttaatatagganggggaagaagaaggngttggggaatggtcccnccttgccccaaggggcnaaatngggcgnggtcncataattagaganctaagtanggtggggnttgaaaccagttncccggtaanctt

SEQ ID NO: 2168 - DNA, 697 bp, Homo sapiens
attgcccaggttgtctcaaactctgagctcaagcagtcttcccaccttggcctcctaaagtgtggaaattatagcatgaacccctgtcaggtctttttgtcagtctatcaacctctaacatcctcgccccttttattttttttgtctgtattgaaactttattacaaaattataaagcagagctctgtaacaaaataatacacatttgggtttgctttaacctccaagtaagtctgagaaaatcttaataaaagccacttgaagtaacaattcacatccaagagatttccacaaatttatacaatgtatattgagcactagttcctgtacagcttattcttattagtttggatccaactattccaatgtattatgaaccagtcagctatctgtcttttgaaacaagtcttaactgaaatctcagagtaatcagcaaaagctacggaataattctaagaattagatgtttccatatcattaaaaccaaggatccatgaggggcagaagggaggattcaaagatttaaaaaaaatcaaattttagaccttggttaaatattaactggaatgggatcttggaactcccaactttaatttggtgtaataaaaatgatgcaaaaaaaaaaaaaatcagggttgtttgacaccttttttcctaaagggaaaccttcaccaaaaggggataaaagatttaaagg

SEQ ID NO: 2169 - DNA, 670 bp, Homo sapiens
  misc_feature (1)...(670): n = A,T,C or G
gatctttgtgtggctcctatttttatagaagtggagggatgcactatttcacaaggtccaagatttgttttcagatattnnnnnntgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtnagggtggattattggattgtcattagaggaaggtctagatttcctgctcttaataaaatnacattgaattgatttttagaggtaatgaaaacttcctttctgagaagttagtgttaagggtcttggaatgtgancacattgtttgtagtgctatccattcctctcctgagnttttaaccttactactnggaatccctaaccanttatnaatngctttttttccnnaattttcaaaatggtttcccctngctttggttnggcnctatgggnctttttttttnaacccnggggccccggaaatnnnnntttncnnncncaaaggngggcccccttttnaagccccgggggggaaccccntttccctcntngggaannntttccccagggggggggggancccgggttnna

SEQ ID NO: 2170 - DNA, 570 bp, Homo sapiens
ccctttctttgtgaccagaatatgggtgtccaggtgccagatagatggaaaaaaggaaagaatgtcactttgaaaactactaaggagaagcagaaaccacaagggacgtgggaccagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatggtctaccttctgcttccctggaaaggatgaatttacatcatttgacaagcctattttcaagttatttgttgtttgtttgcttgtttttgtttttgcagctaaaataaaaatttcaaataca

SEQ ID NO: 2171 - DNA, 417 bp, Homo sapiens
  misc_feature (1)...(417): n = A,T,C or G
aaggatttcaggttacatacttcaaatttctagaatggaatggaatcattttggaactggaaaaatggcataaacactgacgtcccttaaaacttcaattttataaagaaaattcttctgcaaaccacatcccctttatgtaacaagactaggtattatctacacctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtattatctcgtgccgaattcggncgacntttagaattattccgtagcttttgctgattactctgagatttcagttaagacttgtttcaaaag

SEQ ID NO: 2172 - DNA, 949 bp, Homo sapiens
  misc_feature (1)...(949): n = A,T,C or G
tgtgcaccgatagaaggccaaattctaggggaagttccagatcttggaagggagttatccggtcttctcagcgcttcaattggttagccaattggaattatttatgccatttattgaccttcgggaggaggattttgattggaacccgattgaggaggtggggtttccgaggaatttgaaggaaaggcccaggtttgaggtggggaaaaaggttgaggaaaaggaggcccccaaggaattcctggaattttggttaactgtttttaagaatgttgacttgctccaggtgatatggttcagggacacgattgaacctattctgaagcacttacaagatattaaagtgaagttctcagatgctggccagcctatgagttttgtcttagaatttcactttgaacncaatgaatattttacaaatgaagtgctgacaaagacatacaggatgagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaa

SEQ ID NO: 2173 - DNA, 743 bp, Homo sapiens
  misc_feature (1)...(743): n = A,T,C or G
aactgacatttnaangaccaatttgttctaccttagcattttaactagtttttctgccagctatgttgaatgcacaaattctgtcacgcatgttcattcatngctacataatttggttcttctggaatatttttatgtagctcttggagtacagctatgaaaattaacaactgttaaaggaaataccttttttttttttnggaaattntccccnngannncccaangnnttttnccnncgggtngnngaaaggggtaancccnncngggatannngggnccttccanaacttngnannngaangncggggcntnanacaagnacattttntggtnaaaaaaaaaanngggcgnnnnannnanggggaaangaatncccggnnggcccccccccaaaacnggtntnangggggtanggggcaaagggggaatagggggccnnggtanncggaaagnancccggccccnnnnangtncngggnncccngggggggggaaaaangggggtntnnnngaggcagccggannnaancggnattgtaagttagcccccccaanggctgggccccngccnngggggggggggggcnccctnnggcccccggggangggngggagtncccccnangggcaagcccnnntanncccgggaaacngggggncngntgcccgggntnanggnaannggngcncaaaaanaaaanncccnaancccgnnggggnggccccccccggggnanggng

SEQ ID NO: 2174 - DNA, 583 bp, Homo sapiens
  misc_feature (1)...(583): n = A,T,C or G
cggcgcnctccntgctcctcccgctgctgctgccgctgccgccctgagtcactgcctgcgcactccggccgcctgngtccccatactagtcgccgcaaagaacagtctgaacttgatcaagatttggatgatgttgaagaagtagaagaagaggaaacgtggtgaagaaacnaaacgtcaaagcacgtcagctaacgtgttcagatgatgcaaaatctcagattcttgcanccgttcaagaaagacttgatggnctggtagaaacaccaacaggatcattgaaagccgtgcctaggggtagttaaaagaccgagtgaatgctctcaaaaacctgcaagttaaatgtgcacagatagaagccaaattctatgaggaagttcacgatcttggaaaggaagtatgctgttctctatcagcctctatttgataagcgatttgaaattattaatgcaatttatgaacctacggaggaggatgtgaatggaaccagatgaagaagatgggttcggcggagattgaagaaagccagattagatgagaaagatgagaaagagcccagatcctgatttggtactgtttagat

SEQ ID NO: 2175 - DNA, 591 bp, Homo sapiens
  misc_feature (1)...(591): n = A,T,C or G
ccaatgaagnctgacaagnccttccggatgagtcagaccaatgatcggatccnttttcttttgaggaccagaattagggttgtacaggntgccagatagatggaaaaangaagaatgtcactttgaaaactattagagagcagaaacacagggacgtgggacagttcgtactgtgactaaacagtttccaagactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcaaaa

SEQ ID NO: 2176 - DNA, 467 bp, Homo sapiens
  misc_feature (1)...(467): n = A,T,C or G
tgggacagttcgtactgtgactaaaacagtttccaatgactctttctttaacntttttncccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccaggactatggacccaaaggaagggttcaaaacccaggcaggagtgcaagcaggcagtgnaagcagggatgttttgtgggcnttgagggttaacctggcantgttattnggccttaaacacaantcttntttttanttaccggcctntgtttttgtnttttccttcgggtggntctgggtntttttttt

SEQ ID NO: 2177 - DNA, 376 bp, Homo sapiens
aaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaa

SEQ ID NO: 2178 - DNA, 471 bp, Homo sapiens
ttacagtgtggatccgctgtgtgaacctgatgagttctttgagaaactctttgagtttctgtttgacctctttaacaacaagagcaaaactccatctcaaaaaaaaaaaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaaa

SEQ ID NO: 2179 - DNA, 418 bp, Homo sapiens
  misc_feature (1)...(418): n = A,T,C or G
cgctgctgctgccgctgccgccctgagtcactgcctgcgcantccggccgcctggctccccatactagtcgccgatatttggagttcttacaacatggcagacattgacaacctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaaggaaggaatgtgaatgggaaaccagatgaaggaaggatgaggatttcggagggaattggaaagaaaagggccaaggttnaaggttgaggaaaaaaggtggaaggnaaaaggaggaccccaaaggga

SEQ ID NO: 2180 - DNA, 788 bp, Homo sapiens
  misc_feature (1)...(788): n = A,T,C or G
gcgccgcctcctgctcctcccgctgctgctgccgctgccgccctgagtcactgcctgcgcantccggccgcctggctccccatactagtcgccgcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgnaggaagttcatgatcttnaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaatttnggttaactgttttaaagaatgttgacttgctcagtnatatggttcaggaacacgatgaacctattctaaagcacttgaaagatattaaagtnaagtnctcctgtatctatctgtctgtctgtctgtctgtctgtctacctacctaccttcatctatcaattagtttttataaacagaccaaagtccttatttggagatggtagaattatctaatagaaaactgctaatgcctacttgnctgggactttnaggagctactatagggggcaattattttgttttact

SEQ ID NO: 2181 - DNA, 314 bp, Homo sapiens
  misc_feature (1)...(314): n = A,T,C or G
ccgccctcctgctcctcccgctgctgctgccgctgccgccctgagtcactgcctgcgagtccggccgcctggctccccatactagtcgccgcctgcctagggtagttaaaagacgagtgaatgctctcaaaaacctgcaagttaaatgtgcacagatagaggccaaattctatgaggangttcatgancttgaaaggaagtatgctgttctctatcagcctctatttgataagcgatttgaaattatnaatgnaatttatgacctacggagaagaatgtgaatggaaaccagatgaagaggatgagattcggag

SEQ ID NO: 2182 - DNA, 465 bp, Homo sapiens
  misc_feature (1)...(465): n = A,T,C or G
ggcccaangtaacccggaaaaagtaccccggacccggtaaagggtaaccggggccccccacaggacgggggaaaaaaaaaacggggatttcccagaaagttaagccccgaaatttaaacctgtatttttaaaatttaaacccccccattaacctaagccatcctttccctttgtggtagggtcctacccttctgcctccccccggaaaggatgaatttacatcatttgacaagccctattttccaagttatttgttgtttgtttgccttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaa

SEQ ID NO: 2183 - DNA, 464 bp, Homo sapiens
  misc_feature (1)...(464): n = A,T,C or G
cccctttttttttgggcccccaaaaatatgggtgtgacaggggcccgaaaaagtgggaaaaaagggaagaaggtcccccttgtaaccttctaaaaaaaaccgaaccccccagggggggggccggttgggcgtggnctaaaacaacagttccaaagcctcctttcttaacttttnttgcccctcctgaagtccctgagagtggagatctgggatgatgatgctgaagctatccttgctgcagacttcggaaatggtcactttntacgtggaggtataatcccaagatcagtgttatattttactggagaagctattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctcaaaaaaa

SEQ ID NO: 2184 - DNA, 388 bp, Homo sapiens
  misc_feature (1)...(388): n = A,T,C or G
atgtctcagtcagctggtgtttgtgtagtaacagaacacagtcctcgaatgccatgttattcatttttattatttttttaatttgaaggaacacgatgaacctattctgaagcacttgaaagatattaaagtgaagttctcagatgctggccagcctatggtaaaagaactttgaaatatttataattttgtaacatgcttacaggtaggataaataggaagcttttaaaaagataacattcaaggggtaaggttgggtgctctttgttattagtggaataaatatttgggatgcttgcttaattgtgngggcagtatttattccttttcctccttcttgatccataatttgtgttttngaaacacagacatccttgttcccggggnt

SEQ ID NO: 2185 - DNA, 429 bp, Homo sapiens
aaagtgtaaatctagaactgctaatttagtaggcttctttctataagtagcaacaagcttttaaaaaaattgtttgcaataaaatatccagtggaaacaaatttagtggtttccatttgaaaatgtaacttttaaatatcaaaaacaggaagcagcacagcagcacagcttagaagttacagtgtggatccgctgtgtgaacctgatgagttctttgagaaactctttgagtttctgtttgacctctttaacaacaagactataaaagtgaggcagtgtagccaagtagctaagaaaagaggcattagagaggctgaagcaggaggagaatcgcttgaacccaggaggtggcagaggttgcagtgagctgagatcgtgcatttgcactgcagcctgggcaacaagagggaaactcaaaaaaaaaaaaaa

SEQ ID NO: 2186 - DNA, 432 bp, Homo sapiens
  misc_feature (1)...(432): n = A,T,C or G
gatctggatgatgatgctgaagctatccttgctgcagcatccatcatccagatctcccactctcaggaacntcaggaggggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcag

SEQ ID NO: 2187 - DNA, 373 bp, Homo sapiens
ccacatgattttgcacacttttcgtccgatggtccataaactatggtttgcacatggtcccagatacactgctactaagctaagaatctcactttcaactctccccagttgaagcagaaacacaagggacgtggcacagttcgtactgtgactacaacagtttccaatgactctttctttaacttttttgcccctcctgaagctcctgagtgcggagatctggatgatgatgctgaagctacccttgctgctgacctcgaaaccgggcactctttacgtgagcgtccaatcccaatatcagctttatactttactggatacgctatcgccgctgacgctgactaccatgacgaagtaggcgaagacccggatg

SEQ ID NO: 2188 - DNA, 250 bp, Homo sapiens
  misc_feature (1)...(250): n = A,T,C or G
tgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatgnatgcattttgaaactttaatataggaaggggaagaagaaggagatgaggaaaatgatccagactatgacccaaagaag

SEQ ID NO: 2189 - DNA, 205 bp, Homo sapiens
  misc_feature (1)...(205): n = A,T,C or G
atnatctttntaattaaaaatggnattctatctttaaagttcagaaaaagctgcatttcgatgaacttcaaagatagaatcccatttttaatgaactgaagtagcaaaatcatctttttcattctttaggaaatagctattgccaaagtgaaggtgtagataatacctagtcttgttacataaaggagatgtggtttncaganga

SEQ ID NO: 2190 - DNA, 114 bp, Homo sapiens
tttgaacccaatgaatattttacaaatgaagtgctgacaaagacatacaggatgaggtcagacccagatgattctgatcccttttcttttgatggaccagaaattatgggttgt

SEQ ID NO: 2191 - DNA, 1109 bp, Homo sapiens
tttgagacagagtctcactctgtcaccaaggctggagtgggggactccatcttggcagggggcgggggatgtggaccttcaagtctcagaaatatgtgtttgtcttttgatctgctgatttggtgtaacgtgattgcctcattcattccagtgtacgtacttgctgtaaatttatatacagaattaaatagcccatttattaatttataaaccataataaaaccagacagtcatttcccgtcaccagcagatcttgcattggaaaaggaaaataatatacaaatttcagcaacttcagagatttcaggaagcctgaatggaggtcgaattcattttggagttcaataatatgttcaaagaatcaggtactatatataatcatatagacaactcccgtaatatctccgcagtgcaaaattatccctgtttcttgtcattcaccagtgagaaaaatccaactgcagacttgactgccttcggtgaaggcacacggcaagttcttctgacaaataacaccctttgggattgactcttcacgttttacacagcaattgtctcagcttgggaccaaagtatttacaaagcaagcgaacaagagacgaagcaagagggacacttctgaggccggtggtgcggaaactcaccgccaaacagggtggggggccagtcacctcttcaggagtgtcccatgtgtcagctgacataacatcttaaatacagaattccaattgaaggaaaaacaaacaacaacaaaagaaacaccagtcaagcataagtgatgttacttcctctctgaacagggaaacatctcgctcgctgggagataaaaggtaaatctctcatttgctgctctcttcccctaagtgccagcaagaagctgggtgtggtgatgaagaaagaaggcagccatcacctaagaccccacaagccaagccgtggtcccctccgtgagggcacggtcctttcatgaagccgtaaaagagaccacagctcggacctgagcactcagggttacctactggggtcttgtcatattccttatgttgatttctgccaagacccaaactgattccttttttttttttttttttttgagacagagtctcaaa

SEQ ID NO: 2192 - DNA, 5167 bp, Homo sapiens
  misc_feature (1)...(5167): n = A,T,C or G
ggtaccgtcagatgcaaagtgcctgggacagaagtggggctccgctggcgcccagctccaaaacccaggcagcgtggaaaagactagacagggaaggggttagccctcagaattacacgcgggtttgccttaccagactaccaccactggcacaacctcagacccacacccaaccgactttacctcccaggccctgattaatctcgcccggaagtaccgcccacccatgctcacttccgctatcccgtacttctgctcatctcgcgagaactgaaagcgcctatgtgacctgcgctaagcggaagttggccctcttttccgtggcgcctcggaggcgttcagctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagtttttacagaaaatatttgggggtggccagcatacccagttggtgttaatccttgcttattatatccagtgccttgtagagtgcagtaatttcgttgaaaatctgcttgtgaatctttgatgtatacattatccaaaaataacctgactttaaggtcattgctatctggtttaggagtcacatgtttgagaattctgggactattagcaccacacactttgtaattttatatcagatgttctaaattattaatattttttaagagatgaggtcacactgttgcccaggctggtcttgaacccttgagctcaagtgatgctcccactttggcttcccaaagtgctgggattatgggcgtgagcaccacacccagcccaaaattattttttggcttacaaaagaagttgctttaaacttctgtttcatctgtaggatatggataacaatagttaagagttgtgagaattagaagttagagaccttactcagaatactagggagcaggtgctagggattttggagctttaccttttaagaacttttgtccatatagtagacaacatactcaccagtgaggacctcaaatagcaatatttctgtggtgaaatttggggatatttatgttaaataaacagcatgtcagtcaaggttgggttttcctgacaaaatttgaaagaatttctctggattttggttttcaggactggtgtgacttaacatacatggcatagatagtatacgtctgttaagtcagtaattacacttacttgagcacaggtactgttcaaggtgctgagaatacagtatagacaaattcctacccttatgaagctgatgttgcaaaaaaaaaaaaaaagcaattgacaaataggtggcagttgcccataaccatagccctggaaataatccgtataatacaagcgtggtctggttgatgggtatttttagatggttcttatgtctatagtaggaggcttaacattttagcagaatctgaacatctgagcatttagcctaaggcagttaactccctacaaagtgtccatgaaacaaatacatctgaaaaggcctatgctccaatgcagatctgtaatccatgagcagttttggagtacagatcagattaatgaagatactttaacaacatgccacctaatctgatgttaatagttaacgttacccctgaattggcaggaattgtcaaaggaaatagagatgcaagcttacatcaaatttaaaagtatggcaggatgattatgtagataatgtgttaagtggttttcacagacaaattaactatgcacagttatatattaacataatgccactgtattttagtaaaactggaaggtagtaaaagttagcctggttatttttcaggacttggtttcccttatatttttataatatttaaccaatcttctagatttctgtggagggggaaaaagcattttagaatagttctgatttgattttaaaggcctcattataggttttcatagatgctgttaagcttacgtttatttctgatgtttttaaagtagatgtggattctaacaaaacaaatattgaaatgattgagtcctttgaatttttaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggttagtctaagatgatttgagggggtgggaggagttcgacctggctttggatttgcgtctttaacccagaaaggccttaactgtttgctgttttgttttgtttaggaggctaaggagaagcgccaggaacaaattgcgaagagacgcagactttcctctctgcgagcttctacttctaagtctgaatccagtcagaaataagattttttgagtaacaaataaataagatcagactctgatctctgttgactttncattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggatacctagttttagtggataccatccactaaatggtttttaagccatttcaaatttgttttaacaaagcttttcaactccagtgaattgttaggctgttcacacactgaaaaggaaatgactaaaaacattcttggatcatgtaaaaatgcacaaagtatgtacttttttctaacagttctatgctgactagcctattgtgacaatatcaggatctttagaaggtggcacattaggctttaaggttgaagtaatgcaagctctttgttggcattactgtaataatagctttacaaagcagagttctaaatgttaaatgtacatgtgaatcacctaggggtctggttaaggcgcagatagtgattgatagangagtggggacccacatttttacattactaaaaagctcccaggtgttaggccggtagtgccagtccctcgatgcctactaagantcttaactattcctcttactacatggtgttaa

SEQ ID NO: 2193 - DNA, 889 bp, Homo sapiens
gctcgaccccctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgaaaaaaaaaaaaaaaaaaaaaaaagtcaaaaaaaaaaaggggggggccactataggggaccccgaaa

SEQ ID NO: 2194 - DNA, 502 bp, Homo sapiens
ttaaccaatcttctagatttctgtggaggggcaaaaagcattttagaatagttctgatttgattttaaaggcctcattataggttttcatagatgctgttaagcttacgtttatttctgatgtttttaaagtagatgtggattctaacaaaacaaatattgaaatgattgagtcctttgaatttttaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgacaaaaaaaaaaaaaaaaaaaaa

SEQ ID NO: 2195 - DNA, 377 bp, Homo sapiens
ctcagaagccccatgaaggtgccactgtctctgcagatgaggaaacaggctcggagaaacgaagagacctttgccacggtgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacagggagctgtcaggtggggatgcagtttcctgttctcagcaggaagcagccatcggtgctcatgagaagtctccaggtgctcaaatgttggcagccaattttaaaaaaataaatcaggcc

SEQ ID NO: 2196 - DNA, 663 bp, Homo sapiens
cagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacggtcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcgggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagctgggggcgtcactgcagggcaccggcagaaactggggtctgaaaacagcagcccagaatggatttggaacagaacagggtggtacagaaaggaagtt

SEQ ID NO: 2197 - DNA, 903 bp, Homo sapiens
ataacactagatgtcacgtaacaaattaaaagctactaacccaagatctatatgctaacaaaaccttcattattctcccaccaaagggcacattacagaagtaccatactagttcctgaaatatataaattccgaatgataccaagtgggctaaactgaatttgaaaattgtctagggcttatcacactgtaatgttactacagggaactgacctgtcagggtgctgtaatggtggatcaacaggaaagcctcccctcaatgtctccaatgtcccttccatttaacaggctacaattccaaggattttaaatcatggaggtagtagtgggtccttaaccttatgaaccaaagctcctatactagaacaggtgggatctatttcagcttgtgagagaagttcaagaaaaactgaagaagtgcttcatcaaacaccaaataataaggttataaatccccaatccatcattctactgttgtttcttgatctttatttttccacggccccgctaaggaacatctgtataagtttctctcctaattgcctccccatggaattttaatactacagctgtacacagatataccacactgtacatctgttcaggaactgggatcttcgggaggccacaaatcactgtaatgcctaagttttttcacccttcttccaataactaattttcactcccttgttggagatatcgccctcactgagaatgcatgttctgatgtatggaaagaaacccagaaaaatgaattccaaatttggtagctgtggggagctgatgaatggggagaaagggcaaaggaactcttaacgagctctatgtatttctgtgttgtttggatatctttcaatgtggactgttcatgtgttacccttattaaagaaaaagatggaaaaa

SEQ ID NO: 2198 - DNA, 811 bp, Homo sapiens
  misc_feature (1)...(811): n = A,T,C or G
cccagtaatatntccgcctanttgggatnggcggtacattcccngacacttgctgttccaattaacgccccataggaattgccccgggccaaattcggagcccccaatactgaccagactggacagacagacatgcaaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttaaaaaaaaaaaaaaaccaaaaaaaaaaaaaaaaaaaaaggcgccgctctagcggatcganggatacgtacg

SEQ ID NO: 2199 - DNA, 1745 bp, Homo sapiens
cgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagcctctgtgacagtgaccgtctccctttgtacatacttgcacacaggttccccatgtacatacatgcacatactcaaacatgcgtacacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaagggaaaaatgcaggatgttaccgtaaaattccagctgctattcatggagctgaaaaacaagcacaaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaa

SEQ ID NO: 2200 - DNA, 538 bp, Homo sapiens
  misc_feature (1)...(538): n = A,T,C or G
tttttttttttttttttgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcaggtatgtcccctgtgcaaccgccccctggcaggattcggagcaggagatgagtaggcatgtggagcattgcctttctaaggtagaggggccatcaccacccaccttccttcccgctcccttcccccgacactagctgntgacttgccctgaatctgtgggctcttggggtct

SEQ ID NO: 2201 - DNA, 1044 bp, Homo sapiens
  misc_feature (1)...(1044): n = A,T,C or G
tttttttttttttcatattaaatgttcttaccagagtttaaattttaaaaaatcaactagggctcaccctcaacacccccctccatttgtcaacctctacagcctgcatgccacaggaatcagcagcctgactgttgcacttgtccaaacacaactgactgcaaggctcccacagacacatgcccaggcactcctgccccttaggattctgtggtaagcagaccaccagcagacagaggcccccaggagacaggcccataggaattttctacttaggggaccgcaaagtcccaaagggctacagggagttgaacgagaagagtgcccgacagattgcaggttgtggggaggtgtcaggcatttatttctggagcagaggtgagatggagcaatggcctcagcagcggacgcagttgcgcatgaagtcgacacagaggcttgtgtagtaagtagggtagtcacggaggtggctgacgtgtgcagatgacacgaaatccacagaacgcgccaggacccggcgtgccaggcgtgcctccaccatgcgttctatgtctctggccaggactacttcgtcagccctcgagtagaggtagagctcgggccagcgagagcccgcgtcctgtaggccccaggttgctgtcaccaggagcgctgtcaaagatggtgcccaccacacgcaggcggcagaagcgacgggtctgcaggagctccagcacgtagcggtacagcatgacgccaccgttgctgaagacatggaagagcaggggctccttctcaatctcataatcaaagagcagctcgagcagcttccttttgtggtagatggcactgtacttggcaaggttcttgtccttgcagccaccccagcccaagagaatcaccacaggctgccgagtttctgcctccttcccacctgggctggggctgttcttctggctccagcagggctgatccgggatctcgatggtgtagtcccgccctgccgaggccatggtgaaggcgccggcccagagcacgggtctccagccggaactncaccttgcg

SEQ ID NO: 2202 - DNA, 935 bp, Homo sapiens
  misc_feature (1)...(935): n = A,T,C or G
tttttttttttttttttgtggggaggtgtcaggcatttatttctggagcagaggtgagatggagcaatggcctcagcagcggacgcagttgcgcatgaagtcgacacagaggcttgtgtagtaagtagggtagtcacggaggtggctgacgtgtgcagatgacacgaaatccacagaacgcgccaggacccggcgtgccaggcgtgcctccaccatgcgttctatgtctctggccaggactacttcgtcagccctcgagtagaggtagagctcgggccagcgagagcccgcgtcctgtagcctgtcatagaagtgggtgtggaagagggctgtgatgggagcaagcaggacgtggaacaggacgaccaccagggcaaaggccaccagcagcaacaggcgcagcatggcggcccggcgctccaggatggctgccagggcccgcagagcccctaccaggttgctgtcaccaggagcgctgtcaaagatggtgcccaccacacgcaggcggcagaagcgacgggtctgcaggagctccagcacgtagcggtacagcatgacgccaccgttgctgaagacatggaagagcaggggctccttctcaatctcataatcaaagagcagctcgagcagcttctgggccaaaacacgaagtgaagggatacccagtgactcggagaagaagaccatgtgccacggggctgtgtatcggattacgatgcagccccttttgtggtagatggcactgtacttggcaaggttcttgtccttgcagccaccccagcccaagagaatcaccacaggctgccgagtttctgcctccttcccacctgggctggggctgttcttctggctccagcagggctgatccgggatctcgatggtgtagtccgagtctccgaggccnatggtgaaggcgccggcccagagcacgggtc

SEQ ID NO: 2203 - DNA, 1557 bp, Homo sapiens
  misc_feature (1)...(1557): n = A,T,C or G
tgccgaggagcccgnagcgccggaggagcagaggggccggcaggagggcccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcaaggggttggctgggagctcggcccatccacctcttggggtacctgcctctctctctcctgtggtgtcccttccctctcccatgtgctcggtgttcagtggtgtatatttcttctctcgtgtgagggggttgacctgatagacaaccctgtgatcaagaggattgcaaaggagcacggcaagtctcctgctcggggggtagaggcaggaaatg

SEQ ID NO: 2204 - DNA, 802 bp, Homo sapiens
  misc_feature (1)...(802): n = A,T,C or G
ggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaaagcggatacgggccaccactctcctggaaggtggcttccgaggtacaagcagctgacacgtagacattggcactctggtgccaggcctctgctgggtatccatctgctggaagccaagaggccgaggctggtggctggtcatccatccgttccaccacgtggggactgctgctggtggggctcctttgtgaccgtgctgcctgcctgtgatgtgcatattaaaatggatgtatttgggtggggaaatggaattgtgaggctgcaagctaggagtgacgaaggggggctctcagcttcgggtgatgcattgaaggtgacagccaagccgcgttagcactctggctccagcagggctgatccgggatctcgatggtgtagtccagctctgccgaggccatggtgaaggcgccggcccagagcacgggtctccagccggaactncaccttncnacccgtgcctcacccgggcgcc

SEQ ID NO: 2205 - DNA, 510 bp, Homo sapiens
  misc_feature (1)...(510): n = A,T,C or G
agattcggcacgngtggnanntnncnatngtgagtcgaagtaaattntaaccangtcagtttgagtcnctnttactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgnctccttcagggttggctgggagctcggcccatccacctcttggggtacctgcctctctctctcctgtggtgtcccttccctctcccatgtgctcggtgttcagtggtgtatatttcttctcccagacatggggcacacgccanaggggacatgatcctctccttagtcttaagctcatggggctctttataaggagttggnggggtagaggcaggaaatgggaaccgagctgaagcagaggctgagttanggggctagaaggacag

SEQ ID NO: 2206 - DNA, 477 bp, Homo sapiens
  misc_feature (1)...(477): n = A,T,C or G
gctctgaaggctcgggtcagagaacttgaacggcagctatctcgtggggaccnttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcngnccttcgcntccagcagccccacctgcccccagcctctgtgacagtgaccgtcttccctttgtaacatatttggcacacaggtttccccatgttacattacatggcacattattcaaacatggcgttacaacaacaacacactttttacacaggnagggattttgggnggccagngttggagggttttgggcccgggggatttacntgttgggtttcccacntttgggttttggggg

SEQ ID NO: 2207 - DNA, 417 bp, Homo sapiens
gcccggcgctccaggatggctgccagggcccgcagagcccctaccaggttgctgtcaccaggagcgctgtcaaagatggtgcccacctacacgcaggcggcagaagcgacgggtctgcaggagctccagcacgtagcggtacagcatgacgccacactttctgaagacatggaagagcaggggctccttctcaatctcataatcaaagagcagctcgagcagccttttgtggtagatggcactgtacttggcaaggttcttgtccttgcagccaccccagcccaagagaatcaccacaggctgccgagtttctgcctccttcccacctgggctggggctgttcttctggctccagcagggctgaactcgggatctcgatggtgtagtccacgtctgccgaggccatggtgaaggcgc

SEQ ID NO: 2208 - DNA, 381 bp, Homo sapiens
  misc_feature (1)...(381): n = A,T,C or G
tgggtanccatcttnttggaacccaaagaggccgaggcttgtngcttggtcatcaatccgttccaccacgtggggactgctgctggtgggctcctttngaccgtgntgcctgcctgtgatgtgcatattaaaatgatgtatttgggtgggaaatggaattgtgaggctgcaangctaggagtgacgaacgggggctctcagcttcgggtnatgcattgaangtgacagccaagccgcgttagcacctgtgctgcccagtctggccggagtgtgagttgcccctctgtcccagcagagatgccatccaccagcaatggtgaaagcagcaagcangaggccatgcagaagactctggctccagcagggctgatccgggatctc

SEQ ID NO: 2209 - DNA, 1614 bp, Homo sapiens
gctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggaaaaaaaaaaaaaaaaaaaaaaaa

SEQ ID NO: 2210 - DNA, 733 bp, Homo sapiens
  misc_feature (1)...(733): n = A,T,C or G
tgcttgcaaattctgcctgcaggactgtcctgccaggttccagtgggtatcactacccctgtttaagagtgccacttttgaggtcacccagtcattnacctagaacagcagnacatggtctggctatncagctcagactctcgtccgaatcctctcacatggtggctttaggaagatcctggcccaggagggtgatgccagctatcttgcttctgaaatatctacctgggatggagtgatagtaacacttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattcccctgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggaaaaaaaaaa

SEQ ID NO: 2211 - DNA, 585 bp, Homo sapiens
atgacttttatgctgggctactcgtctaaatcacctttttctctttcctagatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggaaaaaaaaaaaaa

SEQ ID NO: 2212 - DNA, 532 bp, Homo sapiens
  misc_feature (1)...(532): n = A,T,C or G
ttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgcctgaagaaggaatnaggaccctggctcccaattctgctgaacaggcatctatcctttctctggtgacaaaaattaaacaatgtgattgataatctgattgtggctccagggacattttgaagttgcaaaattggaagaagttcgacaagttggggnttcctaataaaaaagggggccaattggcttccagggccccnaatgttggcttgaccntgggttggtgaanacccaagaattcttgccaacngtttggaagcntgttgcttgnccctgggggaaacnaaagttcgttggnaaagccctaaagagcccaggatncctttcctggnaagttttttaacccaatgg

SEQ ID NO: 2213 - DNA, 505 bp, Homo sapiens
tttttttagaagtgccattttgatggcacacctactggatttattatttttcagggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgacccttagaacagcaggtattgggacagatatgactgctatcttgcttctgaaatatctacctgggatggagtgatagtaacaccttcagaaaaggcttatgagaagccaccagagaagaaggaaggagaggaagaagaggagatacagaagacccactcaagagaggagagaagcatagaaactcagggtacattcctccactcttt

SEQ ID NO: 2214 - DNA, 214 bp, Homo sapiens
  misc_feature (1)...(214): n = A,T,C or G
gttgctgccctggggaacaaagtcgtggaaagcctaagagcacaggatccttctgaaggtttgcatttgttgctgattctgtatttagtagccataggaaccaggtcttgtaattgtaagtacactttcaacaaaatcagatcagaccagatggaagagtaaatgcagagttttangtggtgggantttttgncaggggctcnaggggtccaag

SEQ ID NO: 2215 - DNA, 1742 bp, Homo sapiens
gcaattctgcacagacttacaaactgtgcatgtaaaagtgtaaaagcatgtatcctcttattgtagtcttaaaaagctcgtggaatctagggacacagaagattctgtggcacagatttaggtacagagcaaaatactcactggaaaaatcaagtattggctagctaccacggggatttgatcctagctggcaaacgtggaactccgcaaatactttttttttttttttatgtatacttgttttattcataatttgtcatgttctgggataccaaaagtaataatggctgaacttaacaaaatttgtaacctcatcttaatatccactgatccatctcattcaatggtaacagtcaatgttttctaaaggaacataaaaacaaacatgcacacaattgcacagttttcataaaggtctatttcattattggtgggtagcgcatttaacagttaaatacatttaaataatgtataggtgactgcaggactgcagcattggtaactagataaccaactagaaaccagctaacaaagaactgtctaaatacttaaaatacagctcttgttgagatcatcctttgttttgatcatcttcttgggggaaaaaagcctgctgctggtcacaatggaaatatattaaggccaaatcttctgatatccattcccaaaggtttctttcagctggattaagcctccaactccagggcgagcccaaccttgtggcctccagcattaatgctcttcccatctaccagagcagagagtgtaagcttcacaccaggcctcagagtctgagtatagcctactccaattaagctagagttgttgacttttgcagaaatggaagcagtgggatccaactgatatttagctgcaatgccaaaacgagtgcagttggtacctgatgtccaagcaaggtttactgaagtgtcaagatcttcacaaactttctgataaattgatcctccaaattctgtcccatcattgacattagtgtgtagctggaagtccccagtcctgtagcccactgcaaagttattccttgtcagctttgatttggcactgtcaaaggtcatctggtagccagcaagccagccctcataaccaaagacagctgaaccatggattgcaggtccagcaaaatcaaagtcaacatcacaaccaaggtttatacactccctcttgtaagaagacttgattttaccacttttctttcctgtgtttggtgagaaggtagtatcaaatgtcagtttcaaaccttgacaaatctggtcttcaattgcgatttctgttcccagagtgttatcagtgttccacttttctgtgaaagtcagaccatactcacaccacttgtatttggtctccaaggtcccagtaactttaccagtgtctgtattagatgaaccggacgttgaaaattccacgccactgcaagactttgttttcacatccagtttcaccaacccaaaaccaaatcctttgttgaaaatatctctggcagctttgccaaggtcagcatatgatggaggaatacacattggacgcgcgcaagtctgtccgtgggtcgccatggcgaggccgcgggaagaggggaatctggtggtgtcctgaggggggccgccgcccaactccgctagctgctgaagccgcttggcacgctcgcggtcgggctgcagctccagcagctggagggcgaagtgaaggagacaccgttccgcccgccgcaaccctgctgtgccgaa

SEQ ID NO: 2216 - DNA, 1464 bp, Homo sapiens
cacagttttcataaaggtctatttcattattggtgggtagcgcatttaacagttaaatacatttaaataatgtataggtgactgcaggactgcagcattggtaactagataaccaactagaaaccagctaacaaagaactgtctaaatacttaaaatacagctcttgttgagatcatcctttgttttgatcatcttctggggggaaaaaagcctgctgctggtcacaatggaaatatattaaggccaaatcttctgatatccattcccaaaggtttctttcagctggattaagcctccaactccagggcgagccaaccttgtggcctccagcattaatgctcttcccatctaccagagcagagagtgtaagcttcacaccaggcctcagagtctgagtatagcctactccaattaagctagagttgttgacttttgcagaaatggaagcagtgggatccaactgatatttagctgcaatgccaaaacgagtgcagttggtacctgatgtccaagcaaggtttactgaagtgtcaagatcttcacaaactttctgataaattgatcctccaaattctgtcccatcattgacattagtgtgtagctggaagtccccagtcctgtagcccactgcaaagttattccttgtcagctttgatttggcactgtcaaaggtcatctggtagccagcaagccagccctcataaccaaagacagctgaaccatggattgcaggtccagcaaaatcaaagtcaacatcacaaccaaggtttatacactccctcttgtaagaagacttgattttaccacttttctttcctgtgtttggtgagaaggtagtatcaaatgtcagtttcaaaccttgacaaatctggtcttcaattgcgatttctgttcccagagtgttatcagtgttccacttttctgtgaaagtcagaccatactcacaccacttgtatttggtctccaaggtcccagtaactttaccagtgtctgtattagatgaaccggacgttgaaaattccacgccactgcaagactttgttttcacatccagtttcaccaacccaaaaccaaatcctttgttgaaaatatctctggcagctttgccaaggtcagcatatgatggaggaatacacattgtaatgtgactctcaagtcctcggccaatgctgtgctgcttaagggcaggcaatctgagctcattacaccagctcattcattccacaaagcacgtccacgcccttaggagcacaagtaatgaccttgcgctctcacaagagggactgctacttcctctagaaaagtgattgatccgatcgacgcgcgcaagtctgtccgtgggtcgccatggcgaggccgcgggaagaggggaatctggtggtgtcctgaggggggccgccgccacgtccgctagctgctgaagccgcttggcacgctcgcggtcgggctgcagctccagcagc

SEQ ID NO: 2217 - DNA, 1020 bp, Homo sapiens
caaaataaaaattactacaaaacatttcagatacaagcgaggaaactgacaggaagtgggtattaaataataaggaatcactaactttcttaggtgtgatagtattatagttatgcagaaaagaagagacgggccttattctgaagagaagtgtcatgaccaaatggcccagcaaaaaaaaaaaaagcaaagaaaaagaaataaaaaattgtggtaaaaggtaaacacgtatttattgtactcttctttcaactcttctgtgtgcttgaaaggtctgaaaagtaagctgaagaatgaaaactaaattttttaatactatcaaaacaatcctactttatcaagaatacttaccaggcctcagagtctgagtatagcctactccaattaagctagagttgttgacttttgcctaaaataaaatacaaaaacaactgtaagaaaaatatttcaatagagacaaagcccctacatgtttccccatcatgtaatcatgaagtgttcagttttattcacgtgagacaataaaattcaatattatgtattaagccaaacaaaccaggtactatttaattcgtatccattcaactcaaaaatcaaattctcagtaggacacaatactcttgatagccactggaatgtatccaaagaccccaaactgtccatacagcacaaaagcctaagcactctcataaaaatcatctttgttaattctagtctagcacaacaaaccagaccaaaatgtggtacaagtcaggctcactagaggtgacacacagcagccttaaagcacagggtataaagtttaaattcatgacttagttacacacattactacttccaggactcttcctaaagaatcaaaaccatgaatgtttaaaaaaaaaaaaaaaatctccaaacgacaagtaattcctctgaagaatcagatcaaacaatcctttatcctcacattcttacacctctcataaatgccggtgctgctgagttctggctgtatgtaaccactgcgtttgggaggag

SEQ ID NO: 2218 - DNA, 1047 bp, Homo sapiens
  misc_feature (1)...(1047): n = A,T,C or G
cttttaggaccatttatgccaatggggtatttccaccagtctaaataaaggggagnagggtatggaccaaaattttcangaaactcaaattcacctgaaaaagctcataactctagataaagtattaggagtcaccacaaaagcaaancagtaatatatcgtaactctagtcaaccagggcntaagctataactgaaaaaaaattaaagcacgagccgtttttcttaaaggctcaaatcttctaagtacagtttttaaaaattttgggaaattgggggagggggatgtagactgtaaaagaactattttcacataagtttaatctaagtatcttaagtttctaatagaagaattaatacaaggctgggcacagtggctcatgtctgtaacgtaatccaaccaggctttgagaggccactgtgtttactgggtaacacagtgagaccccacctctacgaaaaataaaaaaaattagccaggtgtggcagagcgtgcctgtagtcccagctacttgggacgtgggaggctgaggaaagatgatcgcttgagcccaggaggtccaggctgcagtgaggtataatcatgccactgcatccagcctgggcaacagagggagaccctgtctcaaaaaaataagtaactctaaatttaaagcagcaagatatttacaatttgcaatgattgatctgatttcgctaagcaacccaaacatacattttcactctttatctaaaacgttttaaaaataaggttcttaccaaatcctttgttgaaaatatctctggcagctttgccaaggtcagcatatgatggaggaatacacattgctggtagaaaaaaaacattccagtgttaatgtctctattctcccaccttctatccaagaacaagagcatgacccactgctgatattaaaattcaagcaatcccatttgttggaatgttttttatgcggtcaggagctacaataaaactataacgacccataaaggagataccaccaacgaattatttctaaaacagataaccatgattatacaaacttgg

SEQ ID NO: 2219 - DNA, 2255 bp, Homo sapiens
  misc_feature (1)...(2255): n = A,T,C or G
aggctgagacaggatgatagcttgagcctaggatgggcaacatatggagatcccatctntacaaanaaacatcaaagaattagttgggaatagtaggaggctgaggttgaacccaggatgtcaaggtgccgggagtcgtgattgtgccactgcagtccagcctcgacaacagagagccttaaaaaagcactattatttctgacacagtaagaaccactcagggaccaaacaccagctatacctggacttagacaggcctatggctcaaggttatcatcaacattaactcggcagcttttgaggttaaacaaactccaccagcctggcctggaaataaaacgtctaacactgtatccatcaaaaaagcgcatttcaaaatctaaaactaatctatctgtaaactggggactgtgtgaaatcagttcaaattttcaacataattcagtatacccaaagactcattcccacaaccaaaacccccattctaagtccacaaaagtactcacagaaatggaagcagtgggatccaactgatatttagctgcaatgccaaaacgagtgcagttggtacctgatgtccaagcaaggtttactgaagtgtcaagatcttcacaaactttctgataaattgatcctccaaattctgtcccatcattgctataagatattttaaattagtagatctagaatagacaatgtaataatgtctaaggcacaggctgatttgtagcattacatttaaataaaaaaccacagctcaagtgggtctttagtgttccactgaaaacttgcaagttttaacaggtttttttccccaacccatacccatacagggattggtaaaatgaaccacagaatatccattcagtggaattatcacactgtattaaacatgcaagaggttctcaaacagccttttggttacgtattttatatataagtatatatacacacacatataaaaaggtgaaccacaacattaacaaagattatatacctagctggcatgattgtaagaaacgtaggttttcttctttgtgcttctgttatttaccaatgaatttttacaatggaaagaaaaacattttaagtactttctaatgtgtctctctagtcctcggccaatgctgtgctgcttaagggcaggcaatctgagctcattacaccagctcattcattccacaaagcacgtccacgcccttaggagcacaagtaatgaccttgcgctctcacaagagggactgctacttcctctagaaaagtgattgatccgatcctccaaaggcagaatccccaattaacaactttttacttctatacgtcaaagacatgtacaaaggctgaaaagtccatgcggccacagaccaactccccgggccttgttccccatttgaaatccagcagcccagcccctcctccgcagaggaggtggtcagacggtggggcgaccaccaaaagcagccgaatttccaagttcttggaaagatagggggaaacaaactgggtttctggtcgacaggcttcgactctccgccgccccatcccgcagagatcccagctttacttacgacgcgcgcaagtctgtccgtgggtcgccatggcgaggccgcgggaagaggggaatctgcgggagggacaagaagtgcggtaagctggggtcaaagggccaaagggagatcccgggcagagaggggcgaggggccgcggggcagcgcggccatcttaggaagccagggccgactccgagtccggcgcgggcctccggcttggccgccgcggcctaggcccctgggtcggcgtgaggcgggcgcggcggtacctggtggtgtcctgaggggggccgccgccaccgctccgctagctgctgaagccgcttggcacgctcgcggtcgggctgcagctgcagcagctggagggcgaagtgaaggagacaccgttccgcccgccgcaaccctgtcctctcccagacaggaccccgccgctgcccccggggctgtccgccgcgcctgtccctgcagcgcagcccgctgccaactccaacctgctccagagcggccacgtggaccgacagcgccccggtcctgcaggtgggctgcctccgtccgtcggtggggatccggaaggcagaagctgctgggccttggatcaggcagctatccgggcagcctcagaggcgagggggcggggaacggcggaggcagcgcgctggggaccgcctgggagggggatggggcggaggccccgcgcgaacgcgt

SEQ ID NO: 2220 - DNA, 1061 bp, Homo sapiens
gcaattctgcacagacttacaaactgtgcatgtaaaagtgtaaaagcatgtatcctcttattgtagtcttaaaaagctcgtggaatctagggacacagaagattctgtggcacagatttaggtacagagcaaaatactcactggaaaaatcaagtattggctagctaccacggggatttgatcctagctggcaaacgtggaactccgcaaatacttggagccattaattatgtatacttgttttattcataatttgtcatgttctgggataccaaaagtaataatggctgaacttaacaaaatttgtaacctcatcttaatatccactgatccttctcattcaatggtaacagtcaatgttttctaaaggaacataaaaacaaacatgcacacaattgcacagttttcataaaggtctatttcattattggtgggtagcgcatttaacagttaaatacatttaaataatgtataggtgactgcaggactgcagcattggtaactagataaccaactagaaaccagctaacaaagaactgtctaaatacttaaaatacagctcttgttgagatcatcctttgttttgatcatcttcttgggggaaaaaagcctgctgctggtcacaatggaaatatattaaggccaaatcttctgatatccattcccaaaggtttctttcagctggattaagcctccaactccagggcgagcccaaccttgtggcctccagcattaatgctcttcccatctaccagagcagagagtgtaagcttcacacctattaagacaaaaaaacacaaaaacaaaaaaccgtgatgtacctggcacgtcactcagtctgggccttctttcacagtcatccccagagcctgcctgtcacttcctcagcctgtcagctgacctactagtgctggccaccagagggcgcttggaagtatctgagacaccagaagaactgggttaccattctagctaaggcaccaagtcacagagaaatgttttaataacaacttcaaagtgttctagaatatactataatgttgagtatactatcccgatga

SEQ ID NO: 2221 - DNA, 869 bp, Homo sapiens
cccaaccacaaaacaccatacattttaggcaatcctatcaagtcagcatctcacacatcaaaataattaagtaaaatgaatgtactggtagcagtctgccaatatataatgcctcttgtaaaaatacaaagcacattaaaccccatataaaatgaacatttactctctcagcaccaaaggtcagactaacagtcttctactataaactttcaaggggcaccctagaaatgaccaagaatgattttgtttttaaatgttatgagaaatcctttagggtgcacccagatcaataagatgacagacatcaaaatcatcctctgagggcccacatcacagtatcctatgaaagaaatacttacacattagtgtgtagctggaagtccccagtcctgtagcccactgcaaagttattccttgtcagctttgatttggcactgtcaaaggtcatctggtagccagcaagccagccctcataaccaaagacagctgaaccatggattgcaggtccagcaaaatcaaagtcaacatcacaaccaaggtttatacactccctcttgtaagaagacttgattttaccacttttctttctggaaaaagaacaaactgatgtcattgggaaaaatttacacacacttctgcacaagagagcacaaaacagacttaaataaactgcagtatgaccagggagtaaaaatcagcaatacaataacagggagtaaaaaagtcagctcaatgaactacaagacaaggacacatgaagcaactggacagccatctaggaaaactgctttgcagaacaaacaatcagtcacaaaagcctgttagaaacacattagttgcccaagttagtgcaacaacaaagaggcaaa

SEQ ID NO: 2222 - DNA, 766 bp, Homo sapiens
gggcgtggtggctcatgcctgtaatcccaccactctgggaggccaaggtgggcagatcacctgaggtcaggagttccaggacagcctggccaacatggcgaaaccccgcctctactaaaaatacaaaaattagctgggcgtggtggcacgcacctgtagtcccagctactcagggaggcagaggcagaagaatcgcttgaacccaggaagctgagactgcagtgagccaagatgatgccactgcactccagcctgggtgacacagcaaagactccatctcaaataaataaataaaagcagatacagagatttcaccaccacaaggtagcttaataagctatcaaacagtaaatgtacaccttttctaaatatacaaaagagaaatacttttaaatgtaatacagataaaaatgtctgtgcttaccctgtgtttggtgagaaggtagtatcaaatgtcagtttcaaaccttgacaaatctattttgaaagaaaagtaatttgttttctttttttgaaatacaaaaataaattaataaaattaatactaaaattttcaaaatgttacctggtcttcaattgcgatttctgttcccagagtgttatcagtgttccacttttctgtgaaagtcagaccatactcacaccacttgtatttggtctccaaggtcccagtaactttaccagtgtctgtattagatgaaccggacgttgaaaattcctaacaagacaatcaataacttcatgaacattctcataagcctagaat

SEQ ID NO: 2223 - DNA, 607 bp, Homo sapiens
  misc_feature (1)...(607): n = A,T,C or G
ctcataccnaaagacagctgacccaggaatgcngcccagcaaaatcaaaatcaacntcacacccaggtttatacactcccncttgtaagaagacttgaattttaccacttttcttcctgtgtttggtgagaaggtagtatcaatgtcagtttcaaaccttgaacaaatctggtccttcaattgcgaatttctgttccccagagtgttaatccagtgttcccacttttctgtgaaagtcagaccatactcacaccacttgtatttggtctccaaggtcccagtaactttaccagtgtctgtattagatgaaccggacgttgaaaattccacgccactgcaagactttgttttcacatccagtttcaccaacccaaaaccaaatcctttgttgaaaatatctctggcagctttgccaaggtcagcatatgatggaggaatacacattggacgcgcgcaagtctgtccgtgggtnccatggcgaggccgcgggaagaggggaatctgcgggagggacaagaagtgcggtaagctggggtcaaagggccaaagggagatcccgggcagagaggggcgnanggccggggcnagcggcccgcgaattcttcca

SEQ ID NO: 2224 - DNA, 584 bp, Homo sapiens
tttatgtatacttgttttattcataatttgtcatgttctgggataccaaaagtaataatggctgaacttaacaaaatttgtaacctcatcttaatatccactgatccatctcattcaatggtaacagtcaatgttttctaaaggaacataaaaacaaacatgcacacaattgcacagttttcataaaggtctatttcattattggtgggtagcgcatttaacagttaaatacatttaaataatgtataggtgactgcaggactgcagcattggtaactagataaccaactagaaaccagctaacaaagaactgtctaaatacttaaaatacagctcttgttgagatcatcctttgttttgatcatcttcttgggggaaaaaagcctgctgctggtcacaatggaaatatattaaggccaaatcttctgatatcccattcccaaagtttctttcagctggattaagccctcaactccaggggggagccaacccttgtggcctcccgcataaatgcccttcccactaaccgagccgagaagtttaggcttcacacagggctcaggagtctgggaaaagcctaatcc

SEQ ID NO: 2225 - DNA, 493 bp, Homo sapiens
  misc_feature (1)...(493): n = A,T,C or G
aatancaaangtcantttcaaaaccttgaaaaatctggtcttcaaatgcgaattctgttccccaaaatgttaatcaatgttcccacnggggggttttaaagtcagaccatactcacaccacttgtatttggtctccaaggtcccagtaactttaccagtgtctgtattagatgaaccggacgttgaaaattccacgccactgcaagactttgttttcacatccagtttcaccaacccaaaaccaaatcctttgttgaaaatatctctggcagctttgccaaggtcagcatatgatggaggaatacacattggacgcgcgcaagtctgtccgtggnntgccatggcgaggccgcgggaagaggggaatctggtggtgtcctgaggggggccgncgccnacctccgctagctgctgaagccgcttggcacgctcgcggtcgggctgcagctccagcagctggaggncnaagtgaaggagacacgttccgcccgcc

SEQ ID NO: 2226 - DNA, 403 bp, Homo sapiens
gatttctttcagctggattaagcctccaactccagggcgagcccaaccttgtggcctccagcattaatgctcttcccatctaccagagcagagagtataagcttcacaccaggcctcagagtctgagtatagcctactccaattaagctagagttgttgactttcgcagaaatggaagcagtgggatccaactgatatttagctgcaatgccagaacgagtgcagttggtacctgatgtccaagcagggtttactgaagtgtcaagatcttcacaaactttctgataaattgatcctccaaattctgtcccatcattgacattagtgtgtagctggaagtccccagtcctgtagcccactgctgtccaagcaaggtttactgaagtgtcaagatctttgctga

SEQ ID NO: 2227 - DNA, 396 bp, Homo sapiens
  misc_feature (1)...(396): n = A,T,C or G
tccaaagcaacatcaccaaccaagggttacacacccccccttggaaagaagacttgaatttacccacttttctntcctgtgnntggtgagaaggtagtatcaaatgcagtttcaaaccttgacaaatctggtcctcaattgcgatttctgtncccagagtgttatcagtgttccacttttctgtgaaagtcagaccatactcacaccacttgtatttggtctccaaggtcccagtaactttaccagtgtctgtattagatgaaccggacgttgaaaattccacgccactgcaagactttgttttcacatccagtttcaccaacccaaaaccaaatccagcctctcctaggcattcacgtgaaaagcaatggcagatccacgtggcctgtattgggg

SEQ ID NO: 2228 - DNA, 3349 bp, Homo sapiens
tttttttttttttttttttagtcttaagcagtcacacaagtctaagccacatttatttgcacatgtatagtaatggccaacagatactccaagttcatacaaatttgtaaaacaacaaagttaataatcacttggtacacttgtgtgttatcttgcttacatattaaaacctagatgaacttccttcattttgtggacttccatacaatacttccttaaacaaaattcttgaaaacacatatcagcatgtttaagttagagccaacacaaagttaagacaagacacaaactcaaaaaccaagtttgaaagatacttttctacctccctcccctagaaagaagtgattttctttaacagatgtatgttatatcacacaagtaaccatgaagacaaaagaatgacgctcccatcatcaggaagaaaatgccaaccagatcatactgtttagttatctaccgaacatatggttaaaatatgagaaacgggggaaaatgcttagattaaaataacaagggagaatagaaaatagcaaatgattttaaagagaactgttccccctcaaagctgcaaagctctgactctgacaactaaaaactgtccaaggcaaataaaaacgaggaaaccttcaaaaacattctaatcacgtgcagtatctagtgttaaaagctgaaaatgataaagaggatatttattatacaagtgtcaacgaggacatcccaaaaataatgaaataaacacacatttatttctacaaaagcaatgtatgatacagaattagaagggaacagacttaaagatttgcctattaaaatatacagattcttactgaagagtataggatatttaaaaaagatgacaagggatgttaatctttttttattattatcatttttacatattttggaacctcacataattttgataaataactcttacaaaattatgcaaaaagtacaagaatgtctggtaaacaaacagtctgtattttccaaaaagattttttacaacatgcaattcttaaggcagcatcctctttacaaggaaaggtaatccttttttatcaagaaatcttctgctgcaaagaatggctaagaaagcctggcttcttccattaacgccttttgtctttcctgtctgattttcggtctctttcacttcttgaagatcttttgcctgatcgactactctctgatatagacctctttctgtcggaccgggaattcttatcctttgatccttttgtatctctactactaccaccttttgaagatttgtgacttctttctagtcctgaagtatcccttctcttccgatccacgctccttctgtgctttctatctctattatgtccccggcccctactccgacttctactctcactactactactagtgctactgctactatctctgctgctgctgccacttgtactggagctgctactggaactactgcgactgctactacttccactgctggaactacttccactgctgctactggttgaactgctactagaactgctactgctactgcttcgacttctactcttgcttgttttatttctagctcgacctctacttctgctcctaggttttggttttgctcttgctctctggatgtactgtcaagactggctctactggtacctcagtgagttttacagactctacaggaaaatccttcctctcaggtagtaaatgcccttgctcctgagtaacttggggtgttggctgtaaaacagctaatgacaaatcctcaggctgagagggaggctgggactggagtactggttgggactgggattgaagctgaagctggggctgagactgaggctgaggttgagccacaggctcaggttggggctcagattctttttcttctttttcctcagactccttttccatgtctaaagcactgacattctctttcccaggagaaagggatttacattctttatctggctcaatttcaaattccatttctggttccaattctttgctagcttcattttctgaaggttctacactttcaactcgattagtttccattacctcctggtcagcaattacatgtttgacattctcaaccatctctagcacatccataacttcttcaggctgactatcctgctgcttctcactttcccttacctcagtttcctcctccatcttaacctccatttcctgtttttgttcttcctcctcctgttctttctctgcatcactatgaacaatcgctatttccttttcctcttcctctcctgcttcctctatttctacatcattgtgctgattacctgtctcctccaactcttcctctcgctgagccaccttaccctcttcttgttccgccttctgttcttcattacgcaccacctgatgctctttttccttcattgattgtcttctaggcctagcctccattttatttatttgttctgcaaattcgatgcgtctaccttcaaataaagcgttcatttttctctgtgactcttctattagtttttgggtagctggacacattcttccaggaatataaaacaaatggggctttgtcttagttcttatatatttaattattttggcattatgttcattccattcttcttgcagctgcgcaagctcaactttctgttccaaaagccgcagttctgtctgtttagcacgcctctcttcaaacagttctctcctttcattttcaacctgctttctctcttcttctgcctgaacttcaagtttttgttcaatttcctggcgccgcttttgcctttcagtagcaacagtggattcttgtttaaatttttgaagggtacccatcaacaagccaaatattcgccggttcctttgctttcccttttcatccatattttgatcctggataaggtctctacgtgtgcgctctttggaggtagctacaactgaagactgcaatgctggctttttaacatcatcatcctccgggtcgctttcctggcgtgatttctcttctggtccgacgctccccgcccagcctactgactgccccttcaaggtctctctgtttggctgggggtcctcctccactatctgagaatccacgcctcagtaataaactaccacgtcctctacctccaccaggaccagaaagggccagcaatctggcttggatgggcctcacgtcattcggatcccgcccggtgagcttgcgaatgttctcatccacgttcttaagactctctttggccttttccagctgttcctgcaaagttctcacggcgaccgccaacttctccatgcggcaggcttgagactgcttttcgggccgagccgggctatgccaacacacgaggcggtgggagcggtcgca

SEQ ID NO: 2229 - DNA, 2617 bp, Homo sapiens
agcaatgtatgatacagaattgaagggaacagacttaaagatttgcctattaaaatatacagattcttactgaagagtataggatatttaaaaaagatgacaagggatgttaatctttttttattattatcatttttacatattttggaacctcacataattttgataaataactcttacaaaattatgcaaaaagtacaagaatgtctggtaaacaaacagtctgtatcttccaaaaagattttttacaacatgcaattcttaaggcagcatcctctttacaaggaaaggtaatcctttttcatcaagaaatcttctgctgcaaagaatggctaagaaagcctggcttcttccattaacgccttttgtctttcctgtctgattttcggtctctttcacttcttgaagatcttttgcctgatcgactactctctgatatagacctctttctgtcggaccgggaattcttatcctttgatccttttgtatctctactactaccaccttttgaagatttgtgacttctttctagtcctgaagtatcccttctcttccgatccacgctccttctgtgctttctatctctattatgtccccggcccctactccgacttctactctcactactactactagtgctgctgctgctatctctgctgctgctgccacttgtactggagctgctactggaactactgcgactgctactacttccactgctggaactacttccactgctgctactggttgaactgctactagaactgctactgctactgcttcgacttctactcttggtggttctatttctagttcgacctctactcctgctcctagtattggtttcgctctcgctctctggatgtactgtcaagactgggtctactggtacctcagtcagttttacagactctacaggaaaatccttcctctcaggtagaaaatgcccatgctcctgagtaacttggggtgttggctgtaaaacagctaatgacaaatcctcaggttgagagggaggatgggactggagtactgcatggcactgggattgaagctgaagctggggctgagactgaagctgaggttgagcaggctcaggttgtagctgaggctgtggctcggactgggattgaagctggagctggggctgagactgagcctgaggttgagccacaggctcaggttggggctcagattctttttcttctttttcgtcagactccttttccatgtctaaagcactgacattctctttcccaggagaaagggatttacattctttatctggctcaatttcaaattccatttctggttccaattctttgctagcttcattttctgaaggttctacactttcaactcgattagtttccattacctcctggtcagcaattacatgtttgacattctcaaccatctctagcacatccataacttcttcaggctgactatcctgctgcttctcactttcccttacctcagtttcctcctccatcttaacctccatttcctgtttttgttcctcctcctcctgctctttctctgcatcactatgaacaatccctatttccttttcctcttcctctcctgcttcctctatttcaacatcattgtgctggttacctgtctccaccaactcttcctctcgctgagccaccttaccctcttcttgttccgccttgtgttcttcattacgcaccacctgatgctctttttccttcattgattgtcttctaggcctagcctccattttatttatttgttctgcaaattcgatgcgtctaccatcaaataaagcgttcatttttctctgtgactcttctattagtttttgggtagctggacacattcttccgggaatataaaacaaatggggctttgtcttagttcttatatatttaattattttggcattatgttcattccattcttcttgcagctgcgcaagctcaaccttctgttctaaaagccgcagttctgtctgtttagcacgcctctcttcaaacagttctctcctttcattttcaacctgctttctttcttcttccgcctgcacttcaagtttttgttcaatttcctggcgcctgttttgcctttcagtagcaacagtggattcttgtttaaatttctgaagagtgcccatcaataagccaaatattcgtcggttcctttgctttcccttttcatccatattttgatcctggataaggtctctacgtgtgcgctctttggaggtagctacaactgaagactgcaatgctggctttttaacatcatcatcctccgggtcgctttcctggcgtgattctcttctggtccgacgctccccgcccagcctactgactgccccttcaaggtctctctgtttggctgggggtcctccactatctgagaatccacgcctcagcaataaactaccacgtcctctacctccaccaggaccagaaagggccagcaatctggcttggatgggcctcacatcattcgggtcccgcccggtgagcttgcgaatgttctcatccacgttcttaagactctctttggccttttccagctgttcctgcaaagttctcacggcgaccgccatcttctccctgcggcaggcttgagactgctt

SEQ ID NO: 2230 - DNA, 696 bp, Homo sapiens
  misc_feature (1)...(696): n = A,T,C or G
ttttttttttttttttttttttttttttttttctggaaaacaaacagtctgttttttccaaaaagattttttacaacatgcaattcttaaggcagcatcctttttacaaggaaaggtaatccttttttatcaaaaaatcttctgctgcaaagaatggctaaaaaagcctggcttcttccattaacgccttttgtctttcctgtctgattttcgggctctttcacttcttgaaagatcttttgcccgaacgactactttctgatataaacctctttctggcggaccgggaattcttatcctttgatccttttgtatctctactactaccaccttttgaagatttgggacttctttctagtcctgaagtatcccttctcttccgatccacgctccttctgggctttctatctctattatgtccccggcccctactccgacttctactctcactactactactagggctactgctactatctctgctgctgctgccacttgtactggagctgctactggaactactgcgactgctactacttccactgctactagaactgctactgctactgcttcgacttctactcttgctggnttattnctagctcgacctctacttctgctcctagnttgggttttgctcttgctcttctgatgtactggcaagactggctcttactgtacctncaggagttttac

SEQ ID NO: 2231 - DNA, 567 bp, Homo sapiens
  misc_feature (1)...(567): n = A,T,C or G
tttatcctttgacctttnggtnctctactactaccaccttngggaagatttgtgacttctttctagtcctgaagtatcccttctcttccgatccacgctccttctgtgctttctatctctattatgtccccggcccctactccgacttctactctcactactactactagtgctactgctactatctctgctgctgctgccactngtactggagctgctactggaactactgcgactgctactacttccactgctggaactactnccactgctgctactggttgaactgctactagaactgctactgctactgcttcgacttctactcttgnttgtnttatttctagctcgacctctacttctgctcctagtgtggggntnggctcttgctctctggatgtactgncaagactggctctactggtacctcagngagtttnacagactctacaggaaaatcctnccnctgagtagaattcagntnggacttaacaggctgaacttgacaaanggattnaccaggntgaactngcnaanaggnnttaaccaagntgaantgnanaaaag

SEQ ID NO: 2232 - DNA, 445 bp, Homo sapiens
  misc_feature (1)...(445): n = A,T,C or G
taagtaaaangcccctgggctccctgaaagtaaactngggggttggttggnccggtaaaaaaacagcctaaatgaacaaaatccctcaagggctgaagaagggaaggctggggaactggaaagtaactggttggggaactggggantgaaagctgaaagctggggctgaagactgaaggctgaaggtttgancacaggctcaggttggggctcagattctttttcttctttttcctcagactccttttcccatgtctaaagcactgacattctctttccccaggagaaagggatttacattctttatctggctcaatttcaaattccatttctggttccaattctttgctagcttcattttctgaaggttctacactttcaactcgattagtttccattacctcctggtcagcaattacatgtttgacattctcaaccatctcta

SEQ ID NO: 2233 - DNA, 1351 bp, Homo sapiens
  misc_feature (1)...(1351): n = A,T,C or G
cagatttagctagaaaaaaaatgtcagtgttttggtgcacctttttgaaatgcaaaactaggaagaggttaaactggattttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctatataagaaatcaagtaaccagaatgcacctataaattatgggagcattgtaggattttaccacatcaattcataggcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatcntttgaccaacaggtgctattggagtgcaaagtgttactcttacgtggtntattttgagtcatgagataatcaatttnaacccaaggccattggnttattagnatgaaggccataatgttcgagncctcagggac

SEQ ID NO: 2234 - DNA, 425 bp, Homo sapiens
  misc_feature (1)...(425): n = A,T,C or G
tcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgaggctgcctgtataaggnaatcaagtaaccnggantggcacctcttaaattatgggngccttgtaggttttacccccattcaatttcttgggcggtaacctttagggggggcttgtgccatagttagntgttttncctgttcnggcctttttaaggg

SEQ ID NO: 2235 - DNA, 2165 bp, Homo sapiens
cccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggcactgctgatcctctctggctgggaagggggaaggtaggaggtgaggc

SEQ ID NO: 2236 - DNA, 2832 bp, Homo sapiens
acacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttcttttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccgtaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactctggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagttaaatgctaaaaaaaaaaaaaataa

SEQ ID NO: 2237 - DNA, 450 bp, Homo sapiens
aagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccgtaaatatacatctgtgtatttgagttggctttgctacccatttacaaataagaggacagataactgcttcgcaaattcaagagcctcccctgggttaacaaatgagccatccccagggcccacccccaggaaggccacagtgctgggcggcatccttgcagagagactattggtgaaggccggagtctattttaagcaactccaaatccactggggtgtgaggcgggccccgggtcctgtctttcc

SEQ ID NO: 2238 - DNA, 2636 bp, Homo sapiens
  misc_feature (1)...(2636): n = A,T,C or G
cnctgattggctgaacaaatagtcccgagggtggtgctaccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggcccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaaaaaaaaaaaaaaaaaaaaaaa

SEQ ID NO: 2239 - DNA, 2087 bp, Homo sapiens
gtgcagcctgcagactcgggcgagcagagcgctaaacagcttgctagagagcatgcgtagcacgcgctgtagagctgtgacctgccagcctgcgagcgagacggctccatctcttagcactacggcgcatgctctatggggtcaactggggggctggcaagcggcagcgctggtctggggcggagtctccgaggcacttcccggtggctggctgctctgattggctgaacaaatagtccgagggtggtggcatccgccctcccgacaaggcagaccaggccccctgcaggtcccctatccgcaccccggcccctgagagctggcactgcgactcgagacagcggcccggcaggacagctccaggtgagagtgccggcgccgcggcgctgccaggtgcgggtgcggcgtggaagctggtgccttcagcaaggggagggtcgcgccccgaggctctgccggccggcaagaccctctgcgtttggacccagcgagtcttgcctggggtgcctgcgggtgctttttctgcgggcgttggctcaaggcatctgccaatcaaccagggcaacttcagagagcaacttcagagagaagcccactctcttccctgggcgctgtccactttcctggacaggcgcggtctccggtcagtgaagctgcccagtgctcctggaccgcgaggacagcagggatgtctgattcctctctctgcatcctcgtgctctccccttagctcctccaggcatcccatcctacctctcttgttagccaacggcgtggtcgaaagcagacttgggcatcaatcctggttaaagtcccagcgatactgctttttaaacagctgacactttgcttccagtacttcagctgggtgaacctcagattcctgaaaaatggaattaatggtactgccatagggtcggtggaggagtaattgacagtagatcagaagcgctgcctgcggtgctggcgcctcgcaagagcttaaatgggagtcgtaataattgttgttattagaaagttaaatagcatgctgcgttggggccttttcttctgccactgaactgttggactgctcttatcttttttcagaatctgtactatgcatctaatatatacgtggcactttgcttggtcctgggggtacaaagctgagtcagattgttacaaagtctaaataactgagataaaggtgttaatacagcccagaaaagcacacttaattcagcctggaaggttttttttcccccctccttcgagattttcagagtatctccttcttagtaagaattgcttggcttagtatgttgagaaaaacatactaagtatgtagtgttgtgttggaaggaaaacttaactgggtgagattttcagctgagtagctttagctgttactctcatggaccttcctctgggcggttgatacaggttctgtaggaaaaccgctgaatgaaagcagctcctgcagatgctattctgttttcaattgtggtaattcctttaattttttccctttcaatttactccttattctctagtaataatggacttttgggaggttgcatttatgataaaaaatagcctggggctgtacaatccttcctatcatgaagaagtacaaagttgtaagtagaagcagtggccttgctttgccaatgcacactgaaggggataacgtttgctcctgttcagagttcacggtcgggcgcgggtgctcacgcctgtaatcctagcacttttggaggccgaggccggcggatcacgaggtcaggagatcgagaccatcctggctaacacggtgaaaccctgtttctactaaaaatacaaaaacaaaattagccaggcgtggtggtgggcgcctgtagtcccagctacttgggaggctgaggcgggagaatggcctgaacccaggaggtggagcttgcagtgagccaagatctcgccactgtactccagcctgggggacagagcaagactgtctcaaaaaaaaaaaagaaagaaaagaaaagaaaaagaaaaagaaaaaagaaaaaagaaaagaatttcagagttcactacttcttggaaaaaaataatcccaggaggaattc

SEQ ID NO: 2240 - DNA, 1851 bp, Homo sapiens
  misc_feature (1)...(1851): n = A,T,C or G
gaattccttcctccctcctaacccctggcaaccaggatcttttttactctctctatagttttgtcttttccagcatgtcatatagaatgcagcctttacagatcttggtaatatgtatttaaggttcctctacatctttttgtggcttgatagctcatttccttttagggctgagtaatactccattgtctggatgtagcacagtttagttacgcattcatttactggagcacatcttggttgcttctaaattttggcaattatgagtaaaactactatagacatctgtatgcaggtttttgtgtagatgtaagttttcaactcctttgggtaaaataccaaggaatgtgattgctggattatatggtaagagtatgtttagttttgtaagaactgccaaacttttccagtgtggtgctaccagttgcatttccaccagcaatgaatgagngttcctgttcctccacatcctcttcagcagttggtgttttcagcgtttttggatgttgctcattctgatacgtgtatagtgatgtctcattatgtgtgatctttttctttcctttggtttattttgttaggaattattgtgagaaatgcaattacgaaagcaaattgtaaaacattttataagaaaaaaattgtaaaaacattttataatttcttaaaaatatattgatttttgttttgctgcttacataagtgtgtcttgttagtggacatgcaaaaaatggtccagttcactgctaccttgccagtgctgttttaaaaaaattctttactaacattatatgtgagtacatcactatgtcaatctttcaatttatttctagttcatgggcgccgtctcgatcttttacgaatgttctatttggcaagataccatatttgttttgaagcttggtgctactgcctcctaaacaatgaatgtttttcaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcaggtatatatgaattgataatggcatggatgtatttccttagtactcttaaagcagacaacaggcttccagcagaagaggtagataggtggtaactctgaagttgtatgagaggggaagttagtgtcttttgaaaggttttaaatgttgctaggaatttaatgactagcagtaaggtaaattataagtaaatgattacattaagatttacatttagttaggaattcttaagttacttcggcatttctggtggtgtgggtgctgctgggtaaacgttattccataactttcctcctttctccataaatatgtaatccagatgttcacttttcttctttccagaaattatcctttcctccctcttccttctggctccaccagttaattgctgtatgacattggacatcttacataagcctcctgtgtctcggtttccttatttgtaaaatggagcgtaataaacacctacctcataaggtcactgggggcttaaaggagaggatgcagagaaggaacctccacagaacctggcaccttgtatgaactggctaggggttggctcttctcctgccagtggcaacatgcgcatgcatatacccatacgcacacttgggttttggtctatgttttggtaccaggtattagagaaagtcagcagcactatagcagcctccgggcttgcttcccatttttaaaaccagaggcacctctaaggac

SEQ ID NO: 2241 - DNA, 878 bp, Homo sapiens
ccatatcaagggttaaaatatattttaaagctagggattctaaatgtgtgagttcctttgaaatcattggtggtttatttcaacgtggtgtctgtaaattgttctttgggggaggggcatgggggagataaaggtgatggggtgaggctcttggaaatagtctgttatttacattgtaaaaggaactgggaagattttctgattctcccagactggatttcttccagtgcttatctaggttgagatttggagcaagcattaacaaatgcttgatttactagtttaaccaaattcagtgttagggcacacggaagttcagagtgccccatgtcaagtgttttggctcctgctggtggtattgtttgcgtgggtctcaggccgtcgcgagtgacggcctttgtgttttctgagaaggaaatcccagatgatggaattcctgttttctgtcctttgttctcacaggttttatagcattttcacagatccctgagctggctaaaaggattaaaatgttttttgccctgggtcctgtggcttccgtcgccttctgtactagccctatggccaaattaggacgattaccagatcatctcattaaggtacttggacccctcccatccctctcctctccccgcagatttcctcctgagatctgaagaaatggcaaggggagggataatctgtgccttcctcccctgcgttttgatatcagtggagcagtgggcttttctttttccgtttacccctccttccagacccaggggtggccggggacgcctgtcgtttcctgcacactggtgccacgtgtactcatggttagcatgcgtcagtacagctctgcccacctcacagggagagcaaggagagtctgggagaaa

SEQ ID NO: 2242 - DNA, 796 bp, Homo sapiens
aaaacaggcgaaactaatttctggtgtgaaaaatgaggacaatagttacttttgggagacacaactggaagagagcccaagggggcttctgcagtcctgctggtgttgtttcctggactcactgctggttttcccagctgtgtttagtttgtgataactcatcaaactgcatactcagtatgtgtgtgctctattttatgtactatttcaatgaaagagttcctttcttggattacagttatgatgagatggcaaaatatgacctaccagcttccattaacttcattctgaataaaactggccaagaacaagtgtattatgtgggtcattctcaaggcaccactataggtatgtatgtaaataagatcagaagttgatataaattcttcattacagagtttgtacttttcttaaaagtgaaatataaaaagatgttagttcaaattccatttatttttaaatgccaaacagaaataatgaataagataaggaatgttggtaacatttagtcttctatgaaaattcatgtatatggttgaaattgaagaaattaatgtaagccacaatatattacatgttttcctagatgaagcaagatagggatgtgagagagtagaaaacaagtagtttctaagttcagagacttacataaagaaaacaagaaaatatactgccttctgaagttaagtggaatataactaactacaggtacatttggtttacaaaaaattttgaaaagttatatgcattttaatttatgctgattatataagtaatgcatgttcactgtagaaaa

SEQ ID NO: 2243 - DNA, 2954 bp, Homo sapiens
aataataataataataataataaataataataaattaaaaattccttattctcctttcagatatggctggagtcatttgtttcatattttcctttcaccttttacttgccctaaatctggttcagaactttttgtgggagcattaatttaccagaaatatttttgtgtagtaaaattcaagcaaataataatagactgttttattatacagaatgaaaatgcggttcttggggttggtggtctgtttggttctctggcccctgcattctgaggggtctggagggaaactgacagctgtggatcctgaaacaaacatgaatgtggtaagtttctcaaagttatgtacttttaaaatgcatctatttccccgatccagttatgtgagctacatgaagccatacccatacattcatctctttataactcctttgcttttcaatttctctgaatttttttttttttttttttttgaggcagagtcttactctgtcacctgcccgcccaggctggagtgcagtggtgtgatctcggctcattgcgacctccgcctcaggggctcaagtgattctcgagcctcagcctcccaagtagctgggactacaggcatgcaccaccatgcctggctaattttttttgtatttagtagatacagggtttcaccatgttgcccagggtggtcttgaactcctgagctcaggtgatctgtccacctcagcctcccaaagtcctgggattacaggcgtgagccaccgtgcccagcccaatttctctgaatcttagattcaatttgctaggcttttctcaccaggtaatatgtagccaacaaacctcagtttaatgttatatatacttcttaataagataaattatgattttttattaattcatttcatttttaagtctcactaagtttgtttaaactataaaaaagtatttaaactttgcaagaacattaccgctattgagagctggttttagaatacattgaacaaaggttgtgattaagaatgtccagggaacatatttctatacagaagtcaaagtatctgagctaaattttgttagaaaaaatatgcaaaaataaccactcgactaattaaaacatctgaaagttattaatcgtaagtaaacaataaaatctggaaatacctcatttaggcacaaaatatcagtaaagtacaaattattaaagaaaacagcaactttaaaatagatgttgcagtgacccagctgaagaatcaggcaagcttagggactcgcagagaaattcacagtgagccaggagagtatgacctgataacagggtcttaaagttaagttttacttcttagctcaaagcttttcttttgcctcccaatttttccaacttttaaaataattttttaaataagaatgataaaattaaattctttcaagtacttatggtagagagggtatgtgcacttatttacattaaatcccctggataattgaattatccatatcccactgagctcctgattaacaattgtcccatgaatccttccttatagaaaagtgaatgtgaccataattccctattttgttcaacttttcttccatcccaccttgacattctatgtaattattttagtccattgataaaaacaagttaatattttttatactttattggtcagcaggggatctctcaaaacaaagaaagtgttttatacattgacagttctagctgggatatttagaaaagaaagaaatgagcatttatttgtgcccagtaggcaggatggaaacaaagaggcccaagatgtggtaaagttaggcaaatttggtataaaacatgctagaatgatgaaactgaagtttaaccagacaccggtaggtggaacacaagcgtgaaacaagggaggatttactcttgtgatgagaagttggctactagatttagcagactaaaatttcaatgacaaatgctttcttaaagcctggagaacatagtttatctgctcctttgcttgttaatgtgggagactgtttcagattctgtccacccaatttccatcgtcctttttctctacagagtgaaattatctcttactggggattccctagtgaggaatacctagttgagacagaagatggatatattctgtgccttaaccgaattcctcatgggaggaagaaccattctgacaaaggtatgggaaggctcttaaaagtaaaaaccagaattcttctgggttttgtgttagtaaccaagttcagatttaacttaaaaacattgaaatgggattatttttagacgaaagcactaactgtgttgaggtttgcaaggcaaagaaaaataattttcttttaaagaagtaaggacaagagtcatctaattttttgttcaaaggccagattcatttgaggatatgctaaaatctctgaggctttgtttttttaaggaagtgtatttaatgaaatgttttgagcattaaatagatggcttttgctatttaaaaattatttaatttttttgaattcacataatctaaaaatcagagaattagaagacatacagtgaaatgcctcccttctctctcactccctacttcctgcttttttgtgtatctttttgaaataacttcattttaaaatctttttatttccaaaaatctcattagaaacaaatacacacacagattcttatttttcccttgcctccattttaatgcaaaagatggcactattttgttcttcgaattttttacttaatatcttggagatctttccatacaatacataaagcacatcttccagaagtgcatgatatttcactatatgactgtatcattatttatttaccaagtgtcctattaatgcatatttgtgctatttcagtcttctgttaacaaatattgctgctgtaaataagcttttgtgtgtgcaagtttatttacatgatacatgtccagaaatagaatttttggatc

SEQ ID NO: 2244 - DNA, 1770 bp, Homo sapiens
ggggataaaaattcatttggtgcccactacggcagcagctccacagctagtggcgattataattagcattctctcatttggggttagatttctttttttgtgccggtaatggcaacttgaaaagatactcaaagagattttaaaaatttagtctgttagtcaaacttactagacaatgtttaatggagattgcgcttattgtgattttgaaaattaaaacaacaacaacaacgaggctttctctggttccttttcattgtagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaattgtgtgtatgtttt

SEQ ID NO: 2245 - DNA, 912 bp, Homo sapiens
cacctctggcagacattactgatcaatcacagccttgactgtttcttagaagtaaccaccgatccatcagagtcagatgaaaattacttggggatgcccctgggaggggtgatcattaaggccctttcccactgtagaagtccgctgaaaacttatttgattttctgcctccttctcttcatttggagaatttaaatacacctctgtagtgtgtgatttttgctttggtaaacttgtgcaaaagcatcctgatttgatgtccactggttgccattctctcctgaggccattcgtggagacattgggtacttgtctctgcttctgaggtgagtcacggagacttatgcaccagagtgaaatgctgagatgttcttgggtttctttttattttgtaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatggtatgcatgtttatagtaagatttgatttttttttttatctgtgaatgtgcttatttgtgttgaatgatatgggagaggtgggaatgacctcatcagaactctaaagagtctttcatttgagaggcacaagcatgaactttggccaatgcctagaatacggtaccacctgctgccatcctcaggctgactgtggtcaccttcttatgttgtacctagatggagattattgaatgaggagatctgtcacaaattaagctgtaatatttataattactctagtgatttgtttcttttagaaatcattataagtataaacataaagatgggacaatagacagtggggactccaaaaggaaggagggagaggga

SEQ ID NO: 2246 - DNA, 457 bp, Homo sapiens
tgtcatactgaaggagctctgtggaaatctctgttttcttctgtgtggatttaatgagagaaatttaaatatgtctagagtggatgtatatacaacacattctccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataagcccaaagaa

SEQ ID NO: 2247 - DNA, 636 bp, Homo sapiens
aaaaaccaattgcccggttaaacccaaaaccaaaggttggttttaaagcctggaggacgatacaccccaaccaccataatccatgagctcctcaatttcagccaggcaatagtctacctttcggagaagccaaatcccgtgaggactataccactatttttctgaggattaatgtactcttggagcccgctactgtcgttattgatcacatctgtgtgaagccaaagccccgtgtttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaaaaaaaaaaaaaaaaaaaaaaaaaa

SEQ ID NO: 2248 - DNA, 634 bp, Homo sapiens
ttctgtgtcaggtggtagctgctaacaatcatacaatgagaaattgagtcattcagtaaagcaggacaaaaccatgccatctcatttaaaataatgccttggaaatgaagagtaaatctggatattggtataaagttgatttccgaggttgtggctagctccagcaacctatgatgttatctctaactttggtgtcagataactcttttccaaattatcttctttttaggctgttaaattccaaaagtttcaagcctttgactggggaagcagtgccaagaattattttcattacaaccaggtaaagtttttagtcttttcattaaagggggccctgaaaactcattaagaaagccagcctggcctatcaggattctggccaggctcaggtgctgtgggaaatgtttgcaggagttgactagtgtttgttttccatcagtccattcagaacaatccaagctttgtagctggtgttgtggactgggcctcctctctttgtcctttccccagctctaaataagaatcatcactgttatgcattactcagagtaatcacgaacatagcctgtagagtcagacagtcctatgtctgttatctggtagctatggggccttggccagattacattgctta

SEQ ID NO: 2249 - DNA, 433 bp, Homo sapiens
ttttcggagatattgatcctgtggacccccctactggcttttatgcacacctcggtgaggagccaaagccccgtggttgcccatgagaagtgccctggctcattttcacccaaatgaagtgtgcaacgtgatgttctcggacgcaaactccagcccggggctccattttgtgtcctagttttatacgcctccttatttttaatacccctgcttcacgtccctatgtggggaagtccatatttgtccgcttttcttggagcatcatttccttaatatactgtggggggccaaatggcaaatggaattgttttccggatataattcctttgggtccaataacagtccaatccttgttaagggttaatttggccagggcgaatactccttggaaacttttaaagtcttaaacttttcaataaaattgagtgagact

SEQ ID NO: 2250 - DNA, 414 bp, Homo sapiens
  misc_feature (1)...(414): n = A,T,C or G
atgtacacttggagccagctctgaacgttattgttcacaaatgtgagacgccaagaccccgtggttgcccatgagaagtatcctagttcntattcccccaattgcagtgtgaacgtgctgttttcggatgcaaactcagcatcagggattcattatgtgtcatagttatatatgcatccttataattatacaacctgcatcacgtccctatgttgagaagtcaatatttgtctgcttttcttgcagcatcatttccttacaatactgcagatggaccantgacaattgatatgtttaactgatatacttactttagctgcactacagtacccatgcttgatcctggtagatataggcagggcgaatcctactttgtcacttttacagtcttnaacttttccataaaattgagtg

SEQ ID NO: 2251 - DNA, 361 bp, Homo sapiens
  misc_feature (1)...(361): n = A,T,C or G
ccttatgtctagcntatggcaaattaggacgataccagtcatctcattaaggactatttgcagacaagaatttttccccagagtgcgtttgtgaagtggctgggtacccacgttgcaactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaaattttttgcgactgtacacatagctgcagcattaagaacttaaaaaaattgtta

SEQ ID NO: 2252 - DNA, 710 bp, Homo sapiens
  misc_feature (1)...(710): n = A,T,C or G
gctgccatctcaattaaaattcaagggtgtgattngatccgaaaattgctgcngttcctggttcaatttagaaactctgccagtntggtttttggtcctntaccatacaggtcagatctttaattaaagaggaagactcattttcttttcgttgagcccaaataagagcatgtttgctctttngctaactcagttgcaacattttcaaaaccatcttttaacatcttggaaatcttctggcttcaacagttaaagcaatacggaattcattttctaaatccatatactgctggcttaacacggtcaattttctcttggtattcttttatcagtttgctcatgctttttctcttctntggctatttctttagctaaggcatcctggaagtcagcatcagtaaaaaactcccttgtttcaagttccttcctgtgttcctgttctttcaatgcaagaagttgatgaagttgttgcgcttgttctctttctcgatgaagggaagttctaagtaagtatatttctctatcggcagctgaagccttgagttccacctcttggatcagtcttatctgtgctgcctgctgctgccttttttgcctctccattttttctaatgttttttcgagggttcttaagtgtttaaggtgatcctcttgttgatcttttgctttcattagttcaacagtcagttttttaatttcattttgaagtt

SEQ ID NO: 2253 - DNA, 859 bp, Homo sapiens
ttttttttttaaagaagaaagggctttattcagccaggagcttcagcaagactcatgtctccaaaaaccgagctccccgagtgagcaattcctgtccctttaagggctcacaactctaagggggtccgcatgagagggtcgtgatcgatggagcaaacagggggtacgtgactcggggctgcctgcaccggtaattagaatggaacaggacaggacagggattttcatggtacttttctatacaatgtctgtaatctatagataacataaccgattaggtcatgggtcaatctttaactaccaggcccaggatgtggggccaggctgtctgcttgtggatttcatttctgccttttagattttacttctttctttggaggcagaaattgggcataagacagtatgaggggttgtctcctcccttaaaatcacgaactggtggtatagtgaggagctattccttccaaaatcttttaaaaacattactggtcatggctgagaaaagtgtctctggagtcttaaagttggtgaaaataatttttcccaatataattatcttactccacatacgaagtcttgtaatcctacctgtagagagttgccatgcactgtgacttactttgtataatatagttctcaaccctttgtactcatatgcgtgagaaactctcagtatctctcattacacacagtgatttcaacataccataaatgggctgattaaaagtgaggtcactttatgtacaaggaaatactattctctgagttacatggctcagataactcacaaaaccatctacaccacatcaaagtgcatttgggttacacaagtaaagcctctactatcagctacaaattt

SEQ ID NO: 2254 - DNA, 361 bp, Homo sapiens
  misc_feature (1)...(361): n = A,T,C or G
agccacggggcatcggcaacgactcacatcttaaaaaccgaactccccgagtgaagcaattcctgtccctcttaaagggctcacaactctaagggggtccgcatgagagggtcgtgattgattgagcaaacagggagtacgtgactaggtgctgcatgcactggcaattagaacagaacagaacaggacagggattttcacaagtgcttttctcttcaatgtctgtaaatctacaggataacataaccgattaggggcagggggtaggatcttttaactaccagggggctagggggtaggggccccggggcttntcttgcctgcggggttttcantttctngccttttaggttntttactt

SEQ ID NO: 2255 - DNA, 4923 bp, Homo sapiens
ggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctggggggagcggcggtggccggggctgcaggaggggctcggcggttcctctgcggtgtggtggaaggattttatggaagaccttgggttatggaacagagaagagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgctaaaaaaaaaaaaaaaaaaacagcagagaaagaaaaaaggtcgcc

SEQ ID NO: 2256 - DNA, 643 bp, Homo sapiens
  misc_feature (1)...(643): n = A,T,C or G
gtagtgacagggtttcactgtgtcagccaggatggtcttgatctctggcccaagcttttaaaagtgaaaacggtggccaggcgcggcggcacacgcttgtaattctagcacttcaggaggccgagatagaaggatcactcgagcccaggaattcgagaccagccctgacgatataaatagggaaagagagagagagagagagagagcgcgtgcacgcgagggagaatgcctgcccctctccagcctggccaacagaaggagatcctgtctcaaagaaagtgaaaatgcttcagctagaattataggataatcctgtgtgagataatttacatagtgactggaagagttattaaatattgctttcttgttgctaagttctgtagttgggttagatatctaatgcgtaactattgtgaaagtcaagagattctaatttttccagaaaataatgttgagtttccatgaagaacaggaagtactgccagaaactntccttgctaatttcccttctctgataaagatggacattcacanaaaagtaactgacccaagtgtggccaaaagcatgatggcttgcctcctgtcttcactgaaggctaatggctnccggggagctttctgtgagtgagaccagaatgataaa

SEQ ID NO: 2257 - DNA, 777 bp, Homo sapiens
  misc_feature (1)...(777): n = A,T,C or G
gnnggngggtgggttactcctgatgaagaaccacggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtnttagtgacattgcccccatgcaaactgatgaacagacaaacaaggagcagtttgtgccaggtccaantgaaaagcctttgtacactgcggncccngtgaccctggngggatttgnaggtacttggtgatcttattttttnttttttttntnnnntnnntnnnnnnnnnntnntnnnnnttnnnnnttntnnnnttcctttcnntcntttccttcntntnctncttnccncntcctccncntncnncnntcccnnnctnnnncncntnnnncnccnnnncctnnnnnnnnncnncncnnncnnnncntntncctnnnnnntnnnnnnnnnntnnnncnttntcnnncnnnctctnttnttnttcnnnnnnnntntntntntcntntnnnncnnnctcntntnttnncntnnnctctnttcttnctnnntnncntnntntttntntnnntccntcnctccncnntnnctccccccttnttnccncntcttcncntctctntnnctctnccntntccctccnnnccnctcnctncncncncttntncccccttcccttcnctnntcnccnccctcncct

SEQ ID NO: 2258 - DNA, 669 bp, Homo sapiens
  misc_feature (1)...(669): n = A,T,C or G
gctgtccgattatccgccctaaggattgncctcagccaaatccgcccagacttattagggagagggtaagagaaaacctaagtttcttcacaganctccaccattgtggcttgaganaccctaaacattgncctanggacctaggncttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaa

SEQ ID NO: 2259 - DNA, 492 bp, Homo sapiens
cttttccttaaatgtaagttagaagaaataacctcttcagttaaaccttcagtgaaggttcttttagttttctgttctgctttctaaaaacatagactctgttctttagagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggaagccagaaactttcctcttctgtcccacagaatactgtggcactttctgttatccaaatgtgtctcagtctccatatttaaggactgtgggtgaaaagcttctacctggaa

SEQ ID NO: 2260 - DNA, 490 bp, Homo sapiens
  misc_feature (1)...(490): n = A,T,C or G
naaaacnnaaccatttgaatcnactcaactntcttacnanctggtaagaancttcccttcatctccaagccctccnaaaaatncaaacttggntccaagctttaccaaaanaccatatccttctatggggttaaagggtttctaacctaaaaaccttctctcctttcttctcacctatttagtgcatactcaaaggctttggttggaagtcactaggtaccactaggtacaatgctttagggctctctcaaagcccacaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatganaaaa

SEQ ID NO: 2261 - DNA, 439 bp, Homo sapiens
tatgacgatggagtgggtttaccctttcaaagtcagcctgatcttattggagacaagtatgtgataagtatttggatttgagagtagacctttcatagtgaggcttatcaggttgaggggaggtgatgactggaaatatatttatttattttaaatcccactttggctttagtaaaatctgaatatgtgtgcatttctagtttcttacaccaaatgtaggttccgtaagttcatgcaagtacagtgggtcttggatcactgaagtctgaattttatattagcaactgaaaagtttactgtggcctctttccttctgagcaggttagtaggagggctgctttccctcagcctggattactgctttgtcctagaagatgaagatggcatatgtggttatgccttgggcactgtagatgtgaccccctttattaaaaaaaaa

SEQ ID NO: 2262 - DNA, 428 bp, Homo sapiens
  misc_feature (1)...(428): n = A,T,C or G
cctgccctgcagtagcccagttaaataataagtgggtaaacctgcaagtgcaacaccccatttaaaaaaaaanggatacccttcccccaaactaatcccatctcccttttttttccttccccacagcgtttgcctgcccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttatt

SEQ ID NO: 2263 - DNA, 25097 bp, Homo sapiens
  misc_feature (1)...(25097): n = A,T,C or G
ctgaaagccacaggacccggttggnacctttttggccgcctgcgcctttgcctgcagccccgctccctgggtcacccgaagaggagctggcgctctttccgggcgcagaagcacccgacccacgctggaggaaacggtccctctgggcaggagaagctgagggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatctccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtaagtaggacaaggccaactgtggctgttccagcagagggactgtgggtgatgtttcccttctctgatttctaaaatatctgcaaacttgtttcatttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcaggtgacgttttaacagaaacaaaaccgcaggcagcgggtggggggagctggaggttggaatcacaccaacattatagcattattactctaaaaaaaattacttttttggctgggtgctgtggctcacacctataattggggggccaaggcaggtggattacctgaggtcgggaattcgagaccagcctgaccaacatggagaaaccccgtctctactaaaaatacaaaattagctgggcgtggtggcacatgtctgtaatcccagctactcgggaggctgaggcaggagaatcgcttgaacccaggaggtggaggttgtgccattgcactccagcctgggcaacaagagcaaaactccgtctcaaaaaaaaaaatttttttttaagcgacacagtcttgcactgtggccgaggctggagtgcagtggctcaatcacggctcactgtaaccttggactcagctcaagcagtcctcctgcttcagcctcccgagtagttgggactacaggtgcgtgccaccacacttggctaatttttatgtttttttggtagagacggggtcttcctgtgttgcccaggctggtctcgaactcctgggctgaagcaatcttcctgccttggcctcccagagggttggaattgcagatgtgaggtaatgtccagttccttgccttatttataaaatgtaatttattttttgaactttttcctcttcagagccttccattcgccttcctgtgtagccaggctgttaaaaagctgctttactttccgctttctttccgcatccctaaaagaaacaaaaggcaaatgcccatttttggattagttcttggagagcatcttgccctctctctcccacatcagaaccacattagccaccgtggccacgttcagttcaaacagggggaagtgaacctgcctggctccaacccccagccagagccaaggctgtgggatgccaggtgcccggtgctctgcccagggccacacagcaccaaagctgagtgacaccacaatcgtgtcgcacacacacgtccccctcaccgttccatgatttctgagagttgcatcctcgccaggaactgattgtccttgcggatttctcgaacggcccctttaaattcacgcttgtgtttgtggatcagcctcttcctttcctgttcctccttactactgccttgttttcttccaaactcgaggctacaaccagaaagccactgttaaggaagcaagagtctgtccccacctctcagccagagcctgcttgggagtgtggcttcactccgtagtcatctgctcaactgcagaactggcagacgccccccgtcagctcccactgagcccacagccctggcctcccagggagatgctgccagcacccacactttgaccagccggggtgtgaaaagcttcagtgggacaggcttgctcttctcacaggtcagcggccggcagagctgcttctggctttccatttcggtcagtgtgctctgacacagctcctgaaaaacacgaaatccccgactctgcgatgactcacctgctgcatgccctgagctccacgcacgggttctgtggtgtcaaggcagcgtgaggacagtgctgcgagctccctgcagcaggatggtgcccttgctgtgcgcctaccggtgggcgggggggtaagccaaggctgtggctgctcaagtcctggcacagccggaacgaagtaaagccactgtcttcttgaagagggagggccgtgggctggcccctgagagcactctctgaaaggaggggacttggggagttggaggtcaccatagcctgtgctcctcacagccagaaacgtcaacagaacccctctttcccagacaaacttggcacgaaaggccgtgagccacttgcttcgtgagaaggctcacaggagaacccctttctgccgcggggggccgtgtgcatgctagagcccagtgtgcaaactgacgctgggtgctaggcggggcagggtttccaccagtcttggcagtttgaccttattttcaagccaacagaaccagatggttaagacccattttcaccaagaccttggcttccagaagagttggctggtggcttctgaggaatctcccgaaaggtagttcactgaggttggtcctacccgctttctcctgcacaggtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccacaccagcaggaagtggatacaggataaggggcagggctcacatctcatcctcatcagcctttgaccaggcgacggagtctgtgatagctagcttatctgctctatgctccagggacctggccggaacgagccgagttgctgtcctcatggaactctcatcctagtggggcagagacaaggacggtgtaacgtgcccgggggtcagcaccacagacaaaacgcagggagcacggcacagtgtgggccagggaaggcctggcttcccaagggtgtgggcgcgagcagcatggctgtggggagttccaggtgcagagaactactccagagacgaagccaggcctgcgaggaggccggagcgcatgaggggaaggcacgaggcaaggctgccagggctgtgctggtggtgcgggacggtcctgtgggggtagctgcggagatggcactgatgccttcggctccagcagcatcctgggctggtgcgggccaataaggggcagggttggggcaggatgaaaggcacaagccacagccatgtcaagcaggaagtggatgcagggtacagcctgtcagggtcagggtgaaaggcagggaggcgggtaggccataggtgaatttggagcagcctgtagaggacaggatgtgccatcaaagacttgttcttgggtccagctgagactgtcccttggggcttcctgtcaccttgtgcaggatagtgagaccatccttggaaaacccatcgggactgcagagcgcggctcagagctgactgtccaggcctggcaggggctgacccctgggcgctggtgcaccctccgtgcggcctcttggaggaagcacacaaggcgacagttcccagctgccgcctgagatgcagcatctgctttactccagcccagcactgctcaccgtcactgcccactcttatgattttacttcccttcatatttgtgattttgcaaagatggtgttgacttacagctgcagcatcaaatgactgactgccaccagcttggccccagctcagggacatgtctgagcccaggcagagcaccctagtggccgggaagcctcacctggagctcctgcgggtggctgcagtccgccaggtgatccgtgaggagggcttggagaggccccatgatggcgtggaaggatggcagggacccgtacatgagcacgcagcgcttcagcagggccaggcccacagccaggcaggacagtctgtgagggcaggaggcaagaggaggtccaacttgttctgtttgtcactgacaaaaccaataacgtggcaaaaatgaacttccccacttccactaggctgaaaactccagtgtggccaccttggccggccagggttgggcccatgcaaccacgggcaaggcaggctcagggtcaggcctaacgcaggaggggaggctgtgggaaccgcagcgccagctgggatggggcggctccatttttggttccaaattatgatttgtgaaatcaagcaaatgtattttgaaaatgaaaagaaaaagggacagcaagccaacatgcctcagaaaggctttcggcctccatcaaaccaaacggccgggcggcaagttcactaagaacagcacatcagaaagcacgagtggcttctcctgcctctggggacgctgtagggcacaggccccaaagcggggtcccctcacataccggatgtgattggcctctgtcgaagttggggccctcagtctactcgcccagcggagggagaggctgctctgctgccacgtggccacatcctctctagcagacaccacgagcagttccgagttcttcccaagcgctctgaaagggtgcaccagagtggaacctgaattccaagtgcgacaggacagagatggcctgaacattactgggctcccagcaggctctgcggcaccgagcctgtggaagttcaccctctaacagacgcacaccgatttttatgtttctgggttgtgccagacactgagggtttcagcgtgggcagggacacctcaggggaggggaaaagctttggcagggggcgcggtgagagccaagtgcctgatcctgcctgagaggcctgctggccacagacttcctggggcctactaggcacacatggggctgatgaggcgctcaggccacatccgggaacagactgaagtccctgcccctgtcggggagacaggcagtgcacagcacccagaggagcaaatggaccagacagaacacgagaaaggaaagcggaggggcaggagggagacaggagagtcagtcgggggtgacggtggagggcgggagaggcctgaggggcagacgtcagcaaaggcctgtaggacgcaggagtcaattcactcgccacggagaagggcaatccaggccgagggtgtggctacacggggaggggtggagagtgggtacagtggggcagaggtgccgggccaagcgagaggggaaggcgtgggtcaggccccgccccacacttccccaaagccgagatgcccaccccttccttgactccacctgtgcccagcctgttccgtcacagcccttcacacgtgggactgcagctatctacaggtggctctcccggaggcagggagcatgtgggcggccgcgcccctctggcgcccagcaccgagcctgacagacaggagccttgggaggcaggtggtggcagaatgggagcactgaaccggaagagtgggccagacccctcttggaagggactctgctggtggtgtgaatgatgccacagcacctgctcctcaggtcagtcccctggacatgcaggcgcttagcactgcacggtgagctggaaatagaggacaggggtctgagccttgaggtccaacctctggtcaggctgggagaggcgtccacagacatggaagagctcaggaagaggctgtgcagctcctcaccccccagagggaagcagcaagtgctgaggaagcatccaggagcagggctggcatcaggggaagggggaggagcacaggggctggggtgagggcccaggagggcagccagtgtgcagactgctcctcatcccaacactgctcttgccgccctcgctcctgaattcagagcgttaagagaagcgacacagcagcgcggcctgtgtgagctgcacgagaactttcacactgccttgtcgtcacgtgagaaaaagtaaaaagttaagattgattttaacaatagaccttatctaaccccaaataccaaaatattatgattttaacacataatacaaaaaattaagatattttaagtatttctggcactaagtcttcgccacttgggcatatgtcacaggtagggtacgtctcagttcagactctggcccctggcaaccacgctggacagcacaggtcaccggtagcactgcttttccccatgtggcgcgtgcacacgctcacacagagggacagacagtgcggcgggtggcaggttgtgtgtttcctctactttcgcatattctaaactttctacaatgagtatgaactacttaaaaaaattctaaagtataacatatttgtaggaacctccctcaaatcaactcaccttggcttgctttgtttggagttgctatgtaaagaatcccaagaagaaaattaataagctcaggtataaacctctgggacaaagccacatactccaggaacaggcagcacacgaacaggcccttcaccacgtcctggagggacaggatggggcactggaaaggaacatatggggggttactgtcctgggacgatgtcatgccatgctaggccgaccaccgggcttccctgatgaaccacgcaccccactgagcttcacaagtacagagggaacccccgcaccttatagcagtgtcgagagcatcaaatgagatgaaaacaagataaagagctttagtgatttttttttcccgagacggagtttcactcttaccacccaggctggagtgcaatggcacaatctcggctcactgcaacctccacctcccgggttcaagtgattttcctgcctcagtctcccgagtagctgggattacaggcatgtggcaccacacccagctaatttttgtatttttagtagagacggggtttcgccatgttggccacactggtcttgaactcccgacctcaggtgatccgcccgcctcagcctccgaaagtgctgggattacaggcgtgagccaccgcgcctggccagagctatactgattataaagttccttccacccatacagagcgtacgattactgcactaagcatgtaccaatcacatgcctaataaagaaaaaggaacagcttgaactttttaagccaaaaagggaacaaaagcccttatcatcacactggataacttcaccactaacttgaaaggttgttttctggggtagcaccatctgtaaccttgaggtgccaaaccaggccctcccactcccacccacatctggggctgctcgagccggggctcttttagatgggccctctttggcctaaccgcagtgctcggtctctgcagcccttaaacagccacactcatgttccacaaggccccgaggggctgtggctccggccacccgtggtgcagcaggccgacccctgccgcatgtggagagaacgcaccttggtgagcagctgactgaggcacacgagggcaggggtcaccactgggtgccagaagtcggaagttggaaatagcagcccagtgattttcaaataaatgagctggaaagaaagtgttaccacaggttaaagaaggtaaatgaagtccatccatatgccctccccgcaaacactccggagccaagaacaggatctggcgaggagagggtgcatctccttggcccagagctctggcctcagtgtcacagaacaggcgtccaaccaccgtgggtcaaccagctaaacgtgcagtgaggacactgaggcccatgaagacttcaaagcagtcaacaatggttatagacacgggctcagatcatgttttggggagttgattaaaaatcactaacctaagtcctacatttttaagcttctgctaactattgtgaatccatttcaacacaaacaccaggcaacagaataaagagcgtatctcagcaagtatttccttaaagttactaaagctgaaaatacagcatgaggctgttataaaattgttaaaaatctcagcgtacaaatgtctcccaacctttgaataacatagaaaccgagaccaatttaaaccagcccacaggcttgggcccttaaggacaataccgtggttctatttgccttccaatgtttttgtcactggaccaaatacagcaccattcacgtggaatcaaaccagaatctccctgcacgacccacacgttagtccatggctagtggaggagtgccctcccctcccaggctcgctgccgtgcactctcactccagatcaccctcactgccgtgcactctcactccagatcaccctcactgccgtgcactctcacgccagatcaccctcactgccgtgcactctcactccagatcaccctcactgccgtgcactctcactccagatcaccctcactgccgtgcactctcactccagatcaccctcactgccgtgcactctcactccagatcaccctcgctgccgtgcactcactccagatcaccctcactgccgtgcactctccagatcaccctcactgccgtgcactctccagatcaccctcactgccgtgcactctcactccagatcaccctcactgccgtgcactctcactccagatcaccctcgctgccgtgcagctcactccacatcaccctggaagcacagggtacagccaagagcatcgtacccgtcgtccaccttctgtgatgccaaacagaacttctgtggcaggggcagtgcctagactgaactctgcttaccacatccaaccctggcaatgccgcccggcctttggtctcaatcatttcttccatctcatgcatcgcatctcggagaacaaatttgatagcgtcacttgcagattcaggaaacatctggcaaagatgatataagtgcctgttaagcagaaatgtaaagtcaggagagaatgactttagataagaaacacagaaaagccctgcaagccactttcctatgcagtcacctgttgactgagcaagtaagaactggatgaatccgctttttctaacagcattcttaagagtctacactcacttctgccatttcctaaaaactcggccataacattatggactggaggtggtgggagaaacagctcgatttgtggtacagacgttgttgggggcaccactctgtgtggcagctgcagctgacagctccaaggcactttccatattaactcatttattcctcacgacaggtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcagacaagaggtacacactccctggcatgcagagccacccaactgggtttcactgaagggtgaggggcggggtgtctaccgtgctttccaaataccgctcagtcacccagagcttgaaacttacaatgagccaccccatcccagccacaaatctaaaggggttcacttgtttcaaaatcaacttgtttgtggttaaaagtcagtcccagctctacagtggctggagcggcacgtgtgagaagccggcttgcgctgtgaggctcacaagccctgggtgaccacctgcccacttggcatgctgacaccatcattccacctaccttagtaactctggaatgtatttttatgactctaaatgggagaaaaattgttctgcttaaccccacatcccagatgacacaccatttttacttacacaaccaacttatcaatgactgtgaggtctggtgggtcatctgtagccaaatcgccaacgtattccaaaagaaagccaaacagtttctgcaggaacatgaattgggaaataaagctcagtgctcagcaccaagaacaaagccacaggcacacagcttctggatcacgtacattctggtgacaaccaggtggggcaggggagcccagggtgacagacacgagcagccttctaaaatgtaagcaaatacactgctagaacttgctaagcactagaaggtgtaggggggagaaagctaagggcaaggcgcatccttctacagaacagctgacaacacaccactaggaaagcacgacgaggaacacgggcagcacggcgtcctcctcacaggcaatatccaccattcactgaaagaggcacgatcacagccacctatctgccacagcaaagtctggctctgccacacgctggctatgtgaaccctagtgtcctcccctgtgagatgaaggtgaaggtccccatgcctgcctctggctgggtctggcacgaggcctagagaggggccaaagccaagggaggcctctgccggtgccataccaagtactcccagccatcatcataggtaaccatgtgacgggctggccccatctggcctgaggcacacatggccgttgcacaacttcacacaattctggcattcatatacggggctatgctgacactcccagcgctccacacacactcaatccacgtacttctaattttgctttgtttccttctgcgagactcgggtggttgcacttctgaattctctccaccaccaaaagctgctcttccatcgatcttcctaacaacagagatctcagttcctcataggattcaggggctatcaaaaacacaaaacatactgcacatttaacatttatatatatgtatatatatttatttttgagatggagtctcgctctgttgcccaggctggagtgcagtggtgcaatctcagctcactgaaacttccgcctcctgggttcaagagattctcctgccccagcctgctgagtagctgggattacaggcactcgccaccatgcccggctaatttttgtattttcagtagagacagggcttcaccgtgttggccaggctggtcttgagctcctgacctcaggtgatccgcctgcctaggcctcccaaagtgctgggattacaggcatgagccaccgcacctggcccacatttcacatttaaaatgagaattacttacatgtctgctgacagagaggtaattttatataactattctacttcacgatcacaacaaacccaccagcgtttgccctggtacacctggaggggtctcagccatcctgacctgggctgtcaggtgcgatcacgcacctgggaacaggctaataaggaaatgccctcccacctttccttgattaggaatttgctaaaacacccacagtttcagagcatcttggtggcagggtgctgggtttagtgcccagactgcttcagaaggacctggaaggagccactgtgagccaagcagtgtcagctcaggagactcttgccaccagagggcacttcacagaggccagcttcaccactagcttctcctctggaagcgtctggcaggcacagaataattcggcattgcttactagaacctgaccatttttcttttctttgttttgagacagggtcttgctctgtcacccaggctagagtgcagtggtgtaatctcggctcactgcaacctccgcctcccaggctcaagtgatcctcccacctcagcctcctgaccagctaggaacacaggcacaagctattgcaccaggcttattttttatatttttggtagagacgaggtttcgcaatgttgcccaggctggtctcaaactccaaggctcaagtgacccacccaccttggcctcccaaagtgttgggattataggcatcagccacgcacctggcctggacaatttttctccacatactagacaaaacaacactgtatattccatctaaaatgttacgtggccaaacaggaggctcaggtgggaacatggaagccttctcgcagatgctcacccacctccccagccctgcccctctggtccaccacaagaggctgaccatatactaaaagggaggtgaaggtaccactagagagaggcgcatctggcccatcgggggccggcctacagaaccacagtcacaaactaagatgaccactcactctaagacctggatcagcagacacaggggtgtgtccaggcactcccaagggcatccttggtccccattccacaaatgcaacccctgggagggagacgaacacacacagctatggccaggtcataaaggttatcccagaacctgaggaaacccgcgcacttgcccacctgcgaacgtgtagggcagctcgtctctggtagcttttccagctctttccttgccgcttatcaaccctttcccaggagtctgcctctgctcttttgctggcttctcgttttcttcctcactctccacgttggattccaggtccaagtggctatctgggctgtcgctctcctctgtgtcctccccgcctgaactgtcaccttcttcctcgttgctctcagggtcactggcttccttgctttgctcttcctggacatcttcctcgacattcatctttccatcctaccaagagcgtggaaaccacagggcatgaggacaggcggagacaacgctggaccatctcacagccacatcaagaggctgcccacatcagggctttctacgtggttgcaaggaacacaaacctgtgtgctccatttgcccactggcactaggcctcctgcccaccacccgcttctaggctattcgagccgcaggagctacaggctgctagagaaccctgcggcaggatgctgggcgcggttcagcttttgccagggagcagcatgggactgggatttggaaggtgtacagtggctgcgggctttagcaggaggagtgtctacagcaccttctgctcctccaggtaacctagtgtttttatcagtatccattttcctgtgtggatctcttctgcttgaaacctgtcctgcctatttttcttccctggaccctgactgatacactcttaaaacgagaaaagggtaccgatttataaagttcgtgaattaaaaactacaccagtcatggaaactcaatgacatcactcaaagaaaattcacaactctagccttgagttagctccctcaatagtatgatgaggtcatgcagatagaatcatacagttattaacaaaagtagttgatgttaaccgagtaatcagttttatctgtgttcctttgagacagagagagagagtgagaaagagagcgtgagcaagtgagtgcacatactattgttaaagtcttctctctaaagttttaatatctgatataccataaacacccagataaagaactttagagaaactggttaaaaagatttaaaattcccaactgtaataaatccctaaaatgaataccaaaaaaatgtttttaaattaaaaaaagagagagaaagagaaaatgaaggcaaacatcttactttgtaggaaagcaaacgcctgtcatctttatctagcacgaagccatcattcagatcatctgctgacatatgttttggtttcttaacattttcatcctcatcctttccaagcattcttcgaagtctctcagcctgagcaggaaggaatgagatgtcttagagcacactcttccaacatatggtgagggggccgtgcagtcctgccctgggcagcgggctgggcctacggtcctcccagctctgaggctggtgcatccagcctgctttctgcctgcagttttcaatcaggcatgcaaacactagctaagcagcacattcctcatttaacaaaatcaactgttcaaactttgtggccaatactctccagtcaccaggcaagcctattattctgaggccttcacagcccaattctgctggccagccccgactgggactcatcaccccctgcaccgagagaataggagccaggacgccaagagcaagcagctccacggcctccactatttgaccacacactggacacgggaagaagctagtgatgtggttatgtcaaaacagccagctgagccagctgtgatggcagcccacacctgtaaccccagcactgtgggaggccgtggtgggaggatcagctgagaccaggagtttgagaacagcctaggcaacatagggagatgctcatctatacaaacaatttttgaaaattagctggggccaggcgcggtggctcacacctgtaatcccagcactttgggaggccgaggtgactggatcacctgaggtcaggagttcaagaccgcctggccaacatggcgaaatcctatctctactaaaaatacaaaaattagccgggcgtggtggcaggcgcctgtaatcctagctactcaggaggctgaggcaggagaatcacttgaacccaggaggtggagtttgcagtgagccaagattgtgccactgtactctagctgggtgacagagcgaaactctgtctcaaagaaaaaaaaaaaaaaaggtattcatgaataaatataaactttaaatagactaaaatattccactgatcaaacagagtattctcttcagcccatcctgcaaaatggagcagaaggggctgtggacggacagcagcacagccctgctcctgaggtgctgccaccctacctccagcttcctgaggtgctcctgctcttcctttgccaattctgcctccgtcttcatcctgttagagggctgcgccttcatttcaaagccaagctcgcgaaccatcatgtcatatgcatcgggctaaggtagaaagaagaaattcttcattttaaaaatatatttatttcttattttacaaaaagaaaagatctagcttcctggcacattctagtaatggctagataatgttattgaagtagctaagccacatctacgtcttttcttctagagagaaaactgttctgataagccctgaggattgcgaaatcagtggacattcggtcacaaagaatttgtttacccctagaaaaattctcagaatacatctgctttaacgaaaacaggccaggtgcagtggctcacgcctgtaatcccagcactttgggaggccaaggtgggcagatcacgtgaggtcaggagtttgagatcagcctggcccaacatggtgaaaccctgtctttactaaaaatacaaaaattagtcaagcatggtggcacgcgcctgtaatcccagctacccgggaggctgaggcaagagaatcacttgaacccaggaggtggaggttgcagtgaggtggaggttgcactacactccagcctgggtgacagagcgagactccgtctcaaacaacaacaaaaacgctacttatccaggcattacgccctaaacgtgggaaactaagtaaagtaacggtaacatcaaggctgactgacaaagatgcacagatgaccacatgacactaatctgctgggatctagacttctctgagaacgcagtttcttaaacaaatgcagcattttccaatagtttcgactaaagagaatgcagtaggaaacaactgtttacagaggcaaaaataagtaaatgtatattaaatgtatgtattatgtatcaacagacaaacatgtcacagggaagttcagacacctattctaacgtgtccaccctgaagtacttcttccatccagaaacaccacttttttcagtttaattcacctgcaatagagactcaagtaactgaatctacttccaccccaagattacacacagcaggtaattcagtatcaatgttcaacagaaacttgccctaaaggagacaggtagaagagccgtccagccccagccctttctctggagaaagtcggtcacccaagctcagtgagtgaagagtttgtttcagtacttggctcccaccttgggtttttcctttttgtctctgttctctgacttgggagttttgtgggacaggagagtctgaatttctttccagtcttggtctagcttctccgtgagctcgagggcatcttctcgttgagcttgtctctccctctggggaaaaaataacagacacacaccacataccgttactactggacttcaacccagaggcccaatgtcagtgccaaggacacacacagtgatcactcagttggcaccaaacgtttcaacacagaaaagaggccaggagaaatgagtattttaaatgcaaagctaccaaatctcatcagacggaaatcttttcctgccataaaccattaatttagatgctctgagcagttcactgcaaatgaataaaaaagtgattttttgggcacatgtcagatactaaaaccagcaacaacaaaaaacccatccgcgccaggtgcagtggcccaccctgtgctttagaactaggccaaggtgggagaactgcttgagcctggtcgacacagcacgatccccatctctacaaaaagtaattagctgagcatggtggcgcccactagctacttggggagctgaggtgggaggatcactggatccttgagcccaggagtttgaggccacagtgagctttgatcgtgccactgtactccagcccgggaaacagagactacgtctcaaaataaaacaaaacataaaccaaaaaaaggcaaaagaaccaaaacctgtccgaggtatatgctttatgtgatttttaaaattcctactcacaataaatgcttttactgaactcatataaaatattaaacacagcctaaaaaggtacaggaaaaaaaagctcaaacacattttggtgagcctgtcttaccgtggagaagatgatcaagaacactcactaacccaccttctcttgttttgacttggcaatgagctcttcaatcagctctttccgggacttcggtttctcccgctcctcgccttcctgttgagtcttcttgtgaaggagcccaccgcctcctccaaagtgggcagcagtcagctcagctgggggcaaaaggcagaaaaccccacagtgaagcccagccctggcgtgggaagtgtttcctgtagcactctgccagtgcttcccccatagtggtctggaaaagtccacatttgagaaaaaaatgctcacacgcaacagcctggcctgagaccacaggcacaatggcacttgagaaatacccaaggtaagccactctgagaaaacccagacccattacactcccaactggccgtaacccaagtggctggaaacacccagcacctatttttgattgtgctggttctagcgaagactggcaaacccagagcaagctgactccagggtcttggtgggagcgtcgcccaggatcagtggtgcaatctgtgtccctcccacctccctgggcagggcctggagactctagtcacctgtaccacggcgccccctctagtcacctgcacgccacggcgccccctctagtcacctccacgccacggcgccccctctagtcacctgcacgccacggcgctccctctagtcacctgcgccacggcgccccctctagtcacctgcgccacagcgccccctctagtcacctgcaccccacggcgccccctctagtcacctgcacgccacggcgccccctctagtcacctggaccacggcgccccctctagtcacctgcacgccacagcgccccctctagtcacctgcaccacggcgccctctagtcacctgcaccacagcgccccctctagtcacctgcacgccacggcgccccctctagtcacctgcaccacagcgccccctctagtcacctgcacgccacggcgccccctctagtcacctgcacgccacggcgccccctctagtcacctgcgccacagcgcctcctggcaatgaggggaaggccactcgcccaactcacaccaaggcagttacctccagtctcggggaattaggatctccccagggaatgcgttttatagctaagggtccacgagaagtcttgaacaatgaaaagagcaaagacaaaggcacagaggggttaaaataactggccattctcttcacgcccgtgaagccgagcagtggcggggcctcctggtgtgccgcagatggcgggttctgcaccacatgcttgctgccctaattcctaagccttttaccccctggattagccaaatatcagaaggcagccccaggctttaacgccttaactttcacacactgacaagacaaagctttgagagtcagttttagatttgtacacctttgttctgaagatgctggaaatgggacctactttaacttacaagaaatgtcaagtaattgatgtcatgactgcaaccttataaatagggttcaagacagtcagacccgaactgaatcttaaactctgttaacattatttaaggccaaaatttatctgtttcatgttgttatctacagatatgaggctcaatatgattttcctcaaactgctataattccacagtaggtaaaagctaaaggaactacatcaatgccactggtacaaatattaggctggaattgataaagtagggggagcaaagtagtgcattcagtgaggcacctggagtcagtgaggtgggttctccccacagctctgactctggcatcgggcaaaacaccttatttctctgagctcatgggtagaacgagctattttgaggttcaaataaaataatggatatcaacatgctttcttggcccataaaagcatctatctacacaccatcttaaagttctgaaaacttaaaaaaaaaacaaaaatacataaaaactgtcacttgtgaaatttgtagagaggttaatgatcagtaaaactttcatgcaataactttctctagtctctaagaagagcagaaggtctaacaatgaacagactctccctgactccacgcccacaggcccgtgcacagcaccccagcctcaccagacaacgttcctcgatcctcagcatcgctgtcactgtccacaatgtcattatgcttctcgatgtctgccaaagactggccataatgagtcaattcttcatcttcatttagattgtagatgctttttttctcatgatgtcgctgacagaagagaaaaaaagtttcctaaaattaccacttccatttcacagcaaaaaaaaaaagataaggtagatatatatatttccattatatttgaaatatgacaacgaatcctaagcagccttaaagagtattttgggtcaactaagcaatgattcatgattcagacagaaatgaaactcatggagggtaattcttttttttccttcagacagagtctcgctctgttgcccaggctggagtgcggtagagtgatctgggctcactgcaacctctgactccctggttcaagtgattctcctgcctcagcctcctgagtagctgggattataggcatgcgccaccacgcctggctaatttttgtatttttagtagagacggggtttcatcacgttggccaggatggtctcgatctcctgacctcatgatccacccacctcagcctcccaaagtgctgggattacaggcatgagccaccgcgcccggcctcatggaggggaattcttaaataagcccaggggccagtttccactccagcaatgctgctcagctgagaactcctgtgcacactgctgccgtgtagtagagttaaggcatttatccattcagctaacatttgcagaagaggttgcttctcctttggcctagccagataaggcacaggattcgagggctatcccctggaccttccgagtgcccaggaacatgcaaaacatgcagagtcagccttctccttggccttgacttccctgtgaaatgtacagcaaaaaccctcctccagtttctttccatacctgctgttccagagcaaacctcttcatcatcttctcctcggggctcatgttgctgttgtattctccgaagcgtttatctctgaatacattggatttatccctttctttgtactcttttagtaaagtctgtgtacgctggaaaacaggtcagaaacaatctcacaaaaaattcttgtgatttccactacaggggacatcagaacagtgcatactttaaagttcagggctatgcacagtgatgtcaaagttcacacccaatctgctttcatgcacgataggctttctctactaatcacagaattttgagaagagcaaaacaactttcaaggataatggggcaatcactttcttttcttctttagagtctaccggtgccaaaaggaagggtaaaaaagaacacactagtcaagctcaaggcatgaatggctccctcggctgtaacagctgccttaaggtttaaaacgtgcacatttggaaaagtggaaatgggtttagactccttccgtcatggaggagggtactatttcccatcaaaggtactcctaagaaatgtgtagttgtgagttcatactagacacaaggcaataaacaagttagcgaggtcacagtttaggggcttcacctttataacaccaagaggagcaatattttaaatacggttagcaagtatcaaataatttggttattttcccagcagcaacaaaaaaagaccaagtttaacagtattcaaagttggctgtcctggaggttgaattccctaaagaaagctgtgagaggacagagatgggtgaggaacgagtggcctctgcaacctgagatggccacattgcaaactctttcttgctgcggaacttcttctatttgctaaggaactgccattacactggtgtttacacagcaattccgaaaggaaatggcatcaaggcaaaatcttgatgccatggaaggcccttggaatgatccaattcagtggttttacaaacccaccacaaatcggtgcctcggcagacatttgaaacctctcatctaacccgacttaagtgttccttgccttcctcagggattcctctaatttgtgaagtcactttgaaagaatgcgtgcgtgtggcaggagggagcgtgtggtgacttggtcactgccactctggttccaagttctgtttcaggaggggacaggtcagattttgctccagacataggtcacttccccagggtcggagatgaacttaaaggctaagaaacccagatttaaggtcaaaaccaggagctggaagaggaggaaaagagagtggaaggggttaagaagcagctgggcaagagcagaagatgctccagcagggacagaagcacgacctggccctcctttccatttagagcacattccatctggagaggtcaaccgaaatattaatcatgtggacaggagaaaaggatgtgaaaaaaccatttctcttatctcactttgaaatgtgaaagtgctattattacacttaaaatgcatgaaaaacccctctgctacctgaagagtaggaaaccatccattagttcaataaatactgccaaggcaattttcgtcattttcttcaagaatatttcaagaaccaatttgtttcaactgacacacgctgagttattaatccctagtaacttctagtaacttcctaccgtggcagtgctaaacaatgtttgttaaaaacacctttggggccgggcgcggtggctcacgcctgtaattccagcactctgggaggccaaggcgggcggatcacgaggttagaagatcgagaccatcctggctaacatggtgaaaccccgtctctactaaaaatacaaaaaaattagctgggcgtggtggtgggcgcctgtagtcccagctactcaggaggctgaggcaggagaatggcgtgaacccgggaagtggagcttgcagtgagctgagattgtgccactgcactccagcctgggcgacagacaaagactctgtctcaaaaacaaaaaaaaacaaaaaacacaaacaaaccaccttgggtacaatttcctgaaccagagtctaaagacagcgagtgtccccagatagaccagagggctccatcgccattgctctgttctctccgcttctgttacgagccattccagagcgagatcctgctggatgctgatagtgaaccacacacagtactgaatcaggttaagctctctgaaccttcaccattctttatccgcagagcaaaattttaaaacaacatctcactatttaaatcacaaggtctagctggcaatcagatgggagcacattacatgtgctagcctgtactgctcgatgaactctgtacggacagaggctgcttgcatgctacactgagacctttttttttttttttaaagatggaatctcgctctgtcgcccaggctggagtgcagtggcacaatctcagctcactacaacctccgcctgccgggttcaagcaattctcctgcctcagcctccccagtagctgggattacaggcgcacgctgccacgcccagctaatttttttgtatttttagtagagatggggtttcaccgtgttgcccaggctggtttcgaactcctgagctcaggcaatctgcctgcctcggcctcccaaagtgctaggatcacaggtgtgagccaccaaacccagcatacaccgagaagacttctgaggtctgtccctgcagagggagggagtgtcactggcttctagcaggaagggggtagatggggcaggcatcagcatctctgcctctaaaaatattagttctcattatctggaatatgattctatgggtaaatcttagtgaagaacagcccttaggctataaatacgtaatatgagttattctacattattgtgattctctttctttcttaaactatatagatgttgtgacatcatatggaatttacggcataaaatggggataacagtacttccccctcataacggtgaggattaaatgtaaaccgtgtggcacaaggcctgaccaactgtaagggaccagtaactatattattaatatagtta

SEQ ID NO: 2264 - DNA, 2890 bp, Homo sapiens
ttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcaggtgacgttttaacagaaacaaaaccgcaggcagcgggtggggggagcttatttataaaatgtaatttattttttgaactttttcctcttcagagccttccattcgccttcctgtgtagccaggctgttaaaaagctgctttactttccgctttctttccgcatcccgttccatgatttctgagagttgcatcctcgccaggaactgattgtccttgcggatttctcgaacggcccctttaaattcacgcttgtgtttgtggatcagcctcttcctttcctgttcctccttactactgccttgttttcttccaaactcgaggactttgaccagccggggtgtgaaaagcttcagtgggacaggcttgctcttctcacaggtcagcggccggcagagctgcttctggctttccatttcggtcagtgtgctctgacacagctcctggagctcctgcgggtggctgcagtccgccaggtgatccgtgaggagggcttggagaggccccatgatggcgtggaaggatggcagggacccgtacatgagcacgcagcgcttcagcagggccaggcccacagccaggcaggacagtcggatgtgattggcctctgtcgaagttggggccctcagtctactcgcccagcggagggagaggctgctctgctgccacgtggccacatcctctctagcagacaccacgagcagttccgagttcttcccaagcgctctgaaagggtgcaccagagtggaaccttggcttgctttgtttggagttgctatgtaaagaatcccaagaagaaaattaataagctcaggtataaacctctgggacaaagccacatactccaaggaacaggcagcacacgaacaggcccttcaccacgtcctggagggacaggatggggcacttggtgagcagctgactgaggcacacgagggcaggggtcaccactgggtgccagaagtcggaagttggaaatagcagcccagtgattttcaaataaatgagcacatccaaccctggcaatgccgcccggcctttggtctcaatcatttcttccatctcatgcatcgcatctcggagaacaaatttgatagcgtcacttgcagattcaggaaacatctggcaaagatgatataagtgcacaaccaacttatcaatgactgtgaggtctggtgggtcatctgtagccaaatcgccaacgtattccaaaagaaagccaaacagtttttctaattttgctttgtttccttctgcgagactcgggtggttgcacttctgaattctctccaccaccaaaagctgctcttccatcgatcttcctaacaacagagatctcagttcctcataggattcaggggctgcgaacgtgtagggcagctcgtctctggtagcttttccagctctttccttgccgcttatcaaccctttcccaggagtctgcctctgctcttttgctggcttctcgttttcttcctcactctccacgttggattccaggtccaagtggctatctgggctgtcgctctcctctgtgtcctccccgcctgaactgtcaccttcttcctcgttgctctcagggtcactggcttccttgctttgctcttcctggacatcttcctcgacattcatctttccatctttgtaggaaagcaaacgcctgtcatctttatctagcacgaagccatcattcagatcatctgctgacatatgttttggtttcttaacattttcatcctcatcctttccaagcattcttcgaagtctctcagcctccagcttcctgaggtgctcctgctcttcctttgccaattctgcctccgtcttcatcctgttagagggctgcgccttcatttcaaagccaagctcgcgaaccatcatgtcatatgcatcgggcttgggtttttcctttttgtctctgttctctgacttgggagttttgtgggacaggagagtctgaatttctttccagtcttggtctagcttctccgtgagctcgagggcatcttctcgttgagcttgtctctccctcttctcttgttttgacttggcaatgagctcttcaatcagctctttccgggacttcggtttctcccgctcctcgccttcctgttgagtcttcttgtgaaggagcccaccgcctcctccaaagtgggcagcagtcagctcagcagacaacgttcctcgatcctcagcatcgctgtcactgtccacaatgtcattatgcttctcgatgtctgccaaagactggccataatgagtcaattcttcatcttcatttagattgtagatgctttttttctcatgatgtcgctgctgttccagagcaaacctcttcatcatcttctcctcggggctcatgttgctgttgtattctccgaagcgtttatctctgaatacattggatttatccctttctttgtactcttttagtaaagtctgtgtacgcttcctgagggcccgtgcgcgagacaccccgggcagtcccacgtcgtggcgcgtcttccggcccaggatctggaacttctgcctgttaactttcacctcgaacggattggagttggccttcgccgggccccctcgcgctcccgccggcgccccggaggccttccttcgcgccccgaccttcttcgccttcgccatggcgcgcgccccgctgcgcccaagggcccgagacccgaagagagacagg

SEQ ID NO: 2265 - DNA, 1434 bp, Homo sapiens
tacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcagagacggggtcttcctgtgttgcccaggctggtctcgaactcctgggctgaagcaatcttcctgccttggcctcccagagggttggaattgcagatgtgaggtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctggggggcaggagccactgagtgggtcacacagccttagagggcaacgagggcaggagctcgccctggcggtccccatgcagacaagagggtcactggcttccttgctttgctcttcctggacatcttcctcgacattcatctttccatcctaccaagagcgtggaaaccacagggcatgaggacaggcggagacaacgctggaccatctcacagccacatcaagaggctgcccgcatcagggctttctacgtggttgcaaggaacacaaacctgtgtgctccatttgcccactggcactaggcctcctgcccaccacccgcttctaggctattcgagccgcaggagctacaggctgctagagaaccctgcggcaggatgctgggcgcggttcagcttttgccagggagcagcatgggactgggatttggaaggtgtacagtggctgcgggctttagcaggaggagtgtctacagcaccttctgctcctccaggtaacctagtgtttttatcagtatccattttcctgtgtggatctcttctgcttgaaacctgtcctgcctatttttcttccctggaccctgactgatacactcttaaaacgagaaaagggtaccgatttataaagttcgtgaattaaaaactacaccagtcatggaaactcaatgacatcactcaaagaaaattcacaactctagccttgagttagctccctcaatagtatgatgaggtcatgcagatagaatcatacagttattaacaaaagtagttgatgttaaccgagtaatcagttttatctgtgttcctttgagacagagagagagagtgagaaagagagcgtgagcaagtgagtgcacatactattgttaaagtcttctctctaaagttttaatatctgatataccataaacacccagataaagaactttagagaaactggttaaaaagatttaaaattcccaactgtaataaatccctaaaatgaatacccaaaaaatgtttttaaaaaaaaaaa

SEQ ID NO: 2266 - DNA, 1933 bp, Homo sapiens
  misc_feature (1)...(1933): n = A,T,C or G
aacaatcggatgtgaatggccctctgtcgaaaattggggcccctcaatcctactngccccagcggaagggaagaaggctgctctgcctgcccacgtggcccacatccctctcctaaccagacacccacgaagcagttcccgagttcttcccnaagcgctcttggcttgctttgtttggagttgctatgtaaagaatcccaagcagaaaattaataagctcaggtataaacctctgggacaaagccacatactccaggaacaggcagcacacgaacaggcccttcaccacgtcctggagggacaggatggggcacttggtgagcagctgactgaggcacacgagggcaggggtcaccactgggtgccagaagtcggaagttggaaatagcagcccagtgattttcaaataaatgagcacatccaaccctggcaatgccgcccggcctttggtctcaatcatttcttccatctcatgcatcgcatctcggagaacaaatttgatagcgtcacttgcagattcaggaaacatctggcaaagatgatataagtgcacaaccaacttatcaatgactgtgaggtctggtgggtcatctgtagccaaatcgccaacgtattccaaaagaaagccaaacagtttttctaattttgctttgtttccttctgcgagactcgggtggttgcacttctgaattctctccaccaccaaaagctgctcttccatcgatcttcctaacaacagagatctcagttcctcataggattcaggggctgcgaacgtgtagggcagctcgtctctggtagctttcccagctctttcctggccgcttatcaaccctttcccaggagtctgcctctgctcttttgctggcttctcgttttcttcctcactctccacgtgggattccaggtccgagtggctatctgggctgtcgctctcctctgtgtcctccccgcctgaactgtcaccttcttcctcgttgctctcagggtcactggcttccttgcttcgctcttcctggacatcttcctcgacatccatctttccatctttggaggaaagcaaacgcctgtcatctttatctagcacggagccatcattcagatcatctgctgacaaatgttttgggttcataacatgttcatcctcatcctttccaagcattcttcgaagtctctcagcctccagcttcctgaggtgctcctgctcttcctttgccaattctgcctccgtcttcatcctgttagagggctgcgccttcatttcaaagccaagctcgcgaaccatcatgtcatatgcatcgggcttgggtttttcctttttgtctctgttctctgacttgggagttttgtgggacaggagagtctgaatttctttccagtcttggtctagcttctccgtgagctcgagggcatcttctcgttgagcttgtctctccctcttctcttgttttgacttggcaatgagctcttcaatcagctctttccgggacttcggtttctcccgctcctcgccttcctgttgagtcttcttgtgaaggagcccaccgcctcctccaaagtgggcagcagtcagctcagcagacaacgttcctcgatcctcagcatcgctgtcactgtccacaatgtcattatgcttctcgatgtctgccaaagactggccataatgagtcaattcttcatcttcatttagattgtagatgctttttttctcatgatgtcgctgctgttccagagcaaacctcttcatcatcttctcctcggggctcatgttgctgttgtattctccngagcgtttatctctgaatacattggatttatccctttctttgtactcttttagtaaagtctgtgtacgcttcctgagggcccgtgcgcgagacaccccgggcagtcccacgtcgtggcgcgtcttccggccccagatctggaactt

SEQ ID NO: 2267 - DNA, 1093 bp, Homo sapiens
ccctaaagaaagctgtgagaggacagagatgggtgaggaacgagtggcctctgcaacctgagatggccacattgcaaactctttcttgctgcggaacttcttctatttgctaaggaactgccattacactggtgtttacacagcaattccgaaaggaaatggcatcaaggcaaaatcttgatgccatggaaggcccttggaatgatccaattcagtggttttacaaacccaccacaaatgcggtgcctcggcagacatttgaaacctctcatctaacccgacttaagtgttccttgccttcctcagggattcctctaatttgtgaagtcactttgaaagaatgcgtgcgtgtggcaggagggagcgtgtggtgacttggtcactgccactctggttccaagttctgttttcaggagggggacaggtcagattttcctccagacataggtcacttccccagggtcggagatgaacttaaaggctaagaaacccagatttaaggtcaaaaccaggagctggaagaggaggaaaagagagtggaaggggttaagaagcagctgggcaagagcagaagatgctccagcagggacagaagcacgacctggccctcctttccatttagagcacattccatctggagaggtcaaccgaaatattaatcatgtggacaggagaaaaggatgtgaaaaaaccatttctcttatctcactttgaaatgtgaaagtgcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagccaaagctgaaataattgagtatgaagccctaag

SEQ ID NO: 2268 - DNA, 646 bp, Homo sapiens
  misc_feature (1)...(646): n = A,T,C or G
ggtagagacggtgtcttcctgtgttgcccaggctggtctcgaactcctgggctgaagcaatcttcctgccttggcctcccagagggttggaattgcagatgtgaggtaatgtccagttccttgccttatttataaaatgtaatttattttttgaactttttcctcttcagagccttccattcgccttcctgtgtagccaggctgttaaaaagctgctttactttccgctttctttccgcatcccgttccatgatttctgagagttgcatcctcgccaggaactgattgtccttgcggatttctcgaacggcccctttaaattcacgcttgtgtttgtggatcagcctcttcctttcctgttcctccttactactgccttgttttcttccaaactcgaggctacaaccagaaagccactgttaaggaagcaagagtctgtccccacctctcagccagagcctgcttgggagtgtggcttcactccgtagtcatctgctcaactgcagaactggcagacgcccnccgtcagctcccactgagcccacagccctggcctcccagggagatgctgccagcacccacactttgaccagcncgggtgtgaaaagctcagtgggacaggcttgctcttctcacagtcagcggg

SEQ ID NO: 2269 - DNA, 614 bp, Homo sapiens
ggtagagacggggtcttcctgtgttgcccaggctggtctcgaactcctgggctgaagcaatcttcctgccttggcctcccagagggttggaattgcagatgtgaggtaatgtccagttccttgccttatttataaaatgtaatttattttttgaactttttcctcttcagagccttccattcgccttcctgtgtagccaggctgttaaaaagctgctttactttccgctttctttccgcatcccgttccatgatttctgagagttgcatcctcgccaggaactgattgtccttgcggatttctcgaacggcccctttaaattcacgcttgtgtttgtggatcagcctcttcctttcctgttcctccttactactgccttgttttcttccaaactcgaggactttgaccagccggggtgtgaaaagcttcagtgggacaggcttgctcttctcacaggtcagcggccggcagagctgcttctggctttccatttcggtcagtgtgctctgacacagctcctggagctcctgcgggtggctgcagtccgccaggtgatccctgaggagggctcggatagtctcctctatggactgtatggatgacagggacccgta

SEQ ID NO: 2270 - DNA, 551 bp, Homo sapiens
ttttttttttgttttttttttttttcatttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcaggtgacgttttaacagaaacaaaaccgcaggcagcgggtcggggggagctggaggttggaatcacaccaacattatagcattattactctaaaaaaaattacttttttggctgggtgctgtggctcacacctataattgggggggcccaaggcaggtggattacctgaggtcgggaattcgagaccagcctcttcctttcctgttcctccttactactgccttgttttcttccaaactcgaggactttgaccagccggggtgtgaaaagcttcagtgggacaggcttgctcttctcacaggtcagcggccggcagagctgctt

SEQ ID NO: 2271 - DNA, 539 bp, Homo sapiens
cgagagtgcagtgtcctgaatggagaaccccagcacccagaagcatccactgaaggactaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcagagacggggtcttcctgtgttgcccaggctggtctcgaactcctgggctgaagcaatcttcctgccttggcctcccagagggttggaattgcagatgtgaggtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccacaaaaa

SEQ ID NO: 2272 - DNA, 464 bp, Homo sapiens
ggcagcgggtgggggagctggaggttgaatcacaccaacattatagcattattactctaaaaaaaattacttttttggctgggtgctgtggtcacacctataattgggggccaaggcaggtggattacccgaggtcgggaattcgagaccagagggttggaattgcagatgtgaggtaatgtccagttccttgccttatttataaaatgtaatttattttttgaactttttcctcttcagagccttccattcgccttcctgtgtagccaggctgttaaaaagctgctttactttccgctttctttccgcatcccgttccatgatttctgagagttgcatcctcgccaggaactgattgtcttgcgatttctcgaacggcccctttaaattcacgcttgtgtttgtggatcagcctcttcctttcctgttcctccttactactgccttgttttcttccaaactcg

SEQ ID NO: 2273 - DNA, 534 bp, Homo sapiens
ttttcatttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagacccattcccgaatccccagaggtgcatttcaggattcattctatttcatcaggtgacgttttaacagaaacaaagaccgcaggcagcgggtggggggagcttggaggttggaatcacaccaacattatagcattattactctaaaaaaaattacttttttggctgggtgctgtggctcacacctataattggggggccaaggcaggtggattacctgaggtcgggaattcgagaccagccggggtgtgaaaagcttcagtgggacaggcttgctcttctcacaggtcagcggccggcagagctgcttctggctttccatttcggtcagtgtgctctgacacactcctggagctctgcgggtggctgcagtccgcc

SEQ ID NO: 2274 - DNA, 450 bp, Homo sapiens
tacttgtttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctggggcgcaggagccactgagtgggtcacacagccttagagggcaacgagggcaggagctcgccctggcgtccccatgcagacaagagggtcactggcttccttgctttgctcttcctggacatcttcctcgacattcatctttccatcctaccaagagcgtggaaaccacagggcatgaggacaggcggagacaacgctggaccatctcacagccacatcaagaggctgcccacatcagggctttctacgtggttgcaaggaacacaaacctgtgtgctccatttgcccac

SEQ ID NO: 2275 - DNA, 677 bp, Homo sapiens
  misc_feature (1)...(677): n = A,T,C or G
tggctgccccccacccaccagcttatctttaaaaactccaaaccccagatgctcagggagaccgagtaataataaaactccagtctcccacacagctagctctgcgtngaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggccctcaaatggaacagcccaggtgccctggtccggtccccacttttttttctgtcctgttctcgtttccctctttgcttggcccaaagagggttgggcccagtgtcctgaatggagaaccccagcacccagaagcatccactgaaggacgtgtgtccctggaaccctggctgcacccacagatacagccactcccgggcccatgtggatgtaaccttcgagtgccggaatgcctcgtctccatggagaccaaacttcanagcctgactggcccagtctaccgagaccatgagacctgctgtgcccctcggccaggccaacccaaantcttttaaataaaaggcacaagccacagccacaaaaaaaaaaaaaa

SEQ ID NO: 2276 - DNA, 459 bp, Homo sapiens
  misc_feature (1)...(459): n = A,T,C or G
ctcgccgttcctgngggtngatgctcgnctntgggttagcagcaccctgagcggagataagagctgcccgccgccgcgtaaccccgaggccgagactcctggcctggcctccttgggcccacgacgcctgccccgcggagacggacccatgggcctgaggtttgtgtgcggggcctcaggcgagcgctggcgcagcctgttcccccatcgtctgcgccctgcgggcctcggccctccccgtggaaggaccgcgggcttcggggccccacgctggnggngtgactcctgccacacacacagnngtggncgcgggctgagnggcggcanacacgccaattntgctcngggctgcgtgantgaaccccgctctctgtgcacctacttttgctgcgtttggtgctgagcctgaagtcccaggacaggcggctgagggngaaagatggtgtgaattgggtgggc

SEQ ID NO: 2277 - DNA, 442 bp, Homo sapiens
  misc_feature (1)...(442): n = A,T,C or G
acgcaacccagtctcctcccacctccgagagtgcagtgtcctgaatggagaaccccagcacccagaagcatccactgaaggactaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcagagacggggtcttcctgtgttgcccaggctggtctcgaactcctggggctgaagcaatcttcctgccttggccttcccagagggtttgggaattggcagatgtggaggtgttgttcctggggaaccctgggcttgcacccacagattacagccattcngggggccatgtgggatgttaacnttgagtntcct

SEQ ID NO: 2278 - DNA, 339 bp, Homo sapiens
  misc_feature (1)...(339): n = A,T,C or G
cgcaacccagtctcctcccacctccgagagtgcagtgtcctgaatggagaaccccagcacccagaagcatccactgaaggactaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcatttctattttcatcagaggacgggggtttccctgttgtttgcccngggttgggtcttcgaacttcctggggcttgaaggcaaattctttncctgncctttggg

SEQ ID NO: 2279 - DNA, 333 bp, Homo sapiens
tgcccgccgccgggtaaccccgaggccgagactcctggcctggcctccttgggcccacgacgcctgccccgcggagcggacccatgggcctgaggtttgtgtgcggggcctcaggcgagcgctggctgcacccacagatacagccactcccgggcccatgtggatgtaaccttcgagtgccggaatgcctcgtctccatggagaccaaactcaagggcctgactggcccagtctaccgagaccatgagacctgctgtgcccctcggccaggccaacccaaatttttttaaataaaaggcccaagccccagccaaaaaaaaaaaaaaaaaaaaa

SEQ ID NO: 2280 - DNA, 333 bp, Homo sapiens
gctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgagggacgtgtgtcctggaaccctggctgcacccacagatacaaccactcccgggcccatgtggatgtaaccttcgagtgccggaatgcctcgtctccatggagaccaaactcagagccggactggcccagtctaccgagaccatg

SEQ ID NO: 2281 - DNA, 350 bp, Homo sapiens
  misc_feature (1)...(350): n = A,T,C or G
ttgattcggtcnaaacnancncnntggcancttgtgnagttccnaggggctcgttacttcttacagntcacagtccctcccgggnccagcacacctgagggctgacctccctcttgattagtgcaggggaaaagcactttaaaaagctgtgtcatgcgtaacttgcacatcttctgattctgacctgaaactgcatcccaggtcggcacagacgcaacctagtctcctcccacctccgagagtgcagtgtcctgaatggagaaccccagcacccagaagcatccactgaaggacgtacttctttgatagtgcctccatgcatgcagaagatgacgtggagagctccgcgc

SEQ ID NO: 2282 - DNA, 308 bp, Homo sapiens
ctgtgtgttatcagctgcgactggttcactgcgtctggacaagcctcatggggactggggattctggccagtgtaatttctgtcaaccacggaccattcccgatcccagaggtgcatttcaggattcattctatttcatcaggtgacgttttaacagaaacaaaaccgcaggcagcgggtggggggagctggaggttggaatcacaccaacattatagcattattactctaagaaaaattacttttttggctgggtgctgtggctcacacctataattggggggccaaggcaggtggactacctgagg

SEQ ID NO: 2283 - DNA, 304 bp, Homo sapiens
  misc_feature (1)...(304): n = A,T,C or G
gatctcacgtggncgaccctaaccagatacacatggggaaaggaatcaggtggcacacataccgcctttactccntannngaacttccaattgtgggtcggcacagacgcaacccagtctcctcccacctccgagagtgcagtgtcctgaatggngaaccccagcacccagangcatccactganggactaaattctacacatganggcaaacgtccgtggttgacagaaattacactggnccagtctaccgtgaccatgaganctgcttgtgncccttcggncaggtcaacccaaattctttt

SEQ ID NO: 2284 - DNA, 1963 bp, Homo sapiens
  misc_feature (1)...(1963): n = A,T,C or G
gggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagagaaaaaaaaaaaaaaaaaacattttatttcagcccagtcccctctttctgacttgtgatctcatagagcaacagtatctcctggtctgtttttagttctgtcactcgatgtcatttatctctttataataggatggccccgggncttnttttgaacaggtagtaatgacttcatttgccaccgtgctaaatgggtacacaacctattacattcaccagtccttcattataccattgacctgaggctagcaagagattttgtctgactgtaaagttgaaa

SEQ ID NO: 2285 - DNA, 500 bp, Homo sapiens
  misc_feature (1)...(500): n = A,T,C or G
ttggtgttgctggaccttcagagttatgatggtgatgcgcaaggcaaagaagagatcgacagtgtcgtnttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccagggattttatagctgcagtaccctttagccttcctcttccgtgttactttgttgctaacttacgctaaggttaggtcagcaacatgaagggatagttgnatgggagantggattnggccaggctctacaggtgctagaggtaggaggaggcagtcatcttgcacagtttttcacctggcntcagcct

SEQ ID NO: 2286 - DNA, 596 bp, Homo sapiens
tgtaggccagcaaacgaattacaagtgatgtcttttcttccttgaattacctgcttttattccttgactccctgtccagatcttcaatttggatatttggaggagtgaacatcgttgttttggctggagggaagatcttgatgggtgtttctttccccaaaaattgacttagatattaaaatttggtgcttataagagagagttaaaaaaaaataggattgcttcaattaaaattacaaaagagacattttgtgtgttctgtcgttttatttcagcccagtcccctctttctgacttgtgatctcatagagcaacagtatctcctggtctgtttttagttctgtcactcgatgtcatttatctctttataataggatggccccggggccttttttgaacagtagtaatgacttcatttgccaccgtgctaaatgatacacaacctattacattcaccagtccttcattataccattgacctgaggctagcaagagattttgtctgactgtaaagttgaaagtcaaaagcttatttctggtcccactcttagcagtgtattagatgtggaaataaaagtcattttgggtagctgcta

SEQ ID NO: 2287 - DNA, 378 bp, Homo sapiens
ttgaatatgacatagatgaagtggtatatgacgaagattcaccttatcaaattataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaaaaaaaa

SEQ ID NO: 2288 - DNA, 283 bp, Homo sapiens
  misc_feature (1)...(283): n = A,T,C or G
cttattcaaagtccttcgttctcattcccacagtgctctaagccatgaagcttttnatccatctttcaatttgtaggccagcaaacganttacaagtgatgtcttttcttccttgaattacctgcttttattccttgactccctgtccaggtgggtattttacactgtttggaagaaagctaaacccngaagatcagtagcccctantcacatgtgctgcaaatagccttccntgacctcccatatgctggtncatgaccatcaaaaatgagtcaaggcaatt

SEQ ID NO: 2289 - DNA, 2426 bp, Homo sapiens
tttggccgctacaaagcagggagaggtcatgttggtctggaacgcgtcacaggggggacgtgccgcggcaccatgtggggggctcgtctgtggggagggctgccccactggggacctggggacggaggccctgtgggccggcgggagcaccaggcagcagtgtgggtggggttggtggcgccggcacagagaggggtgggcccccagcccgagatgctccctccagggccggaggaggctggcggcggtgcggcctgactgggcacccttctggagcggccacccctcggctcgtcagtcaacacagtccctcactaggggacagctccgtccttgccacctgagcctgcccagccctggcgggccgtgccctctgctggccttccggtgccagggtggcccgtcctcatcccgcgccagcacctcccccagggactccggcacagtccttgccctctgtggccaggctgtcccaccgcctctgtcctctcatgggctcgcgctgtgtgtcatagcgtcagggcctgggccgctgtccacagggcgcctggtgacagtggcggcagcagcagcagcatggtggcagccaccagtgggcctggggcccccgggggagaggatgccccagaggtgcatgagcagacctcgtaaccgtcctccgagcggctctggtcatgttgtcctggaggggcgcggggcccctctgccgcgtccacgcccgcagccacagatccatcggcctgtgagtctccacacaccagccagtcccgggccgtggactgtgggtacccgggtgccacctccagctcgccatccagcactttccagtactcctggccacggaagaagtaggaggcaccgtcggaccagcgcatggcgtcgtccagcgtgctggggacacccctccacagggggctctgggcggggtagccggggtccatgtgcctcgtgtggtcatcgtagcgccagtacagctggtccttaaagaaataagtcctgtcattgtgggcccaggagaaggcagcgtcgatgccgccaggcgggaggctgaagtcggagacggggcgcgggtatccttcctctacgttattgtccttgaacacccagtacctgtctcctttaaagaagacgatcttgtggtcgctggtgcgctcgtacacggcgtccacgctgtccaggtgcagcggcaggccccgccagaagcggtgcatctgtgccggctgcagggacaccaggtgccggtcccgcgtcagccgccagaagtacttgcctttgaagaagaaagcttcaccccggatctgggccaccgcgtcaaagtgagtgctgcatctgtggggcacgtccttcctgggcggggcgctggaccggttgtctgggggctccggcagcaggggaggctcctcgggctgcgccgtgggagacacagactcccgcacaccgtacagctgccagacgcgcaccttgtcctcgtaggggagcccgtagcgcagcgggtcacccaccgggccctggtagtacggccgcatgatggagtgtgcagcggccacatggcttaacccaatggcgtggccaaactcgtggacagccactgcaaacaggtccatcccgtgggcatccgaggagcggaaggtccaggcctcgtcatcgttaaagtgggtgtacccggcggtgtggtggtggccggggaagaaggcgtgggcacggtgccgccgggcgtcgaaggggtagccgtcgttatggtcggccttggagaagtcgatctggatgtcggcggtgctgcccgccacctcgtggaagttcaggggcgcaatgtcgctccagaccttgagggcgtagtacatgagtgcacgcaccgtgtcgtgccccagtggtgagtcccgtgggaacgtccggaccctccacgacaggttcctcttgttccacttggtgggggctggagcctggcgtctcctgcgagcctgggtcaggacagggaggtctggcagggagcagcgtggggttttcatcagggccagggtggcctcgtccaggatgccggtggcctccaggccaccaaactgctgcatggctgtgatggccttagacagctcctcttgcgtctgcagctgccctgttgtggggtcagccgggggcaggtaaccgaacctgcttagccactccactcccaggctgaggtcctcggcgcgccgcgcgggttccggcgcggcgcagcccccgcgggtccccagcgccagcagcagcagcagcggcagcggcagcagcggcagccgcgagagtccgggccctgggggcggcgggccgggtccccgggctgcgcggcgccgcatggcgctcacatgggcccgcgggcggcgtgcagggtcccgcgccctccgcttcgcgttccgcagcccggcgccctccgctctccgcggcgcccccgccgg

SEQ ID NO: 2290 - DNA, 2306 bp, Homo sapiens
gaattccgggccgctacaaagcagggagaggtcatgttggtctggaacgcgtcacaggggggacgtgccgcggcaccatgtggggggctcgtctgtggggagggctgccccactggggacctggggacggaggccctgtgggccggcgggagcaccaggcagcagtgtgggtggggttggtggcgccggcacagagaggggtgggcccccagcccgagatgctccctccagggccggaggaggctggcggcggtgcggcctgactgggcacccttctggagcggccacccctcggctcgtcagtcaacacagtccctcactaggggacagctccgtccttgccacctgagcctgcccagccctggcgggccgtgccctctgctggccttccggtgccagggtggcccgtcctcatcccgcgccagcacctcccccagggactccggcacagtccttgccctctgtggccaggctgtcccaccgcctctgtcctctcatgggctcgcgctgtgtgtcatagcgtcagggcctgggccgctgtccacagggcgcctggtgacagtggcggcagcagcagcagcatggtggcagccaccagtgggcctggggcccccgggggagaggatgccccagaggtgcatgagcagacctcgtaaccgtcctccgagcggctctggtcatgttgtcctggaggggcgcggggcccctctgccgcgtccacgcccgcagccacagatccatcggcctgtgagtctccacacaccagccagtcccgggccgtggactgtgggtacccgggtgccacctccagctcgccatccagcactttccagtactcctggccacggaagaagtaggaggcaccgtcggaccagcgcatggcgtcgtccagcgtgctggggacacccctccacagggggctctgggcggggtagccggggtccatgtgcctcgtgtggtcatcgtagcgccagtacagctggtccttaaagaaataagtcctgtcattgtgggcccaggagaaggcagcgtcgatgccgccaggcgggaggctgaagtcggagacggggcgcgggtatccttcctctacgttattgtccttgaacacccagtacctgtctcctttaaagaagacgatcttgtggtcgctggtgcgctcgtacacggcgtccacgctgtccaggtgcagcggcaggccccgccagaagcggtgcatctgtgccggctgcagggacaccaggtgccggtcccgcgtcagccgccagaagtacttgcctttgaagaagaaagcttcaccccggatctgggccaccgcgtcaaagtgagtgctgcatctgtggggcacgtccttcctgggcggggcgctggaccggttgtctgggggctccggcagcaggggaggctcctcgggctgcgccgtgggagacacagactcccgcacaccgtacagctgccagacgcgcaccttgtcctcgtaggggagcccgtagcgcagcgggtcacccaccgggccctggtagtacggccgcatgatggagtgtgcagcggccacatggcttaacccaatggcgtggccaaactcgtggacagccactgcaaacaggtccatcccgtgggcatccgaggagcggaaggtccaggcctcgtcatcgtcaaagtgggtgtccccggcggtgtggtggtggccggggaagaaggcgtgggccacggtgccgccggggccgtcgaaggggtagccgtcgttatggtcggccttggagaagtcgatctggatgtcggcggtgctgcccgccacctcgtggaagttcaggggcgcaatgtcgctccagaccttgagggcgtagtacatgagtgcacgcaccgtgtcgtgccccagtggtgagtcccgtgggaacgtccggaccctccacgacaggttcctcttgttccacttggtgggggctggagcctggcgtctcctgcgagcctgggtcaggacagggaggtctggcagggagcagcgtggggttttcatcagggccagggtggcctcgtccaggatgccggtggcctccaggccaccaaactgctgcatggctgtgatggccttagacagctcctcttgcgtctgcagctgccctgttgtggggtcagccgggggcaggtaaccgaacctgcttagccactcctgagggcagagagcagggtgagggggtgcaacagagggcccggtcctacccagtgagaagcctgccacgggccaccactgcttccgggcaggccccctcccagccccctatctgcccacaaggcacctcttgtctctt

SEQ ID NO: 2291 - DNA, 501 bp, Homo sapiens
  misc_feature (1)...(501): n = A,T,C or G
ccttgnaattgtggntaacccgggttgcccaacttccaaactcgcccatccaaacaatttccnaataatccctggcccacggaaaaaaaattaggangcaaccgtcggaaccaaagcccaatggccgtccgtcccancgtgcctggggaacaacccctcccacagggggctctgggcggggtagccggggtcccatgtgcctcgtgtggtcatcgtagcgcccagtacagctggtccttaaagaaataagtcctgtcattgtgggccccaggagaaggtcagcgtcgatgcgccaggcgggaggctgaagtcggagacggggcgcgggtatccttcctctacgttattgtccttgaacacccagtacctgtctcctgggggcnagagaaacagcctgntggcccggctcggccccaccccgaagggcaggagctcctgcctttccttctcctgtgtcagccgcccttgccctggcccctcacctgggcttgatgggacagc

SEQ ID NO: 2292 - DNA, 344 bp, Homo sapiens
gcagtagctgacagggacgagggggagaggaaaccttgtctgaagttctcatttctgtgcaggacccctggcaggggagggccggtgttagatggggtttaagaaaagacaaaatgtcactgggggctcagtcggccacacagctgtgcgtttcccaggactctgagccacgatttggggcaaatgttgcgtgggacagggatgaggacagacagaccccagcgggtggtgaccgtgggcccagggcttacggggcgctggtccggttgtctgggggctccggcagcaggggaggctcctcgggctgcgccgtgggagacacagactcccgcacaccgtacagc

SEQ ID NO: 2293 - DNA, 667 bp, Homo sapiens
gcatgggaaaatccttgcaccaaggctgagctccgtgtggacttgacaagcacagactatgacactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaatgtaaaaaaaaaa

SEQ ID NO: 2294 - DNA, 2814 bp, Homo sapiens
tttttttttttttttttttttttcttgttctgccttactgatttatttcttaagttagagtacacatcgagtctggccagaatatagtgccacgtagctatgcctattgctaggtcacattaagaaagtaacttcatattgccctttcaactgcagtaacaccatcctggaagaaaaatggaccctccagtcaaagctgtctatatatgagagggttttagaggaagtttcccccaaaagattctttgttctgtaagtgaccccttgatgcaaggagtgtttcccagccctagaaataggaagcgcagccacaggcatggggattttaaaatcacgcttcagagacagacatcttggtgtttcatgttgacaccaaactgaccgtccctttgaatgaggaccagccacagttggcactgagaattccccccaactcagggcagtatagagattttgtctctggtttcatggcttagtggcaagcaataccctgaggttcccagcaccaagtgttcaaatcctagctaaaatcctctctccatgctcggtaagtccatgtggcacactttataacggtctaggtatccaagggaaagcgacaggcaacgcgctagcatctgcaatgatgcgaggtagttgagaaacaaggtgaccgatggggcactctgcagccccacccaccatcggttcccatcgcgatgttctgccgcaactcaagaactgcaaggagagtgtcacgcaacaggcagacaccacagaggagccagtacacgtgatgggacatgcaagtgacaagtttcccaaatacctttccgcataataaaataatcttaataaaaacataatttaaagaaagtctccaaagccgagtgtaaagtcagagctgtaaactctacccaagtttgaagggtctcttgaagaatcatccgctacaagatcagtcatgatttattgatggaaacttcagttcggtgatttcagagtcaggggagctgcttccactcctgtcactataggtgtccctgggtgagagcctgcagcctttctggaggtaatgtgagagccgccccacagaggccaggaggaggccaaagtatggtggggagggcttgataggcctggacaggaactcagggtggtactgaaccccaacaaaaaagggatgatcttctaactccacaatttccattctctctccttcaacatcttggccaacaaacttcaagccttgttcttccaaacactttttccagactggattcacctcaaatcggtggcggtgcctctcttccaagtagtctgcgtctccatagagtttcctcatgactgagttcttggtctggaacagggttctcctcttgcccagcctcatggttccgcccatctgccctgggttgtgttctggcatgtctacgaccacgggatgactggtcgtagggtcaaactctgtagaattggcatcttgccatcccagcacgtttcttgagaattcaaccactgccaactgcatccctaagcacacgcccaaaaaaggctttttctgattccgagcccaggcaattgcttggatttttccttctgttcctcgaacaccaaatcctcctggaaccagcactccatgagcactacagagcttctgccaagcttcgtggtagcgcacgggctcttcttgcgaggtgatgggctccaagtccgcagaatctatgtacttgatttccaatttgtggttgatggccagtgcagaatgctccagagccttaatgacagaggcataggagtctgagaactcggtgtatttcgccacaagggcaatagagcaggtctccagcaagcgatcatatctgtcagccatctctttccatttcatcagcatttttcttggctgcctctcaataggaaggtcaagtcttcgaagaaaataatctacaaccccttgctcctctaacaacaaggggactcggtagatggatgagacatcgtggacacagatcacttgttcaggctcaacatggcagaacattgatattttctccttcactgatgtgtcaagtggatttgagcacctgcatacaaccagatctggggaaagcccaagtcctctaagttcccgaacactattctgggtaggtttagtcttctgttcccctgttgaacttggctggggaactagactgacgtggatgttacaaaagttctctcttttgaccttgaattggaactgacggaaggcctcaataaagggcatgctttctatgtcccccacggttccaccaagctcaataacacacacttgaggttccaggccatcttcatctacaggtattaacgcctgtctcatcacccactcctggattgcatctgtgatatgagggacaacttggacagttttccccaagtaatctcctttccgttccttgttaatgacatactggtatatctttccagtggtcagattattgtccttggtgaggcggatgtcaaggaaccgctcatagttacccaggtcaaggtctacttccccaccatcatccagcacaaaaacctcaccatgctcataaggagagaatgttcctgcatcaatgttaatgtaggggtcaattttgattgaagttacatgtaaaccacatgacttgagtattgtgcccacactgctggcaatgattccttttccaattcctgatataacaccaccagtaaccagaatgtacttcattttactctttgacctgcggccggcttcagatcctcccgtcagcgacaggactgggccggcgacgcgcgcggatagccccggacagccagtgaacaaccccg

SEQ ID NO: 2295 - DNA, 3019 bp, Homo sapiens
gcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctcgctccggtttagaatgtaataactcaaggatttgataatacagtgaagtagtataacaactgtctacgtgcttcccatgatatgttctctatattgaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagctgggatctgactaacttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctgcttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcggttttaaattatcctgtatatacctaattatgtgcactggagagtaatttattcttcattatcatttgtaaacattgctttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactcctaagatgaatgaagtgtataactgtctctatttgatctattttttttacctgtttatcacatttgtgaaggtgaaattattcatggagtgaataagaaagatatgaagcagaactgttctattcaggaagctattagacttctcatttattttcattaagctgatttgcagctacttattctcatggccttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggccttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacagagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatgaaaattttgaagagtatattcctgaacttgcagctgcctatagcattctcctccataaggcgagaggagagccggatataagcagagatcgtaggtgaaaaaagatgggccattaaggattcttcaaggaaaacattcctcaaaatgatctttagtgcctttattcctttcaggccaataatccacccaaaaattagaatgttctgagacatccatttgggtctatttgtgacttattcgtattacaaattgacatcagcaaaattcaaaaagaattcagtaaaaagggcatagatccagctatccagactatcttgtgagagaataagctcaccccagc

SEQ ID NO: 2296 - DNA, 1137 bp, Homo sapiens
tttttttttttttttttttaccagttaaactgaatgtttaatacatttgtaggaacagaagaaatgcagtaaggattaaaattttataattagacattaatgtaacagatgtttcatttttcaaagaagtttcccccttttccctatctttttttaatcttccttagagcaataaatagtaattactatatttgtggacaagctgctccactgtgttggacagtaattattaaatctttatgtttcacatcattattacctcccaaaattctaccttcatttccctgcacagtttcactggactgtttcacaacaaaattgtactccactcaaattagaagagcccaaagaaattagagcaaacagcaaattcatatgaattagagaaccaaagattttaaagtgctgatttagtaacataatgtctactggcacaaaccttctatttaatcatattattcaaacagcaataacagaaatgaaagctacattaacgaaaaaggaacttaggaatgaggtcattaaatataactaactacattttaaatacggatatcatatatttcctgattagtatcaggtaaatatctagactcctatcctgaattccggtctcagataaaaaggtcagagacaattacaaggaagatgcttcatattatcaggtccattttttaaatgatggggtcctttaggaaaatttctttagtctttctttttatcacagatttctgttggtccttttgttggtaatccattcatgtctgcacccttaaagtttactttgcctttgtttgtatcattggattcttgtattgctttcttaggccatatacgactaacgaagggggaaaccagagggtatatatatggctccaggaattttttgtagatccagagcagaactggaatgacgatacaaggaatgcacaccattttcccaagcttgagctcctcaacctgcgaccgcagacacgcacctgggaggccggcgggccgcgaccgccgaggagggaggaggcaggaggccgcgcaccgcctaggactctgcgagcgcgcccgggctgggctgcggagcagctacaaagcccaacccaggccgctagcccgggcacactcacccgcgaccgcggaaac

SEQ ID NO: 2297 - DNA, 487 bp, Homo sapiens
tttttttttttttttgttctgccttactgatttatttcttaagttagagtacacatcgagtctggccagaatatagtgccacgtagctatgcctattgctaggtcacattaagaaagtaacttcagattgccctttcaactgcagtaacaccatcctggaagatgcttcatattatcaggtccattttttaaatgatggggtcctttaggaaaatttctttagtctttctttttatcacagatttctgttggtccttttgttggtaatccattcatgtctgcacccttaaagtttactttgcctttgtttgtatcattggattcttgtattgctttcttaggccatatacgactaacgaagggggaaaccagagggtatatatatggctccaggaattttttgtagatccagagcagaactggaatgacgatacaaggaatgcacaccattttcccaagcttgagctcctcacaccgaccgcggaaa

SEQ ID NO: 2298 - DNA, 440 bp, Homo sapiens
  misc_feature (1)...(440): n = A,T,C or G
acgctacaagatcagtcatgatttattgatggaaacttcagttcggtgatttcagagtcaggggagctgcttccactcctgtcactataggtgtccctgtagaattcagatggtttacgcatcatctcccaccaaaaactcactttacgtccctgtttttgtaaccacggttcctacagggacacttgcctgcacatggcaggaatcacaaagactgtttgctacataatatatttaacatgaaactgcagaaagatttccttcttctagctacaaaagatatacattccatttatacttcagtcacacaccctaccaccaactctgagtactggttctgggataaaggtgggcaatgggaacattaaacctacccatttgtgggctttactttcccagggaaaaactaggttccccctttaacatggaccagangggtc

SEQ ID NO: 2299 - DNA, 543 bp, Homo sapiens
tttacaagatcagtcatgatttattgatggaaacttcagttcggtgatttcagagtcaggggagctgcttccactcctgtcactataggtgtccctgggtgagagcctgcagcctttctggaggtaatgtgagagccgccccacagaggccaacaaacttcaagccttgttcttccaaacactttttccagactggattcacctcaaatcggtggcggtgcctctcttccaagtagtctgcgtctccatagagtttcctcatgactgagttcttggtctggaacagggttctcctcttgcccagcctcatggttccgcccatctgccctgggttgtgttctggcatgtctacgaccacgggatgactggtcgtagggtcaaactctgtagaattggcatcttgccatcccagcacgtttcttgagaattcaaccactgccaactgcatccctaagcacacgcccaaaaaaggctgtttctgattccgagcccaggcaattgcttggattttccttctgttcctcgacaccaaatcctcctgga

SEQ ID NO: 2300 - DNA, 347 bp, Homo sapiens
agaaatgaaagctacattaacgaaaaaggaacttaggaatgaggtcattaaatataactaactacattttaaatacggatatcatatatttcctgattagtatcaggtaaatatctagactcctatcctgaattccggtctcagataaaaaggtcagagacaattacaaggaagatgcttcatattatcaggtcagtatatacctaattatgtgcactggagagtaatttattcttcattatcatttgtaaacattgttttttcacatttttgtagttgtccataatgtaagcttgtgggtttgattattgttttccacactggatccagctggtttaaacctattt

SEQ ID NO: 2301 - DNA, 334 bp, Homo sapiens
ctacaagatcagtcatgatttattgatggaaacttcagttcggtgatttcagagtcaggggagctgcttccactcctgtcactataggtgtccctgggtgagagcctgcagcctttctggaggtaatgtgagagccgccccacagaggccaggaggaggccaaagtatggtgcggagggcttgataggcctggacaggagctcagggttgtgctggatgccaacagaaaagggatggatctgttaaatcgacaatccattctctctccttcaacatcttggcccgcaaacttcaagccttgattttccaaacactttttcgccaagtggattca

SEQ ID NO: 2302 - DNA, 2180 bp, Homo sapiens
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaaaaaaaaaaaaaaaaaaaaaaaaaaaaaaaaaaaaaaaaaaaaaaaaaaaaaaaaaaaaaaaaaaa

SEQ ID NO: 2303 - DNA, 2205 bp, Homo sapiens
gaattcggttcattcttttattgtccgttgttttaacctgactgaatacaagatcaacaagagcactgtactcctggcaattattacatatgttagaacatggattttgcactgtagacaacatttaacaccagtctatggggtactgcattgcttttataaagttcaaaataaagatttattttcaaacaagtgactttggtttatttcatacattacactttttcttgcagaaaaaaataaaattgtacaactgcataaatataaaattcttccaccatgaaaatggttaaaacattcataaagacacagcaccagcatgtgatgcctccagaaaggaaaaaaggaaagtaaaagaaaatgtataaagcaaattaattagccctgtcactagccaaagtgatgggcagatccagatctcagacacagctttagaacataccggaggacaaggcaagagatgtcaagacagcattcaatacaagcataacacaacccatcacctttttgtgtttttctgtagtgtcacttaaaatttaaagggcagttcccccatgacaaacccccaccccagcccccaggaaaaaaataaaaataaagacctaacaccacaggaaaagactatggagtatgttaaaaatgctcatcgatgggccattacctttgaaagagccaaaaaacaaaaaacaaacaaaaaaaaaaaattaccatgccagttttattcccgttgaatatttacaccttggacagcaaaccttgctcacataaagtagaaaacagatacaataaaacatggcttgaaaaatgaccagagtatgcacctgtagtactgtacactaaataaaatacacaaggcagcaatacttaggggccagaaacactgcttactacaagtcagttacggaatcataatttacagtaaaaatgggcacgtcccaaggctcaatttttctttttcttttgtcatttacagtagaataaatattttgttgctattgctacactttaatttacattctaacctattaaatgcagaaagctagtgtaaagcatatagattaagtgtaggtcccatacgtatgacagtttgttcaagactagtaggtttttgtttttgtatctttttttaacttattaaatggctagtgggaaagatttgtgcttgtgatcagctcttaacttcaatttttacatcaaaacgtccctgaaaacggtctttctcactgtacccaatgttctcaccgtacgccttacactctatgcgaatttcagtgtccatggtaagattggtgaactgtacggccagcaggggctgcaggtatttgggctgcaggagtttgccatagtacggataatactgcagaggaaaaccaggggagttgcccagtccaaaatactccacatttccaactttatccttatcttcatctcgcttgccagtgcactgaacgggaaggacatttgggttatacttcatcactgggtaagtctccaaggactcattcttgggaggcttaggtttgaagcctagaactcggttgagctttataataatgcacggtttgccctctttgtagccataagtttcatcatttaatccagagcaatttcccagccattcaagcttgaatctgcagacctttcgctctcctcgttcatgattaaagtctcctcgttctttcggttcactgggcacatcgccacaatcttcaaaaatcatgtcatccctctgggctgaatctttgtacttttccaggaacctaactatgttcagtacatatgcctcatagctcttgggatcattaggacgaaaggaaatttcagtcttctggatctgaggaatctgtgttaatcctggcggggccactcggtcctgatatgtgggcttaaattcactgatggtgagcagcatcacttggatggttccgatgaagatgccagccaggcagccataaaatattacgtagaatagaaggatcttaaaccaactgccaccggtcctgcccagaaactccttcttctctgagttccagatgaatttcttccagctgccctcctccttggctttcccgcgggccatggcgatggcgggtcagcagctgccgcggtccggagggtgggtggctgcggcgcgcccctggcgatgaggcatccggaactgacaccacagcagagacgcagccttccagcaatttagcatgaatt

SEQ ID NO: 2304 - DNA, 2025 bp, Homo sapiens
ccggacctcaggcccagttcagtgtacttcccctctctacttcctccctccagtcccttctccatccctcccttttttggctgccccttgcctgccttcctcgccagtagcttgcagagtagacacgatgacaccttttgcaggctaaaaaggctgagagtggcactatgtgcagtgagccaccatggaggaccaagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccactggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacgggtggcccgtgtgccccacagggatggctcaggggactgtccacctcacccctgcacctttcagcctttgccgccgggcaccccccccaggctcctggtgccggatgatgacgacctgggtggaaacctaccctgtgggcacccatgtccgagccccctggcatttctgcaatgcaaataaagagggtactttttctgaagtgtgt

SEQ ID NO: 2305 - DNA, 1843 bp, Homo sapiens
cacttcacagcggtccgaattccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcgggccagcaggtaggatggggtcggggcgtccccgcggtaggtgtccgcgcggccggggtgtcctcgtgagagtgtcgcgcggcggtggccagggtgtccccgtgggggtgcccacgcgggggtgtccacataccggcctcttggtctagtcttgctcaggagtccgggctgcttctagccacaagtagcccccttcccaggtggggaaactggggctgggtgccttgtctaaggtcctgctgtgctgactgcacctgtggtctcccagagctggtatcccagtaacaactacagttctgaagatgatgatatcccacctcccgaggtcaccaggcaccggccccactggccagacttcccaacttctccccagacccctagactctagaggttagaggctgcacagagcaatgggaggatacacactcgtcctcctggagcccctgaagaacagttaactaaatcaggacaataatcataactgagcactcgaagcagaggctgggtgtctggtcactcaggacagttcaagcctcatcctgtaggacagactcccctagatccgaccagagcgccaaccatatctgttatgtgtggccagtttcattccatgcacgacaacatggtcccccaccatgcagggggcccctcgacccagccccctggatgcttgtgacagcgagcagctctccccacaggcagtgagtgtagaggggtgtaaggacggggtcagggctccttcccagggatggcggctatggaaggcatggtggctggccctctgcccgcggtggactcgggagggagggctgactgtgtgtgtgaatgggcagagttggtgctatggaggttttgggggtctgcaggacggagggtggcccaacagtagttctgggaggcagtcaccacctcgtggccttgctgagacctggaaccctcagccagggcactccatctttcaaagcttcttggctgcatgcgtcaggtgggcaagctcagaaggttaaatgcacccgtgctggcggagtcccataaaaggggattcggcatcaaaaggaggaaaaaggttcaaagggcatttatcatggggttcagaatcacggatgtgaggggcggtagtgggacaacagacagaaaagcttccccttcccatactcacagtccagacacggcaatagccaaattccaaatttctaggtattctggactcagaatggggatatcatacgagacttagggggataatgcccttatcttcctattttaagggaaagaacaaactgaaccttctatgcaaaataggatgatgatcctggtcctcccagtaagaaataaaataagtagtctccaggcattcctttccgccagaggagcaactgtttttaaatagccctttcgtgcccagtctgttactaaaccatatgagttgtttttttgggggtttttttttttttttttttttgagacagtgtcttgctcttgctctgtcgcccaagctggagtacagtggtgcgatctcagctcactgcaactccgcctcccgg

SEQ ID NO: 2306 - DNA, 1876 bp, Homo sapiens
ggtaccagacatgtattctggcctttgtgtagcaatggagattcaacagaataatgcagcacagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacattttttttttttttttttttttttgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgactttggtttatttcatacattacactttttcttgcagaaaaaaataaaattgtacaactgcataaatataaaattcttccaccatgaaaatggttaaaacattcataaagacacagcaccagcatgtgatgcctccagaaaggaaaaaaggaaagtaaaagaaaatgtataaagcaaattaattagccctgtcactagccaaagtgatgggcagatccagatctcagacacagctttagaacataccggaggacaaggcaagagatgtcaagacagcattcaatacaagcataacacaacccatcacctttttgtgtttttctgtagtgtcacttaaaatttaatttttacatcaaaacgtccctgaaaacggtctttctcactgtacccaatgttctcaccgtacgccttacactctatgcgaatttcagtgtccatggtaagattggtgaactgtacggccagcaggggctgcaggtatttgggctgcaggagtttgccatagtacggataatactgcagaggaaaaccaggggagttgcccagtccaaaatactccacatttccaactttatccttatcttcatctcgcttgccagtgcactgaacgggaaggacatttgggttatacttcatcactgggtaagtctccaaggactcattcttgggaggcttaggtttgaagcctagaactcggttgagctttataataatgcacggtttgccctctttgtagccataagtttcatcatttaatccagagcaatttcccagccattcaagcttgaatctgcagacctttcgctctcctcgttcatgattaaagtctcctcgttctttcggttcactgggcacatcgccacaatcttcaaaaatcatgtcatccctctgggctgaatctttgtacttttccaggaacctaactatgttcagtacatatgcctcatagctcttgggatcattaggacgaaaggaaatttcagtcttctggatctgaggaatctgtgttaatcctggcggggccactcggtcctgatatgtgggcttaaattcactgatggtgagcagcatcacttggatggttccgatgaagatgccagccaggcagccataaaatattacgtagaatagaaggatcttaaaccaactgccaccggtcctgcccagaaactccttcttctctgagttccagatgaatttcttccagctgccctcctccttggctttcccgcgggccatggcgatggcgggtcagcagctgccgcggtccggagggtgggtggctcgcgcgcccctggcgtcctcgcgccgctcggcttctccggcctggctctctgcaggcaggacgcgctgcgctgcggctctcggagtgcgagacg

SEQ ID NO: 2307 - DNA, 3243 bp, Homo sapiens
  misc_feature (1)...(3243): n = A,T,C or G
acacgcgaggccgggcgcgcgcaccggcagcgtgntggaagtcttcccaggtgctgcaggcggtgctgaggcaagggtctgctgcaggagcacgggcccgaacccgctccaggcccgccgcgccagcgtgcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactcatcaatgtgaatggactgaaagcacagccttgtggcccaaaagaaacgggctacacacagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcaggccgcagtaattcaaaagcctcctccctagggtcaagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagggtctatgaactggacccatcccaactctcaaatcgtttggttttttttattttgattgagatcctcttctccctatgctagtgggggagatattgacaaaatcctatttctttcaaaaaggaacttttccccccgaaaaaaaaaaaaaaaaaaaaaaaaaaaa

SEQ ID NO: 2308 - DNA, 1459 bp, Homo sapiens
gcgttagcgtccgtcaaggggagctttgaatgtttggtgcccaagtcaagggcagcaggggaatggcatttgctatggcttttttttttttttttttatctaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctccaagagaagcgtgtccggcaggtaccggtccttccagtggtcgaggaagaccatgtccagtgtgtccacatcatacttcttcttcagctgggggatgatgtcctgggacgctccaaccacaagggtgaccttgtccttcatgccagcgaaatccaccatccgctgggtgatggcggcacagtcggggttgatctcgatggtgatgagcctcgcccctggtgacagcaggcgggccatgcgcacagctgagtagccacagtaggcccccagctccagcagcacggagggctggtgctcctgaatcacggcgtccacgatcttgcctttcttgtcgcccacgttcatggcccactccttctgctcgcagtaggtgtcaatggcctccagcacgctctgtgcgttcccgggctccgcatgctgcagcacgtggttcaggatgcgctgctccttggtgtcacccatgagcaggttgtggatgggctgcaggatgaactcgttccagccgataaggcacaggccccagccccagtgcctcagaagcagcagcagcaccaccagcagcaccaggcccagcaacacagctgccaacagcagaggcggggcctccggcatcttcaaagcacctctgagcaggctccagccctctggctgcgggaggggtctggggtctcctctgagctcggcagcaaagcagatgttatttctctcccgcgacggcccgcccgggactggacccgccccggtccggcgcaggcagcgcggcggcagccctagctgccccagaagccccacgacgatggcggcaatggcgggaattctgcggggattaggagggcgcttccggtggcggacgcaggccgtgcgggct

SEQ ID NO: 2309 - DNA, 1443 bp, Homo sapiens
tggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaaa

SEQ ID NO: 2310 - DNA, 1414 bp, Homo sapiens
  misc_feature (1)...(1414): n = A,T,C or G
ggcctgggaacngggcccttggaacctctaaggtggctagcagtctgnccccttgganagatggggacanctctaggtgtangtggnacagaaaccacactgcatcctcactcatgggccagggagncaactacaggnatgcgggagctggttctgagccattgnctcttctgctaagcaaggcccagtggggagtagggaaggagatgcttccactctgtgccacatggggcccagaggggctggtgctgctgcggggtccacctgtccccagcgcctgcttggtcagaaaggtgtgaatgctggctgactcctcttcgtttcccaggctggcagtcgatccccatggggctaacaggtcccctggcctagctgcaggagggctgacctctgcaccactgtggctgggagccagtgggccaggcgtgccacccagaacccagccagctagggccccgcccttagcgttagcgtccgtcaaggggagctttgaatgtttggtgcccaagtcaagggcagcaggggaatggcagttgagaaggatgtactaagtcgagttatatctatttttttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggctcaggcganggttgtgctttgcatttaggacacagcccggagccgcagaaggtcagcaggagcacgtctggcaccttcagtaccaggctgggtgagagagcccgagatgtgggccgggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctccaagagaagcgtgtcacgcagtaccggtccttccagtggtcgatgaagacatgtccagtgtgtcacatcatactcttcttcagctgngggatgatgtcatggacgctccaccacaatggtgaccttgtcttcacgcagcgaatccacatcgctggtgatgcgcacagtcgggtgattcgatgtgatagctcgccctgtgacacagcggcatgcacactagtagcacatagaccagtcagagacgaggtgtgtctgatcaggtcagtatgcttctttgcactaatgcatcttgcccaaggtcatgtcacagcttggtcagctcgattaactgtaagacctgctgttccaaaagttgagtt

SEQ ID NO: 2311 - DNA, 505 bp, Homo sapiens
ccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaacgtgcgcatctccaagcgctcaggcctggaccccacggtgacaggctgctgagggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcaccccccccaggctcctggtgccggatgatgacgacctgggtggaaacctaccctgtgggcacccatgtccgagccccctggcatttctgcaatgcaaataaagagggtactttttctgaaaaaaaaaaaaaaaaaaa

SEQ ID NO: 2312 - DNA, 492 bp, Homo sapiens
  misc_feature (1)...(492): n = A,T,C or G
cccaggtctctaagtggacattctgagaaacagtttaaacacaaccgctctaggtcaaagccactgaagataacctttcagccccctctctgtttccttcaggtcgagtcccagacaccagaagtctgaatttggagaaggctggggtagatactagccccgacactcagaagatcctgggtggactcccgggaagccacctctgtgccccacatctacggccattgggtgacgtggtggaggttcccacgaccgtcttcaccccactggagtatggctgtgtggggctgtccgaggaggaggcagtggcttcgccagggggcagggagcatgtttgaggtctattcacggcccatttttaaaaccactgggagttcacggtgggcttgggacgcagatggcatccccagtgttattgttaaaagatgggtgttcccttagggggagcccccaacagtttggtgcttgggccttnattttnctttnggcctt

SEQ ID NO: 2313 - DNA, 581 bp, Homo sapiens
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggtaatttgcattgtatatagatgatcgtctcaaattttcccaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacccttccattgaaaaagaaaaaaaaa

SEQ ID NO: 2314 - DNA, 1183 bp, Homo sapiens
  misc_feature (1)...(1183): n = A,T,C or G
aataatatgtttttttcttatttaaatcacaaaagtgcattaaaaggcaacaaagcaaaaaaaaaacaacaacaacaacaacaacaacaaaatgactaaaaacagcaaactgtttttaagcattaataattttaaaataagctgggggctttgatataactgtaagtaaaagataactaagtccacgtccacaaaaatttacaactgtaaaacatgcttagggtaaacttagaatttatttttagatgaatatatggttcatttgtaagaaactggaaatcatatggttttaaacttgtatacaaagcttatgtcttattcttaacactgaagaggcaggaatttagggttttgggtatacagatcagcaattcccctgtaattttctatcttgtcttgatctccaatttctctggaaaaacacttcagctatttttcactatctggtccctatgttaactggcaataaaaagtaaaaaaaacttaacatcttcaagggtatcaaagttggtctgcaaaaggtaattttagttttgttcaacgtaagtcaaggtgatatgaaagcatttatccaggaagagagttgaattatcattattttaagtaggggactaagggttctgtttcctggtccaaatctagtatctctattgcgtgctgctaatacttaggtacctgcccgggcggccgcccgggcaggtacttntgagtttttttttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacctcggccgcgaccacgc

SEQ ID NO: 2315 - DNA, 487 bp, Homo sapiens
  misc_feature (1)...(487): n = A,T,C or G
gggccgaaaaaaacacaaacccaggaggcccccaaaaaaatggaggaagggggccttccccaggattctcttttctcccgtggtgtatgtaatccaatgggggggttctggacatccgagaaccttcgttggttgattcttgnttactatgaggaaggtctaagaaaactaaggaaatctatgatgctgatggtgatggagattttgatgtggatgatgccaaagttttattaggtaatttgcattgtatatagatgatcgtctcaaaatttcccaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacccttccattgaaaaaaaaa

SEQ ID NO: 2316 - DNA, 482 bp, Homo sapiens
  misc_feature (1)...(482): n = A,T,C or G
tcatttacagtagaataaatattttgttgctattgctacactttaatttacattctaacctattaaatgcagaaagctagtgtaaagcatatagattaagtgtaggtcccatacgtatgacagtttgttcaagactagtaggtttttgtttttgtatctttttttaacttattaaatggctagtgggaaagatttgtgcttgtgatcagctcttaacttcaatttttacatcaaaacgtccctgaaaacggtctttctcactgtacccaataggttncccttnnnnncccacgagcctaactctatgcgatttagtgtccatggtaagattggtgaactgtacggccagcaggggctgcaggtaatgttgggctgcaggagtttgccatagtacggataatactgcagaggaaaaccaggggagttgcccagtccaaaatactccacatttccaactttatccttatcttcatctcgcttgc

SEQ ID NO: 2317 - DNA, 544 bp, Homo sapiens
ttttaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggccttggccgaggtgtgctttgcatttaggacacagcccggagccgcagaaggtcagcaggagcacgtctggcaccttcagtaccaggctgggtgagagagcccgagaggggggccgggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcatgttgtcagccagtagcactgtccccttccgcagcaggtaccggtccttccagtggtcgaggaagaccatgtccagtgtgtccacatcatacttcttctt

SEQ ID NO: 2318 - DNA, 459 bp, Homo sapiens
  misc_feature (1)...(459): n = A,T,C or G
ggcacgaggatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctcccccttgaggataatcctgtagaagattcacaggtaattgtaggaagaagtaagcatttttcctgtgggaggaacagcaggaagtaccaccagntactttaaagcttccaaaaagattgccccctaccaccacagggngggacccgccttaaccttacggttccaaaggtggctgttgttggtctt

SEQ ID NO: 2319 - DNA, 534 bp, Homo sapiens
  misc_feature (1)...(534): n = A,T,C or G
antgtattccaggaacgattgntagtgtgtgcactcaaagcagctntcccgcgcacgtgtgctaggaagtctggcgcacctgggcagatcacgttgtcagccagtagcactgtccccttccgcagcaggccacattcctgcaaacagaccggggggtgggggaggtgagggtcagaggtgcccagagaacctgccccaaaccaggatgggtgctcctcactaggccacggcaccacgcctgtgccttgcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctgg

SEQ ID NO: 2320 - DNA, 496 bp, Homo sapiens
tttgcatttagaaaccacccggaaccgcaaaaaggtcaccaggagcacgtctggcaccttcagtaccaggctgggtgagagagcccgagaggggggcgggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctccaagagaagcgtgtccggcaggtaccggtccttccagtggtcgaggaagaccatgtccagtgtgtccacatcatacttcttcttcagctgggggatgatgtcctgggacgctccaaccccgactgtgccgccatcacccagcggatggtggatttcgctggcgtgaaggacaaggttaccatt

SEQ ID NO: 2321 - DNA, 496 bp, Homo sapiens
caaatctagtatctctattgcgtgctgctaatacttaggtacccataataggtctttacactcagtttctgattgttagtatatgctttaagaaatttatttaaagtttgctttatcctcaagaggcacactttttaaggaaagtgttaattatgctccacattaaatgactttacaacgactgaattacttgaaaagttcttttaaaaattgctgaggcccaggcacagcagttcatgcctgtaatcccagcgtttttggaggctgaggaggaagggcttgaagccagaagttcaagaccagactaagtagcaaagcgagaccctgtctttacaaaaaatcaaaaaaattaggcgggcatggtggtgcacacatgtagtcccagctactcaggaggctgaggcgggaggatctcctgagtccaggagttcgaggttgcagtaagccaagactgcaccactgcactcccacctgggtgacagtgagactctgtctc

SEQ ID NO: 2322 - DNA, 419 bp, Homo sapiens
  misc_feature (1)...(419): n = A,T,C or G
cacttacatcatcatcaaatttttggtcatttgttgtgtcatctaatttctgtttcattttctaatggcttcgtatgtgaatgaattttagttattcctaacgtcattggtagccactcttttgaattttttttttaaacaagtctttcaattttattttataggtaatntgcaatgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgataattggatcatcaagattccccatagacacttccaatgaaaaagaaaag

SEQ ID NO: 2323 - DNA, 453 bp, Homo sapiens
tcatttacagtagaataaatattttgttgctattgctacactttaatttacattctaacctattaaatgcagaaagctagtgtaaagcatatagattaagtgtaggtcccaaacgtatgacagtttgttcaagactagtagggttttggttttggaaccttttttaacctaataaatgggcaatgggaaagatttgggcctgggatcaggccctaacctcaatttttacatccaaacgtccctggaaacgggccttcccaatggaacccaaggtcccaacggaaggcctaaaactcaaggggaattcaagggccaagggaagaattggggacctgtagggcaacaagggctggcaggaattgggcctccaggatttggccaaggtcgggttaatacggcgggggaaacccaggggattgcccagtcaaaataaccccattttccactttatcc

SEQ ID NO: 2324 - DNA, 515 bp, Homo sapiens
  misc_feature (1)...(515): n = A,T,C or G
gaagaagtaagcatttttcctgggaagaacagcaggaagtnccaccagaaacaaatagaaaaacagatgatccagaacaaaaagcaagagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcaggtattctgagacccttctccttaggacacttttttgatgttcatgtgttttgtgtgattgaattttttactcctcactattttccctttctaatttctctacagaatcagtttctcatgtatatgcataagcaagaaatacaattatcactattgcatgctgctgaatttagtaacatttttttctgctccccctccatatgacttctctctggctttgaaaagaaaataaacagtaacacttttgtcattg

SEQ ID NO: 2325 - DNA, 352 bp, Homo sapiens
  misc_feature (1)...(352): n = A,T,C or G
gggccaagtgcagcggcaacagcagcagcgccgcccccgccgccggtaaccgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgntgccaaagttttattaagg

SEQ ID NO: 2326 - DNA, 428 bp, Homo sapiens; identical to SEQ ID NO: 1543

SEQ ID NO: 2327 - DNA, 470 bp, Homo sapiens
  misc_feature (1)...(470): n = A,T,C or G
tgtctnnttacagtagaataaatattttgttgctattgctacactttaatttacattctaacctattaaatgcagaaagctagtgtaaagcatatagattaagtgtaggtcccatacgtatgacagtttgttcaagactagtaggtttttgtttttgtatctttttttaacttattaaatggctagtggggaaagatttgtgcttgtgatcagctcttaacttcaatttttacatcaaaacggcccctggaaaacgggtctttctcactggtaccccaatggttctcacccgtacgggccttaccactctatggcgggaatttcaggtggcccagggggtaagggattgggggnggaactgtcgggggccaggcaggggggnctggcaggggtatttggggggnctgcagggggaggttttgcccataggtacgggggataatactgcagagggggaaccaggggggggn

SEQ ID NO: 2328 - DNA, 446 bp, Homo sapiens
cacagcatttgggagaaaatttaatttaagtggcacattccgctggtgtgatgggatgtccttgtgttcagcaatagggagaccagctgtcctcctggggcttgttaccagactgcaaagcccccgccacctctctgtgtgcgtccctgtggctaagacatgacaaggttggtggtcggggccagctatgtggccctggagtgtgctggcttcctcaccgggattgggctggacaccaccatcatgatgcgcacatccccgctccgcggcttcgaccagcaaatgtcctccatggtcatagagcacatggcatctcatggcacccggttcctgaggggctgtgcccgtcgcgggtcaggaggctccctgatggccagctgcaggtcacctgggaggaccgcaccaccggcaaggaggacacgggcacctttgacaccgtcctgtgg

SEQ ID NO: 2329 - DNA, 459 bp, Homo sapiens
agaaactggaagttaatccgagatgaaggccttgcagtgatggataaagccaaaggtctcttcctgcctgaggatgataacctggggaagagaggggacacgcagaagatcctggtggactcccgggaagccacctctgtgccccacatctacgccattggtgacgtggtggaggggcggcctgagctgacacccacagcgatcatggccgggagtgaatcggttgagccgacatgcgccccggggctcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgctcatctttccggctgatattcatcgtggatgtgtggcatcg

SEQ ID NO: 2330 - DNA, 411 bp, Homo sapiens
  misc_feature (1)...(411): n = A,T,C or G
cggcaggtacggccttccagtgtcgagnaagacatgtcagtgtgtccacatatacttcttcttcagctgggggatgatgtcctgggcgctccaccacaaggggtgaccttgtccttcacgcaagcgaaatcaccatccgctgggtgatggcggcacagtcggggttgatctcgatggtgatgagcctcgcccctggtgacagcaggcgggccatgcgcacagctgagtagccacagtaggcccccagctccagcagggctcagtgacagtgggggtgcccctgtccacagctgcaggagtgggaatcgtgctgccttctgctgctacccttgggaagggtcccaggcctgcagggaaacccgtggcccactgtgtttcccagcggggcaggacgtgccatgacccacaggg

SEQ ID NO: 2331 - DNA, 335 bp, Homo sapiens
  misc_feature (1)...(335): n = A,T,C or G
ncctgtaatcccaggaacgattggtaagtgtgtgcaactcnaaagccagctgtcccgcgcacgtgtgctaggaagtctggcgnacctgggcagatcacgttgtcagccagtagcactgtccccttccgcagcaggccacattcctccaagagaagcgtgtccggnaggtaccggtccttcnagtggtcgaggaagaccatgtccagtgtgtccacatcatacttcttcttcagctgggggatgatgtcctgggacgctccaaccacaagggtgacctggaacagcgcctgtcagtgcccacgtcctcacagacaggaggccatccctacacacct

SEQ ID NO: 2332 - DNA, 303 bp, Homo sapiens
  misc_feature (1)...(303): n = A,T,C or G
cctgaatatgtgggcttaaattccactgatggtgagcagcatcacttggatggtnccgatgaagatgccagccaggcngccataaaatattncgtagaatagaaggatcttaacttgaagtgtgatgcattattaaccctttaattttcaatcaagagagactcacaggctgcatttttttttctttacaaaaantcatatattccagcttcttccatttcaaaatgtcagctaagcactatttccctgactcattctcctgccgattcccacagatcctnccaagcaggaacaccaatcggc

SEQ ID NO: 2333 - DNA, 257 bp, Homo sapiens
gcaagctctggtaggcaagtgcatgcagtgtgcctaaaacctgccagcagtacttttgagtttttttttttgttttgttttactttagcatttattattcatggattgaggaaatcaaaatggctgaggataaagagccaaagcatgggggccacaagattgggaggaaaggcggactctcaggaccttcattcttcacgtggtttatggtgattcattgctggccgtctggacatctgtagcttccgttggataga

SEQ ID NO: 2334 - DNA, 279 bp, Homo sapiens
cagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcaaaaaaaaa

SEQ ID NO: 2335 - DNA, 160 bp, Homo sapiens
  misc_feature (1)...(160): n = A,T,C or G
gactgcccctaccaccacaggaggaccagcctaaccatacgctccaaaagatggctgtgatagatcttgtgaagcaattactgagcagatcaagatctttgggaaggnacactaaagatgttttgnntgaattatagtccactggcattttagtgtattt

SEQ ID NO: 2336 - DNA, 234 bp, Homo sapiens
cgtaattatccacaggttaatgtaatcaacttcaccaccagctggtctgatggcctggctttgaatgctctcatccatagtcataggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaaca

SEQ ID NO: 2337 - DNA, 14871 bp, Homo sapiens
gaattcagggtgaaagggggatttgttgaatttgatagaggatggcaattaccaatatgatgagtgattgagaaacaagtctgtgccacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgagtaccgagctctatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttggacaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagagaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacggagacttaattatttttgcatcttttttagctcaaattgttcatgttgcaatagtcaatcaagtggatttgaattgtagccaatttttaaggccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctcattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaccctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacagaagcctcctggcaaggatcactgtccttcaatgtctgatgttcaatgtgttgaaaaccgttgtagcatatattttgtcttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagcagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaagacattaacagtagtggtattgtttagatgaaattttttaggctttaaatcaacaaatgttaagcagacatggggagcgaaacaccagtgtgttattctgacatgaataaactgctgtttttagggaaaaaatatagtcttgttaaggttaagctaattggttttctggtatcttttgcaatgttagtgtgttttactgctccataacctatgttatatggtaaatgtgcaatatatttctatatgttgctgtaaagaaatgtaataaaaaactgtttactttgtgatatgaaagtaaaaatttattcattgtcattgagcatacagaagtaaatatggattacatatgtcatattttaatgttcacatggtcccaccatcaaatgttgaaaaacttatagtttaacgtcatattctattgaagaaaaatacactcccttttctcaaatgtgaaatgtccagagagaatggaaaattacatataaagcatgtagttatagcatggtgaccctgctgtgatctctcagatgaggaacaaaagggagaaagaaagagcacactggtgctttggagttgagagaaggcaaaaaaagagtacaaaaatgtcaaagccaagtttagctgctcttcagctctccctttagctgctcttcagctttaccttaccatggttattagtgattgaagaaaattctaaagcactttttaaaggacccaattctgaagagtttagattcagagagcacaatggagttggagtgactcctgctcaaaagtttgagacaagcgagtccatgaaaagaccgtcctcctcttaatggaaatacccaggtttcctcattcttctcgccttgctttcagcactcgcagcccagaaagcccttatctaacaggtactgccgttgaaaggtcattgacttgtacaaaaatgatgagtgctgaatagatgtgcataggtcactgacagtatctgctacagagaatgagttttcgtattcttattaggatacacctaacatggcaatctactgcctcaaagaactctataggaggtaagtgaatttatattaatacagattgaattaaaggataatctagaaaaaggcatatgatgtaaaaaaatcagatacaagtatattttctgtatagtcagtttttacattgtgatttcaccagctggctgctgagtttgacggcttcttaacagccacactgctgagattcaaatgctgatagaaactttgatggaaaaatcactggagtaaatatttctaccatctgttgccctgcactgggaccctaacgttaagaataattcataccattgcttgtcctttatatttccccagcagtaataaaatttcataagattttgttttgtggtcacaaagctatcctggtttctgtaactagaagacatacactagcataagggaatcagccggaaaatttactgctaagagaatttgtctctagtcacttactttaaggttacagcaatgtgtaagtgtgggaatacattttaaaatgagcttttcaaagttattagctggtagtggcatgagagttaagtctcttaatacagttaaacagttgggcacttcatccttgcgtaaatattgttacccttttattgctgcttggaaactcctctgcaactttttggcccctatccatcttttcagaagtagtaaataaccaatttactgggagtgtggtaccaggcagaaattccgagaggggctttcaatccttgcccatcaagtgtatctttcagaaataagtatattaaaataattggataatttcagtggcttgttattagacttccgttgtccagcatggcatgtttaagaagatgacagattttcatacattattggaaagaagcaagaacaaaaaaacataacttactgtagtaaccacggtaaagaactgcttaaaatgcaggataaacatgtcatccctaagggattcccattcttagagcatgaaattatcaagagagtaagagactacaaaaaatgagaagaatgctgattgcaaattccaaatagaaaaaatcaaaacaaaactgcgcaccatcattctggaagcaatgagaagcaggaattgtcatttaatgaaatgtaagattaaagttaatagaagtaattttcatgaaataatattttgcaaggacgatgttccagccatattgatcttcgtgttttcttttcacatcccttcttactgttccctagaatgcttgtttctacctttaaatttgcttttctctctaccagagggctctaccctatctccagtttctcaccatgtcccaatctactccctctcagaatttttgtacacttccctttatatatatttgtgctctaattttatattcacagatatgccttttgtaactcccccatcttaaagaaagcacacacgtacgcacacatgcacacacacaaaattgaactctttctgggagatctgcttaactttcttcataactctgtcacttgctgaaactgtagtatgtgttttcatgtttattatcttttccattagaatgaacatattttgggtacttggtctttctcgatcaccaatatacctcggtacgtagaaaaattgattcatatattgaaaatgtaatattcagtagaacgaataaatacataaataaatttaaaaatgatacttttattgtattacctgagacaaatgatctccaagtttgtccttgcttttcatagccaaaacattctctcttacattgagcttccttcacctcttctgtgtacagagcacttaaaattttcacattgtctgatactttaacaatatgatggccctgttctcttacccattggagcatatgttaaataccagaacccatgtaacaaacatatattgtgatcctactgtgtgcaaagcagatactgcttgctgctaggaatacagagctgactaagagctccttttctctttatgagctcacagtctcatgagttcaacgtcttaaggcacaacgtctaaagcaaagggcagtaagtaaacactccagaaagtactggatctggcctaggacaaatggtgggttgtttttccagctgttatttttcctgccccctaattgacagtcctccattacacctctgggatacctagtctgacttgggaaaacctgactttgggaatcagaggcagtctctcttgcttatatatgaggaactctaatggatacttactgtcattagagaaactctgcttctagcctggctccttttgtaaagaaggttgagtccccttggagagcctgcagaacataaccatttgcatgtaatgaacagtttgtaatactttgagattgatgtgcaatttctatttgacaagggaaaaacaattaggattaaccgtggtcgtatatcccagaataccaacgttgtttccacactctaagtgttgttgggtcattatatgagattcataattttgtcctgttgtacccacgtttgcattaccattcagtcttaatttattataccctattaaaagtttttttggtaatttgttcttattgctactcaggcattaaaatgtctgcaggctgtgaaaatgaataaatttaatgtggcagcatagttctcaaaatcctggctttacaactcatagtacaggcttgtattgtaaatcctagttaacatggatttatttgaaaatccaattttactgctaatcttaaataacacatttttcaaacattttatccttgaatttctatttttttataatttatggctgttgtatgtatttacaaaaggacaatgtgtgtacttttaaatactagtaatggattgctgaaacaactgtaactttaaaacaatgcaattgttaaaaaaataaactgtgcagcctggcttaatggaggcttatgaacatatgattaagatatatgctataataagcaaattcactcaactgatagttcataggaactttcaaatttaatctcataaccagtgctatccttcaaagaatggtcagggcaatttaacgagtacatgaccacgcaagataatttcattgaagagtggctgaactgttgaaatattttctagtctccttgggatatcattaagagcagaaattttgaaatggaattgtaatgatgttcagaaaagataagtaggtaactctcttaatacgttttgtgctgctgtaacaaagtacctaaggctaggtaataatttgtaatgaacaaaaatgtattggctcacagttctggagactaggaagtctaacattaaggtgtcagcctctggcgagggcctacttgatatgtcatcacatgatggacgattagagggcaagaaagatcaaaagggggctgaactcccacttttataagggaaccaaacccactcgtgagggtggagccctcaatccttaatcacctcctaaagctcccaccccttaatactgtcacaatggcaattaaatttcaacatcagttttggagggaaaaacattgaaaccatagtagtgatactgacgactaccacacagggcttgggaggctaccctagctgttgcacccaagagatgaatcttctaatgtgattacctttatcattttttttactttattaaaatacttttattttacatgtatacttttgtctacccaccatttccatgtctgaccactgctactactatgtcctagcataacattccatacatccttaaaaccaagcaaagggtggagttccatctttaaaaactaaacaggcattttggacaacacattcttggcaatggaatctggacaacatttatcaaacatggtagggaaggttctcactctgcattatcaaaacgacagccagatatcaactgttacagaaacgaaatcagatggaaaatttttaacaaattgtttaaactattttcttagagagacttcctccactgccagagatcttgaatagcctctggtcagtcatctggaagcaattcttcacataattcatgaacttggcttccactttaggaagagaaccacctttttctatacttgcttgcatttttgctttaatgtcttctacagaactaggtcctttgggtgttttaggagtttttccttgttttgaaggattcttgtccttttgatcttggtgttgacggttttgagtcttttccattccgatttgacttttgtgcatttttggctggagtatctcatatagatttcttcactggcgctttttcttcagtttcctcatcatcaaaatcatcatcatcatcaaaatcatcatcttcatcagcagcaagttttacttttttctgtggaaccttgctaccacctccaggggcagatcgctttccagatatacttatgagtttcacatcctcctcctgttcgtcttctgactctgtatcttcctccccagctactaaatgctgtccactcacatgcactggccctgaaccacacttcaaccgtaagaccactgatggtgttatttcaaagccctcaagggaaaccatgggctgtacagacattttcaaagctgccagtgttactttaattggactgcctttgtaactcattgcctctgcttcaacaatgtgcaatttatcctttgccccagcccctaaactgaccgttcttaaagataactgttgctcaatttcattattatccaccttaaagtgatcatctttgtcggcctttagttcacaaccaaaaagatagttttggggcctcagaggactcatgtccatcatcgtccatcaggtggcaggacgcacttaggtgggagagagggcagatgatgataaaggaccactgctcaagagaacagctgtgcaggacagaatcacaccagggagattacctttatcttagaaaacctgaacatcttgtgtactttgacacttctctacatttcacctaacctttaacatcaacacatttattcagaaaacttttacttttggagctgctctgtgtcaggctctatgctaggtgctcaggatattgaaattgatacaatcctaacctattcacatataatccaaggtttgctgaaattgatggacatttaaacaattgaaacatttaagtggtataattagcaaatggacatttaagccataaaaatagcatctaatagatataatagaggtcggtacaccattgatgagtcagagcagaggcaacccaaagagtaactagccagaagaattgggaaagcttcatagagagagcgatatgaaaataagggagagaattgtaaatccatgaaaatgagaaaaagttgaaaagtgatggtgtcagaaaaacttgtggtatgataatgacaagatgagaggaactctttggtaagctgtgttggatgcatggaaagaaattggcacaaaataatgctgaggacattttttattttattgttggttttgttttggttaatttcattttttaaatctagtatgctagtgttcattgtccaaactgtgaatcataaactcagtttgtggatcaacaccggcctttgatttttagtgaaacaaaatagaaaatatcagcattcatcacaaatagatgtttcacagattttttgttttaattgcgactgtgtgtgtgtgggtgtgtgtgtgtgtgtgtgtgtgtgtgtgtgtgtgtgtgtatgtgagagagagagagagagagagagagagagagagagatggcttggatgtttatcacctccgaatcttatattgaaatgtgatttccaatgttggaggcagggcctggtaggtgtgattggatccgaattc

SEQ ID NO: 2338 - DNA, 305 bp, Homo sapiens
taagagttcacatcctcctcctcttcatcttctgactctgcatctcctccacagctactaagtgctgtccactaatatgcactggccctgaaccacacttcaaccttaagaccactggtggtgttatttcaaagcccccaagggaaaccgttggctgtacacacattttcaaagttgcctttagttcacaaccgaaaagatagttctggggcctcagggggctcatgtccatgtccatcgaatcttccatcgggtggcggcacgcacttaggtaggagagaaggcggacggagataaaagaacgc

SEQ ID NO: 2339 - DNA, 456 bp, Homo sapiens
tttttttttttttttttagaataaatagaactttattctttatccagtagatctcagtggaaagcccaacagtaacaggtgcacccacgggctccaggggaaggggccccaacccctggtgaaggaggtcggggcagagccagctcccccagctgggggtgcaggggtgaggggagacccccctgtaggcccgtcctgcggggtaaggagggggcacgggggtgggacaggttggcgatggtgagggtggtgaagccgggcagctgcttggcgaactccacagtcttaatgatgcacttggtggagagttcactgaacttgtcccagaggtcaatgtccagagagacacgttgttctgagctgttgttcgtagtgtatttgcccagctggcatagggcagggaaggtttcctggtgcgctttgcgcaccttctcaatgagctcccccacctccggc

SEQ ID NO: 2340 - DNA, 482 bp, Homo sapiens
tttttttttttttaaggcggacatctttattcaagccagcaaatgacacgccaggagcccaggtgagccggagtgctctgcccagcctggctgcagttgttggccagagctcagagctctcctgggcctggcagatggctctgcctgcacttctttttgggactcagagactaaattagaaaggggtgggggtagccccaggagaacccactttcattgtcaatcttgaggtcaaagaaaaccagaggtctgtcttctgcttgggggtcagcaaggttctcgtccaggaccctgagggtgctggggccttccagctggaggtcactggactcactgctgctgtcatccagctctcgggaggacgagttttcggcatctgagtcttccgagctgctgatcaccacaacgcgttcctcaggtcaacgtcaatagggtccctgggagtgctggcagcctctgggctggctttcttggatacagct

SEQ ID NO: 2341 - DNA, 362 bp, Homo sapiens
gtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaa

SEQ ID NO: 2342 - DNA, 303 bp, Homo sapiens
atgctttggtgggaagaagtagaggactgttatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgac

SEQ ID NO: 2343 - DNA, 375 bp, Homo sapiens
gagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtattgggagatcgatgggcaaacatctgtagatggacagaagaccgctgggttcttttacaagacatccttctcaaatggcaacgtcttactgaagaacagtgcctttttagtgcatggctttcagaa

SEQ ID NO: 2344 - DNA, 180 bp, Homo sapiens
tattgaattactcatctttgctctcatgctgcaggccatagagcgagaaaaagctgagaagttcagaatggtaattacacgagttgatttagataatcttcttagggatttgataaacacataggttcatatttatcagctgaattatatcagacaagcacttgttaaatacaaatttaa

SEQ ID NO: 2345 - DNA, 2110 bp, Homo sapiens
gaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgca

SEQ ID NO: 2346 - DNA, 8240 bp, Homo sapiens
gaattcagggtgaaagggggatttgttgaatttgatagaggatggcaattaccaatatgatgagtgattgagaaacaagtctgtgccacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgactgtttctcagactgtggtagcaggaggagggttggagttagcagtcatttgcatatgagactgccatttaaaaaaaaattttaaattatttcatttttctgactctcaatatgaaaagcacattgtagacaaattgaaaaatatagaaaaattatataagaaaatatagtctcaccagtatggaacaatgctaactatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttggacaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagagaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacgaagacttaattatttttgcatcttttttagctcaaattgttcatgttgcaatagtcaatcaagtggatttgaattgtagccaatttttaaggccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctctattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaccctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacagaagcctcctggcaaggatcactgtccttcaatgtctgatgttcaatgtgttgaaaaccgttgtagcatatattttgtcttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagcagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaaga

SEQ ID NO: 2347 - DNA, 532 bp, Homo sapiens
ttttgtagacggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaagaaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcagg

SEQ ID NO: 2348 - DNA, 404 bp, Homo sapiens
gtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcatgtttcgaagactcaacttttgcacaaattgtgacgttgttactgggcaaacccacgtatgtgtttgcaactactactctattaacagaggcctactaataaa

SEQ ID NO: 2349 - DNA, 1932 bp, Homo sapiens
taaattgactttcgatgttgagattactttcccttgctatttcagtgaaccaaacttaagtcagataaaacaattttatttggcttcaatatggtgctattttgatctgaaggtcaatctaccaacaagcaagaacagtttctcattattttcctttgccactccaagcagtctttactgaagtctttcgagcaatgtctgacctctgtttcaatacttctcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggtgagagcatctcaagcttttatctgcaaatgaagtggagaaaactcatttacagcagttttgttggtggtgttttcacttcagcaatatttccagaatcctcgggtacctgtaatgtcagttaatgtagtgagaaaaattatgaagtacattttaaaactttcacaagaaatcactatcgcaacagaaactaaatgcttaatggaaatggtgttttctggggtgaaagaagaaactatagaaactataggtgataaactactgtggtagcattttaatcctaaaagtttctttctttcttttttttttttcttccttataaagggcctgcttgttgagtccctagttttgcattaaatgtcttttttttccagtaacggaaagtgcattttcatgaagaagtacacctataatagatgggatccatcctggtagtttacgagaacatgatgtctctcagtctgcgcatcctaaatcaggagtaattacagaacacatttcctgttctttgatatttataaagtcttatcttgaaggtgttagaatttttaactgatctttttgtgactattcagaattatgcattttagataagattaggtattatgtaaatcagtggatatattaaaatgatggcaataaaaatttttatgagtgcaaagctggcataaaaattatttttaaaaggtacaatttccctttcattccagttattgtaattctaagattaagaaagaacgttaaaatctgccgtatgtttttaagcagcatatgtttagaaactcatggaacacttgacattagaatttgtgtataccagggtagagaagtttgaaaagaacacacatctaaaaataccatgtcagatgttctaagaaaaaaaataaatctagagaagttattcaaatatattatttgggatgtttagtacttctctattaactaatgacttatgacctactttgataattccaaagtaaatcactgggccttttctccctggttgtgtcaacttggctaagcaaatccactagtccaggggtcaccaaactaagacctgctaaccaaatttagcatgctgccagtttggtatggctcatcaccaagaagtgtttttgcgtttcaaatggttgaaaataatcaaaagaaaaaataatattttatgacatgtcaaaattacataaaattcaaattcaaatttcagtgttataaataatgttttagtggaacacagccaaactcatttatttatcacttatgattactttcgcattacaacggcagagtttgaatagttgtaacacaaactgtatagtccacaaagcctaaaatatttattacctatcctatcacagaaaaagtttggcgacccttgctccagtcaaatggctctcaaactctatgaatattagcattctttttgtggcaacaactttcaggaccttccaagcactctactcacgatggatttagaaaatctaacaaaaattgatggagtgaaaagcataatggcacaaatccgtgaagctt

SEQ ID NO: 2350 - DNA, 931 bp, Homo sapiens
ggttttacgaacccgaaaactaaaaattgaagtgcaattaaataattgaagtgcaaaatactatggcagaaaaaaaaccagctaattgccaaattttcctaatttttttgaaaaaagctgaccacaggaaacctaaagaccattaaatgcagcatccgttctccacacgatacctaacatccctatttaaccacttttacattgtccttacacttatgagtcaactgtaaataagagcaaaaataaatgcataatctttatgttgactaagactttcacatgtactaactgtaaaatctaacagctaactcaagcttatgtatctggtagtagccacaatttagtgtcttgcttccagatttcatgttaggatgattttggcataatgtatttcccataagatctaggaaaaaaaaaaaaaaagatctctaccaactcccaaaaaagccaagaccagactgccccaagcagtcaaatggaacagcaaggaaaaccacagcaatttccttaaccaacatagtaccaaaaaagtaaaactgaattcaataaccaagaaataatttaccaactataggaaatctgggaaaaatatactaaagttatcatctcagactgccaactgtattcttcatgcatttcattaaatacatgagttttcaggtatttcattaaatgaaatattatctgtggttaggaactttttaaaaagagccaacacttaaaaagggtaaaggcagaatcgataataaatcacaaaaccccttggatttaatcatgtccccagaaaatccagttgacctcttggtcagtcatccggaagcaattcttcacataattgatgaatttggcttccactttgggaagagaaccaccctattaagacaaagcattattacaggtaagtagagaatacaccgagagagataccttt

SEQ ID NO: 2351 - DNA, 664 bp, Homo sapiens
acagtagacagagtaagaaccctgaagtcggaagccagaagcaaaaggcgactggccagtttcctcagacatggggtccccagcatagaaactccggaatggcagcctttgccaccagcctggacacacccgtcccttttgtcctcagaacagatgagctcaggtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtggggtggggcccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggaggccaaggtgggcagatcacctgaggtcaggagttcgagaccagcctgaccaatatgatgaaaccccgtctct

SEQ ID NO: 2352 - DNA, 4101 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgcccttttcccgcgcggccatggagatggccctccgaaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatccgagaccatcaaagcccggatgttacgtgggcctcaccccagacaagcggttcctccctgggcacctgggcatgggacttgtggaaggttatgattccatgggctatgaaatgtctaaggctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccggggcaggtttcctcagacatgggggtccccagcaaggaaacccggaaatggcagcctttgccaccagcctgggacacacgttcctttttgtcctcagaacagatgagctcagggtagggtagagaacgccactttcttcagacctgtcccctttgtgtttaggaaatgagtttaaccagggaccaagtgggccattttagtgttcctgggaaatttaggagggacagtgttggcctttggagtcgggccttcttgtgttaaggggcacaaggtccagatcactctggagcagggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcatttccctctttaatctagtttaagccaaggacatccaggaattcattggcttaaataaagaacccagggccggggtgcagtggctcatgcctgtaatccccagcactttgggaggctgtggggggcggattgcctgagctcaggagttcgagaccagccagggcaacatggtgaaaccctgtctctactaaaatacaaaaaattagccaggtgtggcgggtgtgcgctggtagacccggctactcaggaggctgaggcaggagaattgcttgaacccgggaggcggaggttgcagttagctgagattgcgccactggacgacagagcgagactcagtctcaaaaaaaatttaaaaatttaaaaaaataaaaagaatccaaccccggaaaaaaaaa

SEQ ID NO: 2353 - DNA, 973 bp, Homo sapiens
ttttttttttttttttttttttgatgcattcaaatatttaattgagcagctaaggagatacaaaggcgatttaaaacattgtcaggtgaggcaaatgcaccaagtaatagaaagcaaagggcaaggttcactgaatcacagcagtcagaagaaagtgctttagggaaccaagagattgtttccagcctgaagaggcatgggtggcaaatcagaaaaggggattgagattaaaatagaagacttcagtctgggattgttgatgacactcagtatggactatatttgtctctccttttcctttctccccatctttgggcttaattttacatgtaagtgcccaggactggttcaatgcgcttttttcctatacttgcttgcatttttgctttaatgtcttctacagaactaaggtccttttggtgttttaggaggttttttcctgtttcctgaagggatcctggtccctgtgatcttgggtgtgaataagggtttgagttctttcccattctgatttgacttttgtgcatttttggctggagtatctcgtatagatttcttcactggcgctttttcttcagcttcctcatcattaaaatcatcatcatcatcatcttcatcatcatcctcttcatcatcatcgtcatcatcttcatcagcagcaagttttaacttttttctgtggaaccatgctaaccaccccaggggcagaccgcctttcagatatacttaagagtttcacattctcctcctcttcatcttctgactccgcatcttcctcacagctactaagtgctgtccactaatatggcacggccctgaaacacacttcaatccttagaccactgttggttgtatttcaaagcccccagggaaaacgttggctgaaagacattttcaaggtggcagtgttatcttaattgaacggcctcgaatgtcatgcccctgctccacaatgtgcaaccatcctttgcac

SEQ ID NO: 2354 - DNA, 3962 bp, Homo sapiens
tttttttttttttttttttttttttttttttttttttttagaaaaaatagaactttattctttatccagtagatctcaggggaaagcccaacagtaacaggggcccccacgggctccaggggaaggggccccaatcccctggtgaaggagagtcgggcgcagagcaggctcccccagctggggtgacaggggtgagggggagacccccctgtaggcccgtcctgcggggctaaggagggggcacgggggtgggacaggttgggggtggggggcaggccagggaaatgagaggaactcgggccaagtgtgtgtcggcccatctactgtccagtgtgtgtgtgtttgtgtgtgtgcgcacgcgcatgtgctgtggtgtctggggggccctatgggggtgctggtggctgaggccgggggtgggggcaagctccggcccctggccagccccttcacagtgggggctggggagcctagatgatgtgggccctgacgggaggcagctctgccgaggagccaggtctgggaaaactctgtcccggggcccttgctctgccctgctccatgcctcatggtgggtgcaggcaagtgccaaggccaggagcctgtcctttcagggctgccccacaccgtccacacccagtggtcaggcagagggagaaaggggctggcggcttctccagtgggagggaggggaaggcaggccttggaaagttagtacttcacagttttaaagagaaaactgaggaggaaaaggctgaggaggagaactggggggcacagggacatgaaaggagagtgggggccccttccgagccactccctcccccggacccaccccctccagctctggatccagctccccccaatacacagcacaaattccttcagtataaatgtgcttaaaatgaaaattcttattaaaaaaatcaaaacaaaaaaattaaaataaaaacaaaaccaggcgagaattaatacctggggttggtatggcagggtatgtacagggggaaccccccgcccctgtcccaccccctctgtcaccaaccgaggcaggggggaggttgaggttccccagactggggagccaatggcttgtgagttctgaggatgggggagccaagtcctgggcgtttgctggtgatgaagatagtggtgagctgggcaagaggggtgtcttgatgaacacgaggcccccagggacccatcctgagacccagggaccaggggcctcacttcagttcctgggcctcggcttcttgaacgttcagcccaggctgtgggagcaggcagtccactgagggcccaggcctctgtccaaggagtcgctgcctcctccctccccgtcccccagggaaggtccccagtactgcccgggcagggccaagttgggggcagggctgtggccggggtcacatggtcggtagaaaggcagagaaaaagccggggcggagggcgagggctgtgtccatgtggcgtgggcggtcacggggagtgggtggccgggctgcttctgttggagctggggctgaggctggggctacagctgccctggcgggggggccaggccacccccgtcccgccccccaccccccggctgtccgctcagagtgtccaggccctctgagttctccaacatttcctggatgagaggcggcatggagcccgggatctccatcttcagcgtgatcacccgctcagcccccttggcgctgatgcttcgcaggtcagtaatcttcattagcatcttggggaacatgtgggggcggctgggcctccgcttccgcacgtagacctttagcgcctccagcagcggctcctgcagcatgtccacccggtccggctgctccaggtccttggcggtctcccgagatgaggcagatggcgctgagaggccccgtctccgcatcatccatccccagggggcacagctggttggcgaaaggcaaagaccaggtcggtgaagggggccgaagcccagcgttgtgcatctgggtcccggttcagggtcagcccgtcccaagaaggtcatggtgtccctgcctcgggcgtgtaccgcgtgcagatccgcaggatcaggatgtcccaggcaggcagcccttgaggaggggtgatctgggtgggcgatggttgagggtggtgaagccgggcagcctgccttggcgaactccacagtcttaatgatgcacttggtggagagttcactgaacttgtcccagaggtcaatgtccagagagaacacgttgttctgaagctgttgttccgtagtgtatttgcccagctggcagagggcagggaaggtttccctggtgcgctttgcgcaccttctcaatgagctcccccacctccggcgtcagcgtgtagctctcagagcactcgggcttgggcacctccttcttcttcttgtttcggtcgtttctcacagactccttggacatgcccacttcaaagcacttctgcagtcggcagtactggcagcggttccgggtcaccttgttgatgatgcagttcttgtcccggtgacacgtgtacaccatgttcttctggatgctgcggcggaagaagcccttgcagccctcacaggcgctgaccccatagtggtagcctgaggacttgtcctgacagacaaagcaaggcttgtagatgcggggtagagggggtggcgagggagggctgggcactatctcttcagaactgctgctctgggtctcaatggctttcccctgggtgatgcaagagctgaggtcctgcaggcgcaccttgaactcgtcgaagccatcggtgcgcacggcagcttgcaggctctggggctcctcctggcgcaggcggcagagcgcctggcgcaggaaaccgtgcatgtccagcacctcctggtccgaggcgtagcacttcatcctctgcaccagcgcgctgcccgtgcggatgcgctgcagcacagcatccaggcggcccagccgactggccatctcctcgtagtcgcgctggtaccgcgcgtccacagcctccagcagctcgcgctcctgagcccgcacgtgagctaccacctggcgcacgcgctcgcggatcagctcctcggtctcggcacgcgcgcggcccagctggccgacggccgcgtgcatctgcgcgtgaaccgcgccaaaggcactatcctgctcctgcagcgcctgcgtcatggcgtccagctcctcctgtcgctgctggatctctgcgctgatgtcgcacttgagctcactgtggctgctgtcaaggagcgcgcacgagcagcacagcggcttggaacatcctcggcagtagatgctggtcagcgtaggggtgcggtggttggggttggagcagaagatgttgttggtcttgcgggtgccgtccaggaactcacgcaccgactggttgcgcagctctgctaggggccgggcctcgtgcttgaggaaccactggtgtgcctcgaagcacttggcgcagaggagctgctcgcactcaaagcaccagaagtcggccgactctttgcagcgggtgcacacagcctgcgcatccacaatctgccggtacaccgacaggcgccgctgcagactctcgaaaaagacgttatccagggcgggtgtgtctgcacctaggggccagggcgcctggcagatggggcactgcatgcccgacgcctccaggcatcctgagcacagcgtgtgcagacaaggcagcagcttcgggcacttggcttccgcctggcattgctggcagcgcagaaactggaactcctcctccgaagcgggggctcgctctgtagggctggggctggggctgggctggcggccttcagagggggtctcggggggaggcatggtgggctcctggggccgggcggggtcctgctggggcctcggagatcgggcgggtgcaggctccatggaccccagcttagtttcgattctcggtttagatcttggagtgcgtgaagagaagctgaaggggag

SEQ ID NO: 2355 - DNA, 3446 bp, Homo sapiens
tttttttttttttttgatggttcaacaagtgtttattgagcagccacatctgccaggtcgttgggatagccagtccctgtgctcatgggcttagatcctggcagaggcctagtggagaggcttggggtgggggtcgggggcgatggaaggctgtgctattggccagggactcagaacacaggagagtgcaagggtgacagaagtttctttcttgggcaaagaggcctggaatggtggcttgaatctcgagccatgccttagccttcccctctcagccagagaagacccaggtctccctgcccagaggtccatgcatagccattcattcgttgattcattccttaaccaagaattaatgagtgctactctgtgcagggcctgtaagagcatgggctggaggaggcagctcaggggccgggcaggggtgttggctgcaaggttacaagagaagggtagcactctcagaggcctgcttgacgggcgcctgggactgggctgatggggggcctttctggggcacagggtggtgggaatgtaattggagaggcttccagaggcacttggacttgagaggcctccatggagcctctgacagagtccccagggggaacaactgctccaagagtctgggctctgccttcccctgcccccaccacggaagacatgtcaagctgggaagccatggaggagaaggggagggcaaaaaagttgttgagccactgggataaatgggaggagccccggagggagcggctgcgggatcgcacagcccctcgtatccggtggggtgggctgatgcccctttgcagctgggcaggatgttcctgggcattggcaggatggttgaggggccctgtgatggcaggagtgctggcttggaccacatggggagaccaagtccgaataggggcccgatgcaattgagggtgcaagcggagggcatggcgaaggcggatggctctctgtgctctgtacaacaggtagcggatcccacggtggacggcagggcgctcctggtgatcaggaggctcgctgtgaggctcagcatcgggggtggcagcctgctcagcgggctggtggggaggccaagctggggggtggtatgtgccacagggcaggctggaggctccttgtgctctcagcagagactggactggcgaggagtgggctggcgaggagtgggctggcgaggactgtggctcggcggtctccatgggttccatgcactttccaatacagaacctcagactgagggctggaagagacctcaggggccacccagtccaacctttcactctattcagatccccttttcccctggacaggtgatagtccagcctctagtaataaacctctagggacagaagggtcactacccacgaggccacctgtttcactgtggaatggatttatatatctttctacatggatggagtcaaacctcacttgtttggcccctatatagctgccctgtggcctgacaccccttcactggcccccactggctgtaataaaccaaggaatggattcttgtccagccctcctcactgaggacttagaggacagaaaatgcataaggaagctccagacaaaggtcttggacattccagaaaagagacagtgctctggacacatgctatcagcatttcagaagagctcctggccctggtgtagtgggagggctggggtggtccaggcatgcagctgtcatttggagactgtcctcagcacagcttgggactcaatgcctcactggaaaattccccaggcgcaaggcaagtctgagagtcacctgctgtggctgtgccccctgggacctgaaatggggggaggcaggagtcctgggctgaacttctgggccactcaccgagttttcggcatctgagtcttccgagctgctgatcaccacaacgcgttcctctccctacctgcctccccggcgccactggccacgtggttgctgttgggcaggaagacctcacttcctatgacggggctcctggggctaggcggtccatccaggtggggtggtgagactgccttggaggtgctgggcctgggctgctccggggagctccgagccaaccttgcctccttcccctcctcagactccatcttgatgaccttcctggggcactgggtctggctgcacttcctcttctgggctgtcgttgtattggagacatcctctccataggaagggcctttgatggagaaggcgtacactggcacggggtgtgccccgggcactgactgtaccacagccataggctgggcttcagccagccccagggcctgaacctgggccttcactctctctgcctcctcggccaggtcaacgtcaatagggtccctgggagtgctggcagcctctgggctggctttcttggatacagctgcatctttcccctgggtgatgcaagagctgaggtcctgcaggcgcaccttgaactcgtcgaagccatcggtgcgcacggcagcttgcaggctctggggctcctcctggcgcaggcggcagagcgcctggcgcaggaaaccgtgcatgtccagcacctcctggtccgaggcgtagcacttcatcctctgcaccagcgcgctgcccgtgcggatgcgctgcagcacagcatccaggcggcccagccgactggccatctcctcgtagtcgcgctggtaccgcgcgtccacagcctccagcagctcgcgctcctgagcccgcacgtgagctaccacctggcgcacgcgctcgcggatcagctcctcggtctcggcacgcgcgcggcccagctggccgacggccgcgtgcatctgcgcgtgaaccgcgccaaaggcactatcctgctcctgcagcgcctgcgtcatggcgtccagctcctcctgtcgctgctggatctctgcgctgatgtcgcacttgagctcactgtggctgctgtcaaggagcgcgcacgagcagcacagcggcttggaacatcctcggcagtagatgctggtcagcgtaggggtgcggtggttggggttggagcagaagatgttgttggtcttgcgggtgccgtccaggaactcacgcaccgactggttgcgcagctctgctaggggccgggcctcgtgcttgaggaaccactggtgtgcctcgaagcacttggcgcagaggagctgctcgcactcaaagcaccaggaagtcggccgactctttgcagcgggtgcacacagcctgcgcatccacaatctgccggtacaccgacaggcgccgctgcagactctcgaaaaagacgttatccagggcgggtgtgtctgcacctaggggccagggcgcctggcagatggggcactgcatgcccgagccctccaggcatcctgagcacagcgtgtgcagacaaggcagcagcttcgggcacttggcttccgcctggcattgctggcagcgcagaaactggaactcctcctccgcc

SEQ ID NO: 2356 - DNA, 14041 bp, Homo sapiens
  misc_feature (1)...(14041): n = A,T,C or G
gggattccctcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatgatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcaggtcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcatttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaattccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaattggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccacggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagagcgaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtcttgaggatggggccgcaatggcagtggagccaactccagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagccccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatagtttatgatacgggacgaacagggaggatccgtgtcctgtcttttaaaaccggcatcatttccctgtgtaaagcacatttggaagacaagtacagataccttttcaagcaagttgcaagttcaacaggattttgtgaccagcgcaggctgggccttcttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggatgctgcaagaaactacacaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatattccttagagagtgaggaaagaggggagctagagagaatcctaggagatcctgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtctttttccacatgggcagatgatttgggcagagcgatggaagtccttaagtatcagtcatgacagatgaagaaggagcagaataaatgttttacaactcctgattcccgcatggtttttataatattcatacaccagagaggattagacagtaagagtttacaagaaataaatcgtatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgcntttgcatccttttggcgtgatatccatatgaaattcatggctttttctttttttgcatattaaagataagacttcctctaccaccacaccaaatgactactacacactgctccatttgagaactgtcagctgagtggggcaggcttgagttttcatttcatatatctatatgtctataagtatataaatactatagttatatagataaagagatacgaatttctatagactggactttttccattttactaaatgcgttcatgctcacatcctaatagaaaggaaattacttcgagtcagtcatccagggcttacctgcttggtctagaatggatttttcccggagccggaagccaggaggaaactacagccacactgaaacattgtctacagctccagatgatttcaccatttagaacaactgcccactgacaacgaaagtaaagtaaagtatgggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcaggaaggtattttttaactcccaagccgttagcaggacggatgatagggctggagggctatggattccccagccccatccctgtgaagggagtaggccactctttaagtgaaggattggatgattgttcataatacataaagttctctgtaattacaactaaatttattatgccctcttctcacagtccaaaaggaactgggtggttttgggttttttgttgctttttttagatttattggtcccatgtgggatgagtttttaaatgcccacaaggaccttaattttaaaattaaattaaaactttgggaaaaggtgtaaaacagtagccccatcacatttggtgatactgacaggtatcaaccccagaagcccatgaactgtgtttcccatcctttgcatttctctgcggagtagttccacacaggtttgtaagtaagtaagaaagaagggcaaattgattcaaatgttacaaaaaaacccttcttgggtgggattagacaggttaaatatataaacaaacaaacaaaaattgctcaaaaaagaggagaaaagctcaagaggaaaagctaaggactggtaggaaaaagctttactctttcatgccattttctttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaaagaaaaccaaaagctctaaggtaacaaattaccaaatttacatggaagatttggtttttgtcttgcatttttttcctttatgtgacgctggaccttttctttacccaaggatttttaaaactcagatttaaaacaaggggttactttacatcctactaagaaagtttaagtaagtaagtttcattctaaaatcagaggtaaatagagtgcataaataattttgttttaatctttttggtttttcttttagacaccactagctctggagtgagtctgccataatatttgaacaaaaattgagagctttatgactgcattttaagcataattaatttgggacattatttcgtgttgtggtccttataacccacccaagtatctaaactgcaaatccacacctaactgaaccctaaccatcacatggcatggtttggtcattgttttcaggtactgaggtccttacttgacgtatcataatatattgtgttttaacaccaaccactgtaacatttacgaattatttttttaaacttcagttttactgcattttcacaacatatcagacttcaccaaatatatgccttactattgtattatagtacgtgctttactgtgtatctcaataaagcacgcagttatgttacaaaaaaaaaaaaa

SEQ ID NO: 2357 - DNA, 2768 bp, Homo sapiens
gagttttttttttttttttttttactttattaaaatactgagttttatttcacatgtatatttttgtctcccccacccatttcccatgtctgaccaccgcctactactatgtccctatccataacattcccatacatacttaaaacccaagcagaagggtggagttcccatctttaaaaacttacacggggcattgtggacaacacaattccttggcaaatagaacctggacaacatttatcaaacaccggtagggaaaagttctcactctgcattataaaaaaggacagccagatatcaactgttacagaaatgaaataagacggaaaattttttaacaaattgtttaaactattttcttaaagagacttcctcccactgcccagagatcttgaaatagcctcttggtccagtcatccgggagcaaattcttcactataattgatgaatttggcttccactttggggaagagaaccaccttttttcctatacttgcttgcatttttgctttaatgtcttctacagaactaggatcccttttgggtgttttagggagatttttccctgttttttgaaggaattcttgtcccttttgatacttgggtgtgatgatgatggtttttggagtcttttcccattctgatttgacttttgtggcattttttggctgggagtatctcgtataggatttctttcactgggcgctttttcttcagcttcctcaatcatcaaaaatcatcatcatcatcttcatcatcatcatccatcctcttcatcatcatcgtcatcatcttcaatcagcagcaaagtttttacttttttctggggaaaccttgctaccaaccttccaaggggccagaccggctttccaagatatactttaaggagtttcacaatccttccttccttcttcaatcttctgactctagcatctttccttccacagctaaaatacaatttattagacattataaaactcaagcagcaagaagtcagaaaaaaaaagaacactgatagtaaatactctaaaaactgagacttctattctatttaaaaaaaaaaaaaaaaagagcacatgggaaaaggaactttttaacaaaagtattttgaggcctaatgttcactgccaggttttaaatgcaagaagcctggggagggtggctcatgcctgtaatctcactttggggaggccaaggcggaccacttgaggccaagagtccaatctgggcaacatactgagaccccatctgcacatatacaaaaaaaattagccaggcgtggagtgtgcctgtagttctagctattccagaggctgaggtgaacccagtagcagttcgaggatatagcaagctatgatcacatcactgcactccagccgttataatgagactgtctttattaaaaaataatttttaggccaggcacagtggctgacacgtgtaatactagcactttgagaggccagggcgtgcagatcacgttaaggccaggagttcaagatcggcctggccaacatcacgaaaccccttctctactataactatgaaacgcaactggacttggtggtgcacgtctgtggccccagctactggggaggctgagacaggaggatcgcttgaatcccggagaggttccagtgagccaagatcgtgccactgtactctagcctgggtgacagcaaagatttcctctcccccccgccccaaaaatttatttgtcctctccaatttctagactcacattggaacctattaaaaagacagtagtactatacccatgctttaagtccaaactgggaaccaagcaactgcactaaagaggacaaactaagtagtataatatataaaaataacatacctactaagtgctgtccactaatatgcactggccctgaaccacacttcaaccttaagaccactggtggtgttatttcaaagcccccaagggaaacctagaagggagaaatttttcatcactaaacatgtgaagaaaatgaacaataaacattacaggcaaacacataagccaaatcaacaaaccagtgaacctgtttttccacctctgataaaagtagcagcagaagcccccatgttcaagagttgaccatcgaactccagtgacagaagataaagaaccactttctatctccttggcacaactaaatgacaccaaacctaccttaaaacagaattaaaccttgacacaacatccaaagtatgtaagtgcccttaccgttggctgtacagacattttcaaagttgccagtgttactttaattggactgccttcgtaattcattgcctctgcttcaacaatgtgcaactcatcctttgcaccagcccctaaactgacctgtgaacaaaaaaaaaatactacttcaacttttgagttccacctattttacacccccccactaaatgttatatgcagccatgcgtcacttaaccacagggctaggttctgagaaatgtgttgttagacaatttcatctttgtacaatcataagaatgtgcttatacaaacctagatggtatagcctactacacacacctaggctacaaacctgtacagtgttactgtactgaatactgtaagcaaccgaaacacagtatttgtgcatctaagcataggaaagggccgggcttggtggctcatgcctgtaatcccaacacttaggaggctgaggctgggcagatcatgaggtcatgagtttgagaccagcctgacacatgtacactgccttactaaaccaaatagcagttgtgcc

SEQ ID NO: 2358 - DNA, 645 bp, Homo sapiens
ctactactactaaattttcggtttttttttttttttttttttttaacaactggtcatcaatttattaaaatagttgacttaagcatctgcaatggtgacttccacctcaactcctggctcaatactgatggaagtaatctgcttaacaatctcagaaggactgtgcaagtcaatgagtcgcttgtgaattctcatctggaaacgatcccacgtcttagaaccttcaccacaaggagtttttcttgtagtgattctcaaagtcttggtaggcattcgaactggtcctttcactttgagattcttttcttttgcgcctcttatcaagtcagcacacaccttttccaaggattttacgttgcggcttgttagggtgattcgaattcggtgaattgccacctccggctccacgggtgtttttccggtatccttaaaagccatggctgttgcgcgcgggcttcctgaccgacttgttcctcggcgagagggaacagcggtgagtcaggagcaggagcgtgcggaccaaaaatcctcagcccttacgaccgcgttcgtgccgaatcttgggctcgagggccaagattcctagaggagtcggattaattcggaacatgtcaaagctgttcccgtgtgaaatggtatcgctcc

SEQ ID NO: 2359 - DNA, 578 bp, Homo sapiens
  misc_feature (1)...(578): n = A,T,C or G
ttaacaactggtcatcaatttattaaaatagttgacttaagcatctgcaatggtgacttccacctcaactcctggctcaatactgatggaagtaatctgcttaacaatctcagaaggactgtgcaagtcaatgagtcgcttgtgaattctcatctgggaaacgatcccacgtcttagaaccttcaccacaaggagtttttcttgtagtgattctcaaagtcttggtaggcattcgaactggtcctttcactttgagattcttttcttttgcgcctcttatcaagtcagcacacaccttttccaaggattttacgttgcggcttgttagggtgattccgaattcggtgaattgccacctccggctccacgggtgtttttccggtatccctaaaagccatggctgttgcgcgcgggcttcctgancgacttgttcctcggcgaganggaaacaggggtgaagtcaggagcangagcgtgcggaccaaaatccccgccgaggaaaaccgtgtactattagccatgggcaacccaccggggtcttcgacattgccgtcgacgggaagccctnggggggttct

SEQ ID NO: 2360 - DNA, 548 bp, Homo sapiens
ttttttttaacaactggtcatcaatttattaaaatagttgacttaagcatctgcaatggtgacttccacctcaactcctggctcaatactgatggaagtaatctgcttaacaatctcagaaggactgtgcaagtcaatgagtcgcttgtgaattctcatctggaaacgatcccacgtcttagaaccttcaccacaaggagtttttcttgtagtgattctcaaagtcttggtaggcattcgaactggtcctttcactttgagattcttttcttttgcgcctcttatcaagtcagcacacaccttttccaaggattttacgttgcggcttgttagggtgattcgaattcggtgaattgccacctccggctccacgggtgtttttccggtatccttaaaagccatggctgttgcgcgcgggcttcctgaccgacttgttcctcggcgagacgaacaacggtgagtcaggagcaggaccgtgcgaccaaaaatcctcgcctacgaatcttggcccgaggcaaatccctatatgagcggataaatcggaacag

SEQ ID NO: 2361 - DNA, 500 bp, Homo sapiens
tttttttttaacaactggtcatcaatttattaaaatagttgacttaagcatctgcaatggtgacttccacctcaactcctggctcaatactgatggaagtaatctgcttaacaatctcagaaggactgtgcaagtcaatgagtcgcttgtgaattctcatctggaaacgatcccacgtcttaagaaccttcaccacaaggagtttttctcgtagtgattctcaaagtcttggtaggcattcgaactgggcctttcactttgagattcttttcttttgcgcctcttatcaagtcagcacacaccttttccaaggattttacgttgcggcttgttaggggtgattcgaattcggtgaattgccacctccggcttccccacgggtgtttttccggatatccttaaaagcccatggctgttgcgcgcgggcttcctggcccacttggtcctccgcgagagcgaaccaccgtgatctcggaacaagaaccttgggaccaaaaatc

SEQ ID NO: 2362 - DNA, 441 bp, Homo sapiens
atagcaccttgcagatggttgatcttttacctcatcgcctgttgtattactgatgtaagtaatttgtgtatcaatctcagaaggattgtgtattcaaggagtcgcgtgtgaattctcatctggaaacgatcccacgtcgtagaaccttcaccacaaggagtggctctggcagtgattctcaaagtcttggtaggcattcgaactggtccttgcacgttgagattctgctcgtctgcgcctcttatcaagtcagcacacaccttttccaaggactttacgttgcggctggtcagggtgagtcgaattgcggtgaattgccacctccggctccacgggtggggttccggtatccttaaaagccatggctgttgggcgtcgggctccggaccgagctgttcctcggcagagcaaccaggttggagtcaggagcaggagcgtgcg

SEQ ID NO: 2363 - DNA, 289 bp, Homo sapiens
gcaagtcaatgagtcgcttgtgaattctcatctggaaacgatcccacgtcttagaaccttcaccacaaggagtttttctcgtagtgattcttttcttttgcgcctcttatcaagtcagcacacaccttttccaaggattttacgttgcggcttgttagggtgattcgaattcggtgaattgccacctccggctccacgggtgtttttccggtatccttaaaagccatggctgttgcgcgcgggcttcctgaccgacttgttcctcggcgagagaaacagcgatgagtca

SEQ ID NO: 2364 - DNA, 4496 bp, Homo sapiens
tttttttttttttttttttttttcttcttagataatatatattaaaaaataaacctccaattcagggtataaaaacagagcgaaggcacttgggggtgggggtggaggggtggcccccacaggcaatactgagatggcccgggtcaccgtggtgccctccagaatggagccctgagtcccccaagcagagggcaggagggagagatggccgaggctcatgcggggccagtaaccccagctgggcccctcccaggcgtggcccacagctccctctcctcaggccctcggggtgtgagatgctgcggcagctgtgtgggtgggggtggtccctcacgtcctctcccccattcctctccttcttgcaaaaggccttcctgggcgggaacctcaagtgcagccaggctgggggacagagttccccccaagctgagacaggaggggtctcaggcggcaaaattcctcctccaactcctccagctgcttcatggtctcctccaagctgagcaggttctcctggatttcctgggtccgtgctgggctacaggggccgccccctgggaccccatccccatctcgaggaggccccgccccattgtcttcctccgccggaaacagaagctgcttcagggacagcactttccgaagggccgtggcagcgagctggccctcggggcctggtctgcagaagggcaggaggtcactgaggattctctcggtccgggcatcagctggagacgtctctcggccaccattgccgttctcagagctgctgaggaggggttctcgggtgctgctcgggctgggccggggcttagggcgagaggcaggggcagggactttcagggatccggcagtctcagtgatgagagcacaccagtttttccgctccgacacagtctgtgccaccagctcgtatatctgggcctcctggtcccaggtaaaaaggacgtagaaggctttgtgatcggtggccacctcgcgggtcatggcggaggtgagccgcagcacgggccgcagcatggtcttgccatcgggcgtgggcgtcagtgtccggctatgggacttgagcagcagccgctcgtcctggcgctggagcagcagcagcaggtcgtccagcagcagcacatgcacctccactgccttgtccttagtcacccgccacgtcagtgggccctcgtggaccaatttcttcttggtgatgtccaggttcttgaactcgctcagcatagggtcgctgctctgccgaaggtgggacaagtccaggcgccgctgatagtccttgagcctcagcaggtcctccatgtcacgcacggcttggttgacgtggtgtagaatttcccggcagcactcggctgccagctccactttctcccgttctgtgggctcttctgtgttctgcccgatgctctgcaggagcagggggtacttggtcagccgctgcatctccgtggggatcatgtccttcagctgcaggcggcggctccgcgggcggctctcagcttcctgcacgaaggcacagaaccgagggtccttgcgttgcttggctttgagctgctctaaggcaaatgactggcggctgcagaagcgggaggagattttctggaaccaggagccctcagcaccatcaaaccgggccagcagcacgtctccgatctcctcgatgaggtagccactctcctgcctccgcttcatcaggcgatcgaggaacagggaatgcacctcgatgagctcgtccaggctggggaagatgttctgcagctcctccaaggggaagaacaggcattctgccatgggctggaagaagaggtcgtgcagcacccgcagcatgcgcacgtgggccgcctctgtcaccagcagctcgctgatgacctcctgccgcttcacctggctcttgggcaggctgtgcagggtgtctggggggacgagttcccgccagccgggaggctcttctggttcaagctccagtcccgaccgccccggctccccctcatctccaggctcggggctctcggtttcggccccctcgtcggtactctctgggggcgccaaggactccaggctcattgggcctgcggggatgagtcccccaggctccaggggggcgtcagctggttcccggtctgggctgtccagggacagagggtgcagagagactccaggggtgtcctgcccaggagccccgatattccggtcccgagaggcatccccaccgcctcccttccggtctgtagcacctggcttctcggcatcaacctctgctttgaggtgtcgaaaatctggaacctggggctctccccggttccagcgggcggcatccaggatgctgctcagccccttcttggtcttggcaggctcgtccgaccgccggttccccatcacctttttccggaagaagttcctccccgacttcttgtctccactcttggtccgcaccccaaggtggcgcatgtacaggccaatggcgttgaccacggcagcactcttttcttcgtcggtagagatggtatgttgcatctcctccaggtgcatgagcagccgctccgccacgtgccgctcccgggcctcgtagctggctcggtcccgcccaacccaagcctccagctgggccagctcctgctcccagggcgtcatgcccatgagccgcttggaacggaagtcctccagctgccggcccacggctacctgctggctttgcaccacctcctgcacgaaccgccgctggacatcctcggagatgaggtcagccctagtgcggtcaagttcaaaggcgacgttgggagggaccggcacccggagaaccgctgtcttctccaggaagctgtggtagaagtccaggaaggccttcttggcctccttggggcccagtgagcccagcatgtcggcatgcagacagcaaagcaggggtcctggctcaaactgcagggccacgtgctgcaggagggccatgaggtgggctgggcgccgcttcacctgctccaggctctggaactggctgttttgctcttctgagtttgtctccagctcgttctcaaaatcctcatcctcagccccgatgatgctgactttttttttttttttaagatagaaagattttctttattaatgaccccaaccgtatttctttagatacaggagttttgaactcaaatacttaggagaaaacaagttatgactgcattatcctgcaactcattaccagtaatatattgcaaagcgaaacagcttggaaaagagggtgggagaaaagggaagtgagggagggaagataaagaaaaggaattaagttgatcaagtggaattcttttttttttttttttaattcttgggaactatgaagtctttgcaagcacagctcgtttctgcagattattttccaaacgtgtacaaaatggaaccaaaacggagaatcccttaagaacctgaagaggcgcaacattaaaagctacgattatccagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatacgtgtgtgaatataggccttagagcacttgatgtggtagtgcaggtagtcccggaacgtgtggatcaggttgatggtgttgtctcgagcactggcattggtgtgacgagggaacagcacaaaggtaatgtagccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggcccccgaagcctgaacccgcctgccgagccgccgccgccgccgccactgccgcttcaccgacaagcccggt

SEQ ID NO: 2365 - DNA, 656 bp, Homo sapiens
  misc_feature (1)...(656): n = A,T,C or G
gactataaattttaaacaagctagaagttatctatctgccttgataatattacaaaaatagaacagaacctaattcttgcaacagctatttttgtactgatcaaggaaaagtattctttgctatgtttttggagaactaaagctatttttgtttccattgttttaaagcaagcaagcaagagtcaaaaccttttctaggaaacacaattcattataggaatcaagtcaagagcccctagttaggtgagcaagtagtcatgtgggggtgatttagtgccatggatcttccatgaatggcaaactgccaatgaaaggtgaggaaacaagagtcccaaggaaaatgatgtggatcttacctcattcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcgcggcttgccccatggggaaggagaaacaaagggccggtgagggtgggtaagggaggcanangacggagggaga

SEQ ID NO: 2366 - DNA, 1492 bp, Homo sapiens
gggcccccccccgaggtttttttttttttttttttttttttttttttttttttttttttttttttttttttttaagatagaaagattttctttattaatgaccccaaccgtatttctttagatacaggagttttgaactcaaatacttaggagaaaacaagttatgactgcattatcctgcaactcattaccagtaatatattgcaaagcgaaacagcttggaaaagagggtgggagaaaagggaagtgagggagggaagataaagaaaaggaattaagttgatcaagtggaatttttttttttttttttttaattcttgggaactatgaagtctttgcaagcacagctcgtttctgcagattattttccaaacgtgtacaaaatggaaccaaaacggagaatcccttaagaacctgaagaggcgcaacattaaaagctacgattatccagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatacgtgtgtgaatataggccttagagcacttgatgtggtagtgcaggtagtcccggaacgtgtggatcaggttgatggtgttgtctcgagcactggcattggtgtgacgagggaacagcacaaaggtaatgtagccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctgcccccaggggaaggagaaacaagggccggtgagggtgggtaagggaggcaaggacggagggagagctcgtgcc

SEQ ID NO: 2367 - DNA, 446 bp, Homo sapiens
ataaacctccaattcagggtataaaaacagagcgaaggcacttggaagtaggggtggaggggtggcccccacaggcaatactgagatggcccgggtcaccgtggtgccctccagaatggagccctgagtcccccaagcagagggcagggatcaaacatgcaacagaagagaggagagagtcagaggagtggtgggattttaggggcactggggtagtggggggtcttgggggagggagatgagaaaaggaaagaagaagggagaggaatggccagacccagagagcagcagaggagcatggggagcaagagcctgggacagcgaggcacagatggcagcggtgaccctgcacccacccaccagcgcccagtaagccacacctcccgcccctgcaccccagcctgggcacctctcggtttcggccccctcgtcggtactctctgggg

SEQ ID NO: 2368 - DNA, 3150 bp, Homo sapiens
ataatatatattaaaaaataaaccctccaattcagggtataaaaacagagcgaaggcacttgggggtgggggtggaggggtggcccccacaggcaatactgagatggcccgggtcaccgtggtgccctccagaatggagccctgagtcccccaagcagagggcaggagggagagatggccgaggctcatgcgggggcagtaaccccagctgggcccctcccaggcgtggcccacagctccctctcctcaggccctcggggtgtgagatgctgcggcagctgtgtgggtgggggtggtccctcacgtcctctcccccattcctctccttcttgcaaaaggccttcctgggcgggaacctcaagtgcagccaggctgggggacagagttccccccaagctgagacaggaggggtctcaggcggcaaaattcctcctccaactcctccagctgcttcatggtctcctccaagctgagcaggttctcctggatttcctgggtccgtgctgggctcaggggcccgccccctgggaccccatccccatctcgaggaggccccgccccattgtcttcctccgccggaaacagaagctgcttcagggacagcactttccgaagggccgtggcagcgagctggccctcggggcctggtctgcagaagggcaggaggtcactgaggattctctcggtccgggcatcagctggagacgtctctcggccaccattcccgttctcagagctgctgaggaggggttctcgggtgctgctcggcctgggccggggcttagggcgagaggcaggggcagggactttcagggatccggcagtctcagtgatgagagcacaccagtttttccgctccgacacagtctgtgccaccagctcgtatatctgggcctcctggtcccaggtaaaaaggacgtagaaggctttgtgatcggtggccacctcgcgggtcatggcggaggtgagccgcagcacgggccgcagcatggtcttgccatcgggcgtgggcgtcagtgtccggctatgggacttgagcagcagccgctcgtcctggcgctggagcagcagcagcaggtcgtccagcagcagcacatgcacctccactgccttgtccttagtcacccgccacgtcagtgggccctcgtggaccaatttcttcttggtgatgtccaggttcttgaactcgctcagcatagggtcgctgctctgccgaaggtgggacaagtccaggcgccgctgatagtccttgagcctcagcaggtcctccatgtcacgcacggcttggttgacgtggtgtagaatttcccggcagcactcggctgccagctccactttctcccgttctgtgggctcttctgtgttctgcccgatgctctgcaggagcagggggtacttggtcagccgctgcatctccgtggggatcatgtccttcagctgcaggcggcggcaccgcgggcggctctcagcttcctgcacgaaggcacagaaccgagggtccttgcgttgcttggctttgagctgctctaaggcaaatgactggcggctgcagaagcgggaggagattttctggaaccaggagccctcagcaccatcaaaccgggccagcagcacgtctccgatctcctcgatgaggtagccactctcctgcctccgcttcatcaggcgatcgaggaacagggaatgcacctcgatgagctcgtccaggctggggaagatgttctgcagctcctccaaggggaagaacaggcattctgccatgggctggaagaagaggtcgtgcagcacccgcagcatgcgcacgtgggccgcctctgtcaccagcagctcgctgatgacctcctgccgcttcacctggctcttgggcaggctgtgcagggtgtctggggggacgagttcccgccagccgggaggctcttctggttcaagctccagtcccgaccgccccggctccccctcatctccaggctcggggctctcggtttcggccccctcgtcggtactctctgggggcgccaaggactccaggctcattgggccctgcggggatgagtcccccagctccaggggggcgtcagcacctggttcccggtctgggctgtccagggacagagggtgcagagagactccaggggtgtcctgcccaggagccccgatattccggtcccgagagggcatccccacgcctcccttccggtctgtagcacctggcttctcggcatcaacctctgctttgaggtgtcgaaaatctggaacctggggctctccccggttccagcgggcggcatccaggatgctgctcagccccttcttggtcttgggagggtcgtccgaccgccggttccccatcacctttttccggaagaagttcctccccgacttcttgtctccactcttggtccgcaccccaaggtggcgcatgtacagcccaatggcgttgaccacggcagcactcttttcttcgtcggtagagatggtatgttgcatctcctccaggtgcatgagcagccgctccgccacgtgccgctcccgggcctcgtagctggctcggtcccgcccaacccaagcctccagctgggccagctcctgctcccagggcgtcatgcccatgagccgcttggaacggaagtcctccagctgccggcccacggctacctgctggctttgcaccacctcctgcacgaaccgccgctggacatcctcggagatgaggtcagccctagtgcggtcaagttcaaaggcgacgttgggagggaccggcacccggagaaccgctgtcttctccaggaagctgtggtagaagtccaggaaggccttcttggcctccttggggcccagtgagcccagcatgtcggcatgcagacagcaaagcaggggtcctggctcaaactgcagggccacgtgctgcaggagggccatgaggtgggctgggcgccgcttcacctgctccaggctctggaactggctgttttgctcttctgagtttgtctccagctcgttctcaaaatcctcatcctcagccccgatgatgctgacgggaaccaggccaggccgggaggggcctggggaggccgcccctcgggcgaagtcttccatctccctgggctctgcaaggctggtgtccgcgcggaagtgaccggcggggcgccc

SEQ ID NO: 2369 - DNA, 808 bp, Homo sapiens
  misc_feature (1)...(808): n = A,T,C or G
aattcttgggaactatgaagtctttgcaagcacagctcgtttctgcagattattttccaaacgtgtacaaaatggaaccaaaacggagaatcccttaagaacctgaagaggcgcaacattaaaagctacgattatccagtagcaagtgttccagccttcagttgccagccgcttcctcctcttattcccaagattagcgggatgaaaacgtcttccccgtgattggatnacatttcttttttctcggcatctgggcgtgcgcggctcagcaccttgaggaagtcagacgttttcgcccgcatacgtgtgtgaatataggccttagagcacttgatgtggtagtgcatgtagtcccggaacgtgtggatcaggttgatggtgttgtctcgagcactggcattggtgtgacgagggaacagcacanaggtaatgtagccaatgttgtcacccacagcgtgcgtctgcgcgccttttttaaagntttcncagaaagggagggttcccctggtggcgtaaagaagggccctggtggcggctggagggggctggggtcntgggagggctgtgctttgggaactnncttgggtgagaggcacgctttttccaattgagccagatcggggnnnnncagctagnagnnnnnaggggagagggcgggtgcgaggtctgtccttttttagacttcaacatacatcggnctcatcatgccctataatgggattagctgccctgttctctcctttccttgccttttcttgggaatttggaagaatttttcaaagaccggaggaaaacaattttggtttaa

SEQ ID NO: 2370 - DNA, 513 bp, Homo sapiens
agtggctgatttctgccctatcatctacttcctggcttaagacattttatgagaaaaacattttcacgcaatacagctgaaagtttgaccaagccatatttctttcagtaagtgccatggtggtgtagcagccatatccaggcttcaggaccaaattctacactcacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctcatcagcaccatgtgcctgaagttccttgtagaatttcaaagaaatactgaccatcacttttgttttgtctccattaggatttgaaatatgatagaggaccccatcgaaatctgcaaatgttacttcaaatgcttccggtttgtttccggcggccgc

SEQ ID NO: 2371 - DNA, 589 bp, Homo sapiens
  misc_feature (1)...(589): n = A,T,C or G
ttaattcttgggaactatgaagtctttgcaagcacagctcgtttctgcagattattttccaaacgtgtacaaaatggaaccaaaacggagaatcccttaagaacctgaagaggcgcaacattaaaagctacgattatccagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatacgtgtgtgaatataggccttagagcacttgatgtggtagtgcaggtagtcccggaacgtgtggatcaggttgatggtgttgtctcgagcactggcattgggtgtgacgagggaacagcccaagggaatgtagccaatgttgtcacccacagcggcgtctgtgttttcagctccagaagaggttccctgtggtaaagangactgtgggctgtgtggctggcctggcctcgtgccgaatcttggctcgaggccaattccnatagtgaggcgaattaattcgaaccag

SEQ ID NO: 2372 - DNA, 726 bp, Homo sapiens
ttttaattcttgggaactatgaagtctttgcaagcacagctcgtttctgcagattattttccaaacgtgtacaaaatggaaccaaaacggagaatcccttaagaacctgaagaggcgcaacatcagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatacgtgtgtgaatataggccttagagcacttgatgtggtagtgcaggtagtcccggaacgtgtggatcaggttgatggtgttgtctcgagcactggcattggtgtgacgagggaacagcacaaaggtaatgtagccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggcctctccctccgtccttgcctcccttacccaccctcaccggcccttgtttctcctgtcccctggggcagccgccgccatgatcctgctggaggt

SEQ ID NO: 2373 - DNA, 394 bp, Homo sapiens
catccttggatgccggaagattttcaaggtcatatagcaaagagacattgtatcctgattctggatttaccaagaaactcccgtacaccctctttaataactagaaaataaaaacaaaacaaaaccaaatacgttaatccaaaggccatgataatttcattatttttaaagtactgcacttgccaagctcttcctaagttggcattcttcctaactttcatttggtggatgggaaagtagagacagaggggaagtggatttagtcaccaaacaagtcacaaaactgagatgagtatctttttatgcctgggacagagtgcaatggcgcgatctcggctcaccacaacctccgcctcctgggttcaagtgattctcctgcctgagcctcccaagt

SEQ ID NO: 2374 - DNA, 552 bp, Homo sapiens
  misc_feature (1)...(552): n = A,T,C or G
ttaattcttgggaactatgaagtctttgcaagcacagctcgtttctgcagattattttccaaacgtgtacaaaatggaaccaaaacggagaatcccttaagaacctgaagaggcgcaacattaaaagctacgattatccagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatacgtgtgtgaatataggcctgggaacaaacataacaggtactaaagcacagtcatggtctagaaagacagctttgctgcttttcatcagagagggtcatcagggcggttgggaacatacaccctgggattgacccaggccctgcaggaagcaggaaggtgagcnattctgggaaacaatattcaactctgccatagggangggatgggggacantggctttgatgaagaaagaccatgggttctttgaa

SEQ ID NO: 2375 - DNA, 492 bp, Homo sapiens
  misc_feature (1)...(492): n = A,T,C or G
aaggtaatgtagccaatgtggtcaccccacngcggcgtctgtgtctttncaggctccagaggaggtccctgtggctaaagaggacctgtggggctgtgtggctggctctgcgtccttcttngaactcctgcatgaacacctttcccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctcatcanaccatgtgcctgaagttccttgtagaatttcaaagaaatactgaccatcacttttgttttgtctccattaggatt

SEQ ID NO: 2376 - DNA, 368 bp, Homo sapiens
  misc_feature (1)...(368): n = A,T,C or G
aaaannntttgatctgacgatcagcgattagttctcatncnnnnnnnngnnnnnannactggagtgtctcacccatgggccccacgcagggacacgcncaacattaaaagctacgattatccagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatacgtgtgtgaatataggccttagagcacttgatgtggtagtgcaggtagtcccggaacgtgtggatcaggttgatggtgttg

SEQ ID NO: 2377 - DNA, 357 bp, Homo sapiens
  misc_feature (1)...(357): n = A,T,C or G
agatagaaagattttctttattaatgaccccaaccgtatttctttagatacaggagttttgaactcaaatacttaggagaaaacaagttatgactgcattatcctgcaactcattaccngtaatatattgcaaagcgnaacagcttggnaaagagggtgggagaaaagggaagtgagggaggggnaggataaaggnaagggatttagttgatccngtgggnattcttttttttttttttttaattcttgggggnccatgnaggcttttgccagccccgctccgtttctgccggntttttttttcccaccgggttccaaattgggggcccccacnggggggaatccccttnggacccc

SEQ ID NO: 2378 - DNA, 217 bp, Homo sapiens
  misc_feature (1)...(217): n = A,T,C or G
ggctcatgcggggccagtaaccccagctgggccccttcccaggcgtggcccacagctccctctcctcaggccctcggggtntnagatgctgcggcagctgtgtgggtgggggtggtccctnacgtcctctcccccattcctctccttcttgcaaaaggcctgggggatgtaggagaagagggganacggggaaagatgganaaananacagggagag

SEQ ID NO: 2379 - DNA, 2313 bp, Homo sapiens
ggggtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatatgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgcctgtccccttaaaaaaaaaaaa

SEQ ID NO: 2380 - DNA, 2052 bp, Homo sapiens
ggggtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccagtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatatgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacatcactatttattttgttttggaactgggacatgattctatttgttataaaataaaattgatgtccc

SEQ ID NO: 2381 - DNA, 652 bp, Homo sapiens; identical to SEQ ID NO: 1423
  misc_feature (1)...(652): n = A,T,C or G

SEQ ID NO: 2382 - DNA, 587 bp, Homo sapiens
agtacatgcccagccggatcatcgtgtaccgcgatgggtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccagaaatgacataaagagcctactacatcaaaacacctgtgcagtgaaggacacagcagagtgatgagtacctgtggaatgggagaaaatgtctgcaagtcatctatctgctaaggggttaatatccagaacatataaagaacatcaaaaaacccaattaaagacatttctccaaaaatgagattcaggtgg

SEQ ID NO: 2383 - DNA, 924 bp, Homo sapiens
  misc_feature (1)...(924): n = A,T,C or G
aaaaagaactaactatcnaaaaaaacaacagaaagataaaangtgttggccaaaggaacgtgcaaaaaaatggaaacccttaattccactgttggtgggagtgtaaaattagtaacagtccttaatgaaaaaacagaatgaaagggcaaccccctttgtgtcccctcccattttatgggagctctgttttcactctattaaatcttgcaactgcacactcttctggtctgtgttttttatggctcgagctgagctttcactcgccgtccaccactgtttgccgtcattgcagacccgcagctgacttccaaccctctggatctggcaggggtggatctgctgcacttgtgatccagcgaggcagtgtccattgctgctcccaatcgggctagaggcttgccattgttcctgcgcgggctaagtgcctggggttcatcctaattgggctgaatagagctataacactcaatgcatggcccaagattccattccttagtatccgtgaggccaagaaccccaggtcagagaacaagaggcttgccgccatcatggaagcggcccaccatcatctttggagctctaagaacaaggactccctggtaatattttggcaatcatgaagggacccccaaagtgctttcgcttgctattctgttctacccttccttagaattggaggaaaataccaggcacctgtcggacggttaaaaacgatagggcggccaccagacttaagactcaagtgtgaggctgtctggggaatggctttctaacaacccccaacgcttctgggttggaagcgctggtctacctggaaccagcttccactttcaatttccctggggaagctgggggccgactagaggcagaaagctgtcatcccaaactctcggcattagccggttgagatcatgcgcagccaga

SEQ ID NO: 2384 - DNA, 361 bp, Homo sapiens
  misc_feature (1)...(361): n = A,T,C or G
tcaaatcatatatcgccttagagcacagggggagggacaatgattgggatataaacccaggcattccagcagggagcagcaacccccttagggtccctcccattgtatgggagctctgttttcactctattaaatcttgcaactgcacactcttctggtccgcgtttgttacagctcgagctgagctttcgctcgccgtccaccactgttgtttgccactgtcgcagactcgccactgacttccacccctccagatcaggggagggtnttgggctgtgcttctaacccaggcgaggggcccattgccactcctgataggggctangagggcctgccatttgttccccgcatgggctaaggg

SEQ ID NO: 2385 - DNA, 676 bp, Homo sapiens
tcagcttgttccagcctcctgcctgcccctctgtggctgacagtcgactcccctggagtcactgccctgagtctcaagggtacttctctgcaagctccaggccaccaatgccaccagaaatctctgaagtcgctccagtggcttaaccgcatcacaaagtcaccagactggataaagttattccgctgacctaaagcctgtcagatgtgctggcccctccccgacagggtgcaccggggcaagctggccaaggctccttcaccagccacccccgaagtcactgctgacccacctaccgcatctcaacacggggccgggcaagctcgcaccacggggctcctgccttagggctgcacccctgcctcagagcttcccgttcctctcgcaacaccagctgaacgcctctacttccacagaacctccctcccgcggggggagcccactgctgctccacgaggttcctggctaagggcctgctctggcctttgcttctgtctgctttttaattacactgactttgtatttttacgtgcctgtctgtcctgtgacatcaaagtcttgctccaagaacataacaaagtaactgaaatcgagtgagtgaagtattgcctggtagagattctcaaggaatctgctttgacaaattaataaatgaatttcactggtaaaaaaaaaa

SEQ ID NO: 2386 - DNA, 555 bp, Homo sapiens
cacaaaccctggggcagcaggcaggctcgggctgtggttgtgttctggggtgtgagaagggatgaggtactgctgcctctgggaagctcccagcttgttccagcctcctgcctgcccctctgtggctgacagtcgactcccctggagtcactgccctgagtctcaagggtacttctctgcaagctccaggtatgctgccttaccctgacctatagacagtacctctccccgggtttctagagcagtaaccattttcctcctctacttattacattcctttgattatcccagtgagagtatgcgggtggccgggaagggtgagagctggatcacttgtgctcaggtaacctactcgaatgagaggcccaaagacacatatagtgaattgcctagttagcggttcatccacatggatttggttttgctgaatgatcaccattctcatacaacaaggcatctttatgcaaaggacggtcctcttatcaccccagcccactttctcaatcttttgtctccactctgcctttccttctgacccaagagctgtcgccttgc

SEQ ID NO: 2387 - DNA, 276 bp, Homo sapiens
tgagaagtggtcacgagggccattattggatggtgaggtccgacagactcagaggggccttgtaggctggcagaccatggtacagggagctgctgcctgctggctgccattggagctcaggacaagcagagaaggagagacttgatatcggggtctcctcgtggctacaggaaggctcacctttccagccttggccatcagggtcatagacaagcgtgagcactgccagggctaagagactctaaaactcccagaccaggacttcacctacgccag

SEQ ID NO: 2388 - DNA, 502 bp, Homo sapiens
  misc_feature (1)...(502): n = A,T,C or G
attctactattactactactcnanaattctgaatcctccccatctacctgtctgtccatccatccacccatgcatccacccatctacccgtccatccatccacccatgcatccatcatccacccatctgtccatccaaccacccatgcatctatccatccacccacccacccgtctgtccatccatccacctgtctgtccatctatccacccatgcacccattcatctacctgtttgtccatccatccacccatgcatccatccatccacccatctgaatcacaatagaagaaggtggagcagcgtactggagtgtcccgcactgggcgggcagtaccctgctccctgacactgtgctgactcagggaacacttggtctctcccaaacattgcctgagtccctgtttactgtgtctgcctgtgctaggtaggcaaggataaaagacagccccgcccactggatgcttacagtctactgaagagagacacagaaacaagcaac

SEQ ID NO: 2389 - DNA, 285 bp, Homo sapiens
caccctccttgcaccctccagcaaccctccttgtacccctccagcacaccctccttgcacccctccagcacaccctccttgcaccctccagcaaccctccttgcacacctctagcacaccctccttgcacacctccagcagctgtgggagagctccctttccctggctgctcctgctgtctgggacgctccccagggctctcccatctctttctttgcagatggcaattttcccgaggcagcccctgctcaggttgaccccggaactgggtcacttcctttcccc

SEQ ID NO: 2390 - DNA, 519 bp, Homo sapiens; identical to SEQ ID NO: 1589

SEQ ID NO: 2391 - DNA, 4635 bp, Homo sapiens
ttttgagcagtctcctggctttcttacctttcgaaaggagggctgagatgccaaaaggttaaggaccattgtcttcagtgtttaccacataaattgcaaataggacattgagactttgttaagagaagtagattcacctgtttaacaaatactacactctgaaacaaaagaaatgcagttataaccagtgaagtactctattatcttccctaaacaaaagtactagcgcgtgtaaagagcaaaactgcctactccacagcagatcacagcagaccttcaaggagaaagctaaaaagcctcttgaaaattaacccccagttcccccttttcaagaacttgaatcttgtgctcattctgaaagtttccatcgcggtggaggagcataataggcacttaaagaaactgggtattgtattgggatgaggagtggaaaggactatagaattgtttaacagaacaacatgataaagacttgggttgcatcaaatcatctcacagagatcaggacacacgtgatctgcatctgggaggtggcataagacaggccaattctggagcagctgagaagagaatgtggcccaggagtgtttctggatccctggaataccaccaggaggtagaataccatccttctatcttggccccagagtgtaggtgacaatacctttggactggcaagttccctagaggacaagaaaatgacttctttagagcaaggattcttgacaccttttgggacccatcatgttccattttttttaaacactaaaagaaagattgctttccccgccaaataacagcatgaacattatcttaaaaggctaaaagacattaatttctatgaagccaggcacgagacactttgggtgtcacaataagaatgacaatacgttctgatgttgagcacagaaggagggtgcatcagtgaaaattatgacagacagcatgacggtgctgagaggcaagctacggatccaagcccgcgactgctcagccaggatctctgttccctatgggagcagtgaatcacctgaactttgggtcaatggaagaagtaaaatgcataacaccctaatcctaagacacaagtcctgaccccctaaaccaaggttttcagcactttgctaaaaacacgaacaagctctaagcctggcaaagatggcaatacatacccaggttgtggaagacactgcagaggtggccactggtcacgctgggcagttgagctgctgagagtgccctgcccagccagaaatggtctttaatactcttcccctctttctttcagtttcccttctgaaaaaagatgcttttgtctttcgttctccccaccctgcattcagctaagggtttcttataaatcacccagattctcagaaacacttgagctcttgaccaaccttcttgatgagactgtccaatcaggggtgggttgcctggggggccaggttgagaccaatgaaaccctcttgagaatcgagccattagctggtcattgcatcagccacccctcaccccccgctggcctccaaataacctccccaccctcttcccgttccccaccctcagcgtcagtgtgactgattttgtgtagtcgtgggcggtggaaagggaaactgtaaattccccgcatctgttcaccgaggcggcacagtgcagtggaaagatcaggagttctggggtcacagacgcctgggtttcaatcccagcttggacttattcgaaaccttgggcaagggtcgcattacttttctgcttccccttcggtttcctcatctgtggaatgggcatggagaagcctgctaacattaccgttgaggggactaagtgcaacactacgcaaagcctctggcacatggcaggcgctaaataaaaatgggggcctctctcctcgggaaaagcgaacaggcggagacgatgaagggtgccagtgggaaagggagacggggtgggtcggcggcgctcagaggaaaggggcgaggggtcggtggcaggctccgcgcctcacagtgccagaacgcggcgggcagcaagccgggctctaaggatactcccgggagggccaggccactgggcgccgcgccagcgtccctccatcactccctcccttgtttcctcactccgccccggccttactcccctcgcttaccctgcccagccgggccagtcagcgctcccggctcagcaaccggctgtctcctgggcgtccgtggaaacgccgtccggacggaacaacttccggcccgacggcgccgtcattggctgttcgcgcgggggcggggcagaggccgccactgattggtggcggcgcggcgtcgcgtcggaacgcgactggatggtagtgtgctggccggtctgcctccgggagaaccgagcgctcccggtgcgtgtggtgagcggcgggccccgggctggaggggccgggactgggaagcgcctaaagcgccccgtgccgcttaacgcggtctctcatagccgttcgcctccctttcacttcctgttccttcagaaagcgctgtgccttggaccaaccttacttcttactattgacagctcagctaactcctattcatcctccaaaacccatctctggtcgtatcttgttggtggctttcatcgctctggggcctccggggggatctgtgttttgtgtttgatttccacccacaccagacccagcatagggcttgacaaagagtacgtaatcaggaaatgtttgttgaatgggaatatcctatttcttttacttcctagcatctccccctcccacccgtttgcattccagaaatatttttagacgctgggcattgactagtgaacaaaacacagaaagtcctgtcctcatggggctgacttgctgatagtgactgtcagagtcactcgctccttccttagagtcttctccagtgtccctgccttcccttccatctgactgtctgttcctcttcgattaatccctcatctccttccagagggagcacgggcaccctggtggtgggaatctgggtgcatggtgggtggtgcctggacagaggagttgagagtggcctcgggaccaggcttaggatttagagaacagaaatgccaaattatttgcagtgcacggttccattagtttataattagtctttcatattatattagttccattggagatgagctggctggctggctttagaagatgttgttgttgttgttgttgttttttgagaccaagtctcgctctgtagcccaggctggagtgcagtggcgtgatctccactcaccgcaacctccgcctcccgggttcaagcaattctgcggcctcagcctccagagtagctgggattacaggcgcgcaccactgcacacggctaaatttttttttttttgtatttttagtagagacggggtttcaccatgttggccaggctggtcttgaacccccgacctcaggtaatacgcccttctcggcctcctacagtgctaggattacaggcgtgagccaccgcgcccggtcgttttatttaaactctggctttgcgtgtggaagttgttacctgcctggaatgggctgcgaacgggggcggcattactagaggaggctgactacagacatttatggaatgatgacctgacttgtagaccagtggaaccctcaggcgaatgatgccacttggggaaaggtgtggaagaggttgggtggttgattccaggggacatagaaacccattgtctagaagaagagatgggtaatagcctgtctggaatgactaagaaaaggacttggagggaatctgttgatgctgacctgactccacctgttgggggatggaggcggagcttggcgtgtttgattaaggttgggtgcactgggttttcttggaagtcggtctattgcctgagcgttctgtgctgttccaccgcgccctctgctgtcttaggagtgcctagcacccttctttttctctggattgtgcttggtgctaacagcacagaagtaaaaaattaccaaagcacttctttctgggaactaattgataaccatgtattgtgtatgatggttcagaatttcagaaagatttttttttgagacgaagtttcactcttgtcgcccaggctggggtgcaatggcgcgatcttggctcactgcaacctctgcctcctgggtttaaatgattctcctgcctcagcctcccgagtagctgggattacaggcgtgtgccaccacgcccggctaatttttgtattttagtagagacagggtttcaccatgttggccaggctggtctcgaactcgacctcaggtgatccgcccacctcggcctcccaaagtgctgggattacaggcatgagccactatgccctgcccagaaagattttttttaacaagtagaaattcattgcagtgtgaatctgtgtgttgggagtgaaatgggtggatttggatcatgccctcagaattgctccctgcacacttgggtagacggacacctcaggaccttagccttgtgctgtgggcctgtctgtccagctggctgctacagagatgggatacctgggggaagaatgttccaggcagagagaaaagagggaagggctggagcacagggaacgggtgcaggggaaagtggcaggcctttcccaccatggatc

SEQ ID NO: 2392 - DNA, 3002 bp, Homo sapiens
gaggcagtttttcccgcaggtgaacacacagtacgcacttttgcgaccacagcttgccgcgagaagacagcgtgaatgccgacaacccataaaggctcccatcgcggattagaagacgcggtccataccacgaaccgatccaagcatagtgaccatagtccatcgacttatacccgcatgcaactaatacccccaaaggatacttcggcctattttttttttttttttttttttcaggagccaaggaagtttatttactctactgggtgacaggagggcagagtgctccagaggagacccagatacatcaaccaaggacttccctgagatttggctttgctcttccaggcctgcacatgctgcgtgatgaaatgaggcctgcctagacatctgtgagggcctcgagggctgctgcctcgactttctccctagctaagtccacccgtccagggacacagccagggcactgctctgtgctgacttccactgcagccaagggtcaaaatgaagcatctgcggaggccaggactccttggcatcggacacagtcaggggaaaagccaccctgactctgcaggacagagggtctagggtcatttggcaggagaacactggtgtgccaagggaagcgagcatgatttctggagtggactacatgcatggtctggagttcagtaaactggaaagtttcacccccaagtcttaatttaatcaaaattgctgaactctgttcaatcttcattgttaaaagcagctttaaagctgggtgatttcttagtcaaatgtataacgaagcttttacttatcaatttctttttgggagggggcatgggctgaaatacatcttgtgctcaataaacctccccacatcaatatttcaaagcactttctaggttacaataatgacatttcaattccatatacgcatacatagaatatatatttttaaacagagtgggtcttaagagtatacttggaaccctcggagtcctccatggacaagaacagggtggcccatggacttccagccaaaggctccactgtggggctgctttggggagagactcacagctggacttctctatccgaccatgcaatgttagccagcaccaattacccacaatgctttgcccataagagatagaaataatggaactcacaggaagaaacagtattgataacatacacaggcttacagaggccaggcccagtaattaccatgagacagaagcctacaggtggcggtgctttgactgggctgggattattgatacattactgatacatcacttcttttataagcatatgtaaaacgagtgctactgaaagtcgaaggacagcttccggggagtcatgaactctttcactatctcatccgtgacctccttgcgccgggcctggtgctctgcgatcaagggctgcagaacctctatgagtgccttcttgagctcaccggtgagcatggctccgctggtgtaatccttcctgatctgctcgagcttgtcgtcgtcctcgaggaagaaggtcaggtacatgaaagacacgtccacatcacagttgcccccaaactgcctgtgctcctcgatggtgtctctccctccagaaaacgcatgcttattgaccttggttttgatctgcttggccgtgtcggtgaggaagatggaggagttggggtcgctggcactcattttggtctgggcgccctgcagggctgggaagaaggtggagtgcaacagggctggtttaggatagccgatcctgggggcgacgtcccttgtcattctaaagtaaggatcctggtcaatggcacatgggataaggcactggatatccgtcctgtctcggaagatctgtgggaatgagttgctgaaggagggagcagcctggatggcaggaaaactgatcttcccaatgcagtcgctgtcagtgaagccgaaaatgcctttcacttggttgaaggtaacatgcttttgaatcttcaccacatttttgtagaaacctgagctcatccccatgtagtccaggtcagagaatatgaaagtcttgttgatgtcaaagccacaggcgatgatgtccttggcattctccacagcatagctataggcctggtccagggtcaggtccttccacagatacttctcgtcatccgtcatctggatgaccaagggcacgttaaatacatcctggagccactttgtgaaaataaatggaatgaggtgacctacatgcattgcttcagaagaggggccccggcccgtgtacagataaaatggcttcttattttcataggcatcaagaacctgattcatatctctgtgtgagaagaagatgcctctgcgcaggaagtggtgtggtctttggccggtggctctctctattcggtttattagctctttgtcaattttactacttccaaaccgaacaatgagcttatcgtagtctatgccttttgcactgcttgtctgtactgtccatgggtccacaaaatcctcttcagcttctgtggcatctgggccatgattactggtaggtgctgggttccctggaggacagtcagccttgtaatcctcccccgcggcagctttgtagctcatttttaatgacaccaacatctttactgcagaatcaatttcatcctttgacgcatttcccgctttgagggaccttacgagctccccttgtgtggcgatgctgttgaacagctccagcagagatgcgggctcactgttgggcatgtttgctatctctcaggaactacgttcacagccggcctgaggtcagaggatttgttcagcagacgagtcaagaccaggttgtggaagacactgcagaggtggccactggtcacgctgggcagttgagctgctgagagtgccctgcccagccagaaatggtctttaatactcttcccctcttttttcgagtttcccttctgaaaaaagatgcttttgtctttcgttctccccaccctgcattcagctaagggtttcttctcctccgct

SEQ ID NO: 2393 - DNA, 2130 bp, Homo sapiens
gaaagggggcggggttaaaactctcagatctcattccgcctccctctgtcgtcgccccttcccaattctcgcgagacctcaaggagcacagcttctgcgcaccgcacgatactgggagtccaggcgccaagggagggggaacgcgtccggggaaacggtgcaaacggcgtggccgccatcttgcttgtgcccccgcttcgcgcgcgctccgtgacgcacacttcccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataaaaaaaaaaaaaaaaaactcgag

SEQ ID NO: 2394 - DNA, 1861 bp, Homo sapiens
ttaagagtatacttggaaccctcggagtcctccatggacaagaacagggtggcccatggacttccagccaaaggccactgtggggctgctttggggagagactcacagctggacttctctatccgaccatgcaatgttagccagcaccaattacccacaatgctttgcccataagagatagaaataatggaactcacaggaagaaacagtattgataacatacacaggcttacagaggccaggcccagtaattaccatgagacagaagcctacaggtggcggtgctttgactgggctgggattattgatacattactgatacatcacttcttttataaagcatatgtaaaacgagtgctactgaaagtcgaaggacagcttccggggagtcatgaactctttcactatctcatccgtgacctccttgcgccgggcctggtgctctgcgatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgctgcgggccaggacctcgcccagcccatgttcatccagtcagccaaccagccctccgacggcaggccccccaggtgaccggcgactgagggcctgagctggcaaggccaaggacacccaacacaatttttgccatacagccccaggcaatggcacagccttcctccccagaggacccggccgacctcagcgcctcctgcaggctaggacactggtgcactacacccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttaga

SEQ ID NO: 2395 - DNA, 1516 bp, Homo sapiens
ctctgctcttcctggactcctgagccagagacgaggtctcgctctgttgccaaggctggtgtgccaggctggagtgccgtggactgatcatgactcactgcagcctccacctcctgggcctcaagcaatcctcctacttcagcctcctgagtagctgggactacagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatggcacagccttcctccccagaggacccggccgacctcagcgcctcctgcaggctaggacactggtgcactacaccccatgcctggggccgagattctccagcagaaagatgcaatattttttgtttcctttttttccatttttttctctaaggaatcaatatttcaatatgttgagtgtgtgtccaatgctatgaaattaaaatattaaaaaaaaaaaaaaaaaaaaaaaaaaaaaaaaaaaaaaaaaaaaaaaaaaaaaaaaaaaaaaaaa

SEQ ID NO: 2396 - DNA, 1717 bp, Homo sapiens
gatgctgctaaggctctcccagcacaagcccattcctgggagctgtggcacaacaccatggggttcctgggactgtgcgctttcatccccaaattttgactccagcagactcaaggtcatccacagaagggtgaggggaggggtctctgctccctcctcagacctcccagacagagcacaatgacaagagcaggagccaaggaagtttatttactctactgggtgacaggagggcagagtgctccagaggagacccagatacatcaaccaaggacttccctgagatttggctttgctcttccaggcctgcacatgctgcgtgatgaaatgaggcctgcctagacatctgtgagggcctcgagggctgctgctcgactttctccctagctaagtccacccgtccagggacacagccagggcactgctctgtgctgacttccactgcagccaagggtcaaaatgaagcatctgcggaggccaggactccttggcatcggacacagtcaggggaaaagccaccctgactctgcaggacagagggtctagggtcatttggcaggagaacactggtgtgccaagggaagcgagcatgatttctggagtggactacatgcatggtctggagttcagtaaactggaaagtttcacccccaagtcttaatttaatcaaaattgctgaactctgttcaatcttcattgttaaaagcagctttaaagctgggtgatttcttagtcaaatgtataacgaagcttttacttatcaatttctttttgggagggggcatgggctgaaatacatcttgtgctcaataaacctccccacatcaatatttcaaagcactttctaggttacaataatgacatttcaattccatatacgcatacatagaatatatatttttaaacagagtgggtcttaagagtatacttggaaccctcggagtcctccatggacaagaacagggtggcccatggacttccagccaaaggctccactgtggggctgctttggggagagactcacagctggacttctctatccgaccatgcaatgttagccagcaccaattacccacaatgctttgcccataagagatagaaataatggaactcacaggaagaaacagtattgataacatacacaggcttacagaggccaggcccagtaattaccatgagacagaagcctacaggtggcggtgctttgactgggctgggattattgatacattactgatacatcacttcttttataagcatatgtaaaacgagtgctactgaaagtcgaaggacagcttccggggagtcatgaactctttcactatctcatccgtgacctccttgcgccgggcctggtgctctgcgatcaagggctgcagaacctctatgagtgccttcttgagctcaccggtgagcatggctccgctggtgtaatcctgcccggaggaggacagccacgtgagagatggctccacatgtcctgagcggctccttcctgcctcgggcaccagctcagccctcaccacccatgcagagcctggcacgtgggtggcactcagaagtgagatctgttgttaccacaacaataacctataccttgagctacacttttcctaaaacggctagaaacctgggctctgacgatagccatgacttggcctctcacagtgaaagggccaatggggagggcagtgcccacccctaccgatgctagggg

SEQ ID NO: 2397 - DNA, 1055 bp, Homo sapiens
  misc_feature (1)...(1055): n = A,T,C or G
ttctagaggaacacaaccctacagacttgggaggctcagctgccttcgtggagaacccagnaaaatcatgtacctttgacgcatttcccgctttgagggaccttacgagctccccttgtgtggcgatgctgttgaacagctccagcagagatgcgggctcactgttgggcatgtttgctatctctcaggaactacgttcacagccggcctgaggtcagaggatttgttcagcagacgagtcaagactggggtgggggcggggaaggagagagaggaaaaaccagaggttaacacaacatcgcggctgtttttcctttcctgtattgagtccttttttccggaaaggttgtgaggtgagttacagtaaaggacatagataatataataaaaagagaaccagaaatttggggccatgaagaagaggaaaaccatcaaatgccagtgatgaagactaaaggagtggctaggatttactgacttaaggtgtgaatctacttgactaggaggggccctcctagtcaagatcaagtttccatctggtcgatgcccctgtgcccccacccagtgcccagaacacaggaggactcctgtttgctcagggtataaataccaatgtgttttaatgaacctaagttcattgctaaaaacttttggcaaattactatttgattttttttttttttgagatggagtctcgctctgccacccaggctggagtgcaatggtgtgatcttggctcactgcaacctccacctctggggttcaagcgattcttctgtctcagcctcctgaggctgcctgccaccatgcccagcgaatttttgtatttttagtagagggagggtttcaccatgttggccaggctggtcttgaacttctgacctcaggtgatcctctgttgggattataggtgtgagccaaggcacccatcctctatttgtggtttatcttaattgccttggggatgaattcttgggcttttgtagccataactaatatatcgctgaggaaatgtcttccactgctggtcagctgctctaagacaaagtgagctc

SEQ ID NO: 2398 - DNA, 850 bp, Homo sapiens
  misc_feature (1)...(850): n = A,T,C or G
ttcagaatgaaatattttggtttattaaatggctgattaaaagaactagactgaggaaactgtgtaaccactgagtcttttctctgtgaggaaaaggtgcgttgaaaaggaggaagacataactctggaagactgactatccttggcaagaaactgcaaggcaggacttcctggcacagctgaggatgaagatctgagatgccatcatgctgtggctgagcccatattttaaatttcccatgtagtccaggtcagagaatatgaaagtcttgttgatgtcaaagccacaggcgatgatgtccttggcattctccacagcatagctataggcctggtccagggtcaggtccttccacagatacttctcgtcatccgtcatctggatgaccaagggcacgttaaatacatcctggagccactttgtgaaaataaatggaatgaggtgacctacatgcattgcttcagaagaggggccccggcccgtgtacagataaaatggcttcttattttcataggcatcaagaacctgattcatatctctgtgtgagaagaagatgcctctgcgcaggaagtggtgtggtctttggccggggctctctctattcggntttttgccccttgctcaattttactacttccaaacccgacaatgagcttatcgtagtctatgccttttgcactgcttgtctgtactgtccatgggtccacaaatccctctcagcttctgtggcatnctggccatgattacttgtagttgctggggtccctgaagacagtcagccttggtatcctcccccgcnggcgctttgtagctatttttaatgacaccacatctttactgcagaatcaa

SEQ ID NO: 2399 - DNA, 657 bp, Homo sapiens
agctcatagcatttttttttcctttttgagatggagtctcgctctgttgcccaggctggagtgcaatggcgtgatctcaactcactgtaacctccacctcctgggttcaagcgattctcctgcttcagccacctgagtagctgggcttataggtgcgtgccaccacacccaactaatttttgtattttcaatagagatggggtttcaccatgttggtcaggctggtcttgaactcctgacctcgtgacccgcccacctcggcctcccaaagtgctgggattacaggagtgaccgaccatggctggccactcatagcatttaataaaggaagaagaacatttactaggccttaagaccatttcagttgtttcgaatttagctgtggtcatgacaacttgacatcctcctctacctattgaaaaggcagccagacgttttctccttaccccatgtagtccaggtcagagaatatgaaagtcttgttgatgtcaaagccacaggcgatgatgtccttggcattctccacagcatagctataggcctggtccagggtcaggtccttccacagatacttctcgtcatccgtcatctggatgaccaagggcacgttaaatacatcctggagccacctaaagaaacacgggggcgcagctgccg

SEQ ID NO: 2400 - DNA, 523 bp, Homo sapiens
ttcaagctcgcaccaaggagatccacaaggataggcagggtggtggaggtcactgggcagcgcctccggatcccccgaaagggggcggggtcaaaactcagatctcgagctcccgaaagggggcggggttaaaactctcagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagaggtgtgtgagtgtgcgggagtttctgtgcgagggtgataggcaagcggcggcggggggaggggcagcgcttcccgccttcgccagag

SEQ ID NO: 2401 - DNA, 523 bp, Homo sapiens
ttatttactctactgggtgacaggagggcagagtgctccagagggaacccagatacatcaaccaaggacttccctgagatttggctttgctcttccacagatacttctcgtcatccgtcatctggatgaccaagggcacgttaaatacatcctggagccactttgtgaaaataaatggaatgaggtgacctacatgcattgcttcagaagaggggccccggcgctagtacagataaaatggcttcttattttcataggcatcaagaacctgattcatatctctgtgtgagaagaagatgcctctgcgcaggaagtggtgtggtctttggccggtggtctctctattcggtttattagctctttgtcaattttactacttccaaaccgaacaatgagcttatcgtagtctatgcgttttgcactgcttgtctgtactgtccatgggtccacaaatcgtcttcagcttctgatggatctgggccatgattactggtaggtggtgggttccgtggaggacagtagc

SEQ ID NO: 2402 - DNA, 912 bp, Homo sapiens
aggccaggactccttggcatcggacacagtcaggggaaaagccaccctgactctgcaggacagagggtctagggtcatttggcaggagaacactggtgtgccaagggaagcgagcatgatttgatctgcttggccgtgtcggtgaggaagatggaggagttggggtcgctggcactcattttggtctgggcccctgcagggctgggaagaaggtggagtgcagcagggctggtttaggatagccgatcctgggggcgacgtcccttgtcattctaaagtaaggatcctggtcaatggcacatgggataaggcactggatatccgtcctgtctcggaagatctgtgggaatgagttgctgaaggagggagcagcctggatggcaggaaaactgatcttcccaatgcagtcgctgtcagtgaagccgaaattgcctttcacttggttgaagttaacatgcttttgaatcttcaccacatttttgtagaaacctgagctcatccccatgtagtccaggtcagagaatatgaaagtcttgttgatgtcaaagccacaggcgatgatgtccttggcattctccacagcatagctataggcctggtccagggtcaggtccttccacagatacttctcgtcatccgtcatctggatgaccaagggcacgttaaatacatcctggagccacctaaagaaacacagggggagaaagctgacgtctcatctcccctgtggaggaacgccatcgtgcatctgaaaacacagctcctacttacaacgtatgttaaaacttccttgcctacaaaatcacaatttgaattgtgatatgaatttgactatggataatgataaggtctactaccatttatcgaccaggtggaactgtgtgctctgtgttagctgctctacagtcgacc

SEQ ID NO: 2403 - DNA, 561 bp, Homo sapiens
  misc_feature (1)...(561): n = A,T,C or G
aagcttcactgaatntatcattaattcaaaatttaaaaacatcaatggaatcaactcaatgggaccacttctaaaagttgcagctttttctgggaagaaagcagaggacgtaccaatgagcttatcgtagtctatgccttttgcaactgcttgtctgtaactgtcccatgggtcccaacaaaaccctccttcaagcttctgtggcatctgggccatgattactggtaggtgctgggttccctggaggacagtcagccttgtaatcctcccccgcggcagctttgtagctcatttttaatgacaccaacatctttactgcagaatcaatttcatcctttgacgcatttcccgctttgagggaccttacgagctccccttgtgtggcgatgctgttgaacagctccagcagagatgcgggctcactgttgggcatgtttgctatctctcaggaactacgttcacagccggcctgaggtcagaggatttgttcagcagacgagtcaagacnctccagccgggccagtcagcgctcccggctcagcaacgggctgtctncctgng

SEQ ID NO: 2404 - DNA, 920 bp, Homo sapiens
  misc_feature (1)...(920): n = A,T,C or G
cntctacagagaaatgatatcttctgtgtgaatccagcgcttgttatcttctgtgtgaatccaggctcgaagagtcaactctgtgataaaaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccacccgctgtccaagtccagggccagcagcaaaggccaagcaagaccaccaagctccacgaccaccatccagcctgggcagatcatcatcgcacagcctcagcagggcagaccacacctgtgacaatgcaggttggagaaggtcagcaggtgcagattgtccaggctcagcacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggactcaagttgtgcagggacagatccagacacttgccaccaatgctcaacagattacacagacagaggtccagcaaggacagcaagcagttcagccagttcacagatggacagaggaacagcgttgcagcaagcttcgagtctctgagctaacgggagaggcagacccagagaagttaaagccacaggaaatttcacttccttgcaactctttcccttgcncaccacacaccccccctnacaccgggctggtgctcctgtgtctgctggttccnaccccagcagagttccantttccctccttcttntgacgcttncatgggtgg

SEQ ID NO: 2405 - DNA, 550 bp, Homo sapiens
aatttttttttttttttttttttttttttctttgccattatttaataacatccacactaattataactttaaggaaattgccatgactttgcctgcagaacagtgctgataagaaaagcagaaaaggaaaaaaagaaaaaaaaattcaaaattttacctaaatgaaaggacacaaaacaaattcacctgattcatgtgggaaggacaggctgccttgagttctgcagggagcaaagttggcaatcctggagttcagcattgctacggtggctgggtggctgaggcccaaagcactgtgcagtggtgtgtgtgtgcgtgtgccccccagggaatgtttctgatcccgctggctgccctctgcctgggggccactgctcaccttggttttgatctgcttggccgtgtcggtgaggaagatggaggagttggagtcgctggcactcattttggtctgggcgccctgcagcgtgggaaaaaggtggaatgtaaaaaggcctggtttaggataaccgttcactcgggcaaagtcccttgtcattctaaggtagag

SEQ ID NO: 2406 - DNA, 435 bp, Homo sapiens
  misc_feature (1)...(435): n = A,T,C or G
tgccttgncctggaaaactgccccaaagggnccccaaaaaaaanccctccttnaagcttctgtggcaatctgggccccatgaataactggtaggtgcctgggttcccctggaggaacagtcaagccttgtaaaccctcccccgcggcagctttgtaagctcatttttaatgaacaccaacatctttactgcagaatcaatttcatcctttgacgcatttcccgctttgagggaccttacgagctccccttgtgtggcgatgctgttgaacagctccagcagagatgcgggctcactgttgggcatgtttgctatctctcaggaactacgttcacagccggcctgaggtcagaggatttgttcagcagacgagtcaagancnctccagccgggccagtcagcgctcccggctcagcaacgggctgtctcctggtcc

SEQ ID NO: 2407 - DNA, 435 bp, Homo sapiens
tgagggaccttacgagctccccttgtgtggcgatgctgttgaacagctccagcagagatgcgggctcactgttgggcatgtttgctatctctcaggaactacgttcacagccggcctgaggtcagaggatttgttcagcagacgagtcaagactttcgaaaggaggctgagatgccaaaaggttaaggaccattgtcttcagtgtttaccacataaattgcaaataggacattgagactttgttaagagaagtagattcacctgtttaacaaatagtacactccaggttgtggaagacactgcagaggtggccactggtcacggctgggcagttgagctgctgagagtgccctgcccagccagtaatggtctttaatactcttcccctctttctttcagtttcccttctgaaaaaagatgcttttgtctttcgtt

SEQ ID NO: 2408 - DNA, 444 bp, Homo sapiens
  misc_feature (1)...(444): n = A,T,C or G
gccattttatctgtacgnacgccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaaaaaaa

SEQ ID NO: 2409 - DNA, 579 bp, Homo sapiens
tgctccaacccagcagagctccactcccctcctccttctgacgccttgcagtgggtggtggttgaggtatctgggaccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaactattaaataacatatttatggcattttcttgaaa

SEQ ID NO: 2410 - DNA, 659 bp, Homo sapiens
cggctgtgggcccttggggttccctgctcactcttcctgatctgctcgagcttgtcgtcgtcctcgaggaagaaggtcaggtacatgaaagacacgtccacatcacagttgcccccaaactgcctgtgctcctcgatggtgtctctccctccagaaaacgcatgcttattgacctgcaccagaagaggacacagacacgctcctcagtcctgctcatcctgtgcctggacactggctagaagcccaagtgtggaagtcagaggtgtgagtgctgtcagattctggaccagggaaaggccaaggcgcacagccggtcgggggcgcacagccagtgggggacccactgctgttcttcctgtgaggcgggggtgtgagctactgtggggctcactgcaggagaggtgggggcagatgagctttgaaccccccatcctcggagacacaggagaatagagttgggaaagccaaggcactgattgaactgaaacctgggacagacaagttcctcaggtaacaagcgtcagaaaaaggatgggtaaggccagacatggtagcttgtgccagtaatctcagcattttgggaggctgaggggggaggatcgattgaggccaggaggtcaagaccagtctgggtaacttagtgagccctcctctctgcc

SEQ ID NO: 2411 - DNA, 491 bp, Homo sapiens
gggtggtgggctggtggatcagaccctgcagctgacataccaactctaccatcttgattcttacagattacacagacagaggtccagcaaggacagcagcagttcagccagttcacagatggacagaggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataaaa

SEQ ID NO: 2412 - DNA, 413 bp, Homo sapiens
  misc_feature (1)...(413): n = A,T,C or G
gattacacagacagaggtccancaangacagcagcagttcagccatgttcacagatggacagaggaacagcgtgcagnaagctcgagtctctgagctaacgggagaggcaganccatnagaagtgaaagccacangaaattcaactccctncacctcttccctgcccaccacacaccccccctcanaccgggctggtgcctcctgtgtctgctgctcccaaccccagcaganctccacttcccntcctccttctgactgccttgcagtgggtggtggttgangtatctgggacccccaaccaagctccgagacccagtagggatgcctgcatgccccttctcccagggattgaccttcactctcctcctctccaccccttcngcagcnagctcttacnaggattccaagcaaa

SEQ ID NO: 2413 - DNA, 427 bp, Homo sapiens
gggcatgggctgaaatacatcttgtgctcaataaacctccccacatcaatatttcaaagcactttctaggttacaataatgacatttcaattccatatacgcatacatagaatatatatttttaaacagagtgggtcttaagagtatacttggaaccctcggagtcctccatggacaagaacagggtggcccatggacttccagccaaaggctccactgtggggctgctttggggagagactcacagctggacttctctatccgaccatgcaatgttagccagcaccaattacccacaatgctttgcccataagagatagaaataatggaactcacaggaagaaacagtattgataacatacacaggcttctgtctcatggtaattactgggcctggcctctgtaagcctgtgtatgtaaccaattc

SEQ ID NO: 2414 - DNA, 273 bp, Homo sapiens
  misc_feature (1)...(273): n = A,T,C or G
ctgggtaccctggaggacagncagccntgtaatccacncccgnggcagctttgtagcncantcntaatgacaccaacatctttactgcagaancaatntcatcctntgacgcatatcccgctntgagggacctnacgagctccccatgtgtggcgatgctgttgaacagctccagcagagatgcgggntcactgttgggcatgtntgntatctctcaggaactacgttcacagccggnctgagntcnnaggatttgttcagnagacgagtcaa

SEQ ID NO: 2415 - DNA, 246 bp, Homo sapiens
ttttttttttttttttcttttttttttttttttttttttttttttttttttttttttttttttttttttttttagcaggagccaaggaagtttatttactctactgggtgacaggagggcagagtgctccagaggagacccagatacatcaaccaaggacttccctgagatttggctttgctcttccaggcctgcacatgctgcgtgatgaaatgaggcctgcctagacatctgtgagggcctcga

SEQ ID NO: 2416 - DNA, 255 bp, Homo sapiens
  misc_feature (1)...(255): n = A,T,C or G
tccagcaaggacaggcagcagttcagccagttcacagatggacagaggaacagcgtgcagcaagctcgagtctctgagctaacgggggaggcagagccaggagaagtgaaagccacaggaaattcaactncctgcacctnttccctgcccaccacacaccccccctcacaccgggctggtgcctcctgtgtctgctgctcccaaccccagcagagtccacttnccctcctncttctgangccttgcagtgggtgg

SEQ ID NO: 2417 - DNA, 320 bp, Homo sapiens
atgtatcaataatcccagcccagtcaaagcaccgcacctgtaggcttctgtctcatggtaattactgggcctggctctgtaagcctgtgtatgttatcaatactgatacatcacttcttttataagcatatgtaaaacgagtgctactgaaagtcgaaggacagcttccggggagtcatgaactctttcactatctcatccgtgacctccttgcgccgggcctgggtgctctgcgatcaagggctgcagaacctctatgagtgccttcttgagctcaccggtgagcatgggtccgctgggtgtaatccttcctgatcttg

SEQ ID NO: 2418 - DNA, 244 bp, Homo sapiens
ccagtcaaagcaccgccacctgtaggcttctgtctcatggtaattactgggcctggcctctgtaagcctgtgtatgttatcaatactgatacatcacttcttttataagcatatgtaaaacgagtgctactgaaagtcgaaggacagcttccggggagtcatgaactctttcactatctcatccgtgacctccttgcgccgggcctggtctctgcgatcaagggctgcagaacctctatgagtg

SEQ ID NO: 2419 - DNA, 213 bp, Homo sapiens
tcttgggcttttgtagccataactaatatatcgctgagcaaatgtcttccactgctggtcagctgctctaagacaaagtgagctctggggtggaggacagggccttacctgtcctaggttccacatgaggtaaggactgtctccagtctgtccattccacgtgctgccttatttaactacaagcctttgcagaaggtgtgtctgcagtcgacc

SEQ ID NO: 2420 - DNA, 215 bp, Homo sapiens
  misc_feature (1)...(215): n = A,T,C or G
catttcccgctttnagggaccttacganctccccttgtgtggcgatgctgttgaacagctccagcagagatgcgggctcactgttgggcatgtttgctatctctcaggaactacgttcacagccggcctgaggtcagaggatttgttcagcagacgagtcaagactttcgaaagnaggctgtttaacaaatagtaccctcctgcccagccgggcc

SEQ ID NO: 2421 - DNA, 197 bp, Homo sapiens
gtaagaggaacctgctgtcaatgccccagacttagagagccttgcttttctgcctgctgacctggtcaatggcacatgggataaggcactggatatccgtcctgtctcggaagatctgtgggaatgagttgctgaaggagggagcagcctggatggcaggaaaactgatcttccctgaaaatgagaaaaagtatttt

SEQ ID NO: 2422 - DNA, 1004 bp, Homo sapiens
cccacgttcttgggggcgactccacgccggttggggggctcgcccctaccccgcgacccccaccctgccagtggcgaaccccccccgtattttcccaataactaaaatgcccggccaagagatattcctttcactaaagccccaaggtaacgcgggataccttggccgcttagtattttgaagcacccaaccagggaggaagtttcagactatgaaatgcaagtgatggatttagatgttgaacaacttggaattccacgaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaaaaaaaaaaaaaaaaaaaaaaa

SEQ ID NO: 2423 - DNA, 1351 bp, Homo sapiens
gctggcgccctggttctggaggtaaccggctactgagggcgagaagccaacccggagctctagctgacaaatgcttgctgacctgggccagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatgggacaattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatcaaaaaaaaaaa

SEQ ID NO: 2424 - DNA, 729 bp, Homo sapiens
  misc_feature (1)...(729): n = A,T,C or G
accaggaggccaccttgggtataaaacccccttcggggaattgggccggtaatacgcgagtttccacgccatatggagatgctgttgaaattccctgccaaaagcagaagataaattttcttgaagtgaagactttggaaatgaaacccattaaattgcccagccaaagtatgtcgataagaggaggaagcttgttcccataaagatgaatgacccagttcacctacctttttgcctgagggtcctgaacttctttttcaaaagccactcccacttcttcaacggtgacactcagtatgtctgcagatgtacccccngttgtagagtataaaagtgcggatatgggacactttanaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 2425 - DNA, 553 bp, Homo sapiens
  misc_feature (1)...(553): n = A,T,C or G
gtaatgncgctnanggggnggaagctgttaccatggggatgantgaaccngttcaactaacttttgcactgaggtccctgaacttctttacaaaagccactccactctcttcaacggtgacactcagtatgtctgcagatgtaccccttgttgtagagtataaaattgcggatatgggacacttaaaatactacttggctccccaagatcgaggatgaagaaggatcttaggcattcttaaaattcaagaaaataaaactaagctctttgagaactgcttctaagatgccagcatatgnnccacgcggacacacgccnccntctgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaanttaaataaagttacttgaattnc

SEQ ID NO: 2426 - DNA, 472 bp, Homo sapiens
ttttgtaggtagtcatatgtgatacatactcctcagtaattaaccatcatcctgtctttcagttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 2427 - DNA, 498 bp, Homo sapiens
  misc_feature (1)...(498): n = A,T,C or G
gcgcgcgcttgngacanggcggcattaaacggttgcaggcgtacagacgtgtgtcgttgtctttctaggtctcagccgcgctcgtcgcgacgttcgcccgctcgctctgaggctcctgaagccgaaaccagctagactttcctccttcccgcctgcctgtagcggcgttgttgccactccgccaccatgttcgaggcgcgcctgggtccagggctccatcctcaagaaggtgttggagggcactcaaaggacctcatcaaacgaaggcctgctggggatattaggctccagcggttgtaaacctgcagagcatngnactcgtcccacggtctctttgggtgcagctcaccctgcgggtctgaggggcttcgacaactacccgctgncgaccgcaacntggggccattggggtgttgaaaccttcaaccaagtnattgttccaaaaattacttaaaattgcggccnggcaatttaagggttattcatttacaanttagg

SEQ ID NO: 2428 - DNA, 421 bp, Homo sapiens
gctcttgttccctggatggtgcatttaatagccatttatttttttgagtggagtttgttaagaaattacgcaagtcatattttaaagtaatcagaaaatattgattctgagttgtttaggtgttgccttttaagaaagtgagggtgccaaatcattaaatttctaacaattaacttttggaaaatttttgttcttaataggaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgtaagtagtttttaagtaaaaaaaaa

SEQ ID NO: 2429 - DNA, 363 bp, Homo sapiens
  misc_feature (1)...(363): n = A,T,C or G
ggcacgagcgtatgtctttctaggtctcagccggtcgtcgcgacgttcgcccgctcgctctgaggctcctgaagccgaaaccagctagactttcctccttcccgcctgcctgtagcggcgttgttgccactccgccaccatgggcgtggaacctcaccagtatgtccaaaatactaaaatgcgncggcaatgaagatatcattacactaagggncgaagataacgcggataccttgggcgctagtatttgaagcaccaaaccaggagaaagtttcagactatgcaantgaagttgatnggatttagnatgttgaacagnttggaattttccanaaacaggagtacagctgntgtagttaagga

SEQ ID NO: 2430 - DNA, 328 bp, Homo sapiens; identical to SEQ ID NO: 1367

SEQ ID NO: 2431 - DNA, 1790 bp, Homo sapiens
  misc_feature (1)...(1790): n = A,T,C or G
cgctgctgancccggctccccgaagcggcggcngtgcncccatctgcccggccccactccgggctcagncncnggacgctgagccgccgccgccgtttcagacgcagaccccaccgcagagtatgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcatgtggctcacgcctgtaaatcccagcactttgggagtccgaggcatgcggatcacttgaggtcaggagtttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcnatgccactgcactccagcctgggcaacaaananacnattcgtctcaaaa

SEQ ID NO: 2432 - DNA, 586 bp, Homo sapiens
  misc_feature (1)...(586): n = A,T,C or G
gccacagcgagccggcgcttccaactccggagcaaatttttnagaacataaaacaagaatatagtcgttatcagaggtggagacatttagaagttgttcttaatcagagtgaagcttgtncttcggaaagtcaacctcactcctcagcactcacagcacctagctctccaggttcctcatggatgaagnaggaccagcccacatttaccctccgacaagttggcataatatgtgagcgcctcttaaaaggctatgacgataaanttcgggnggcgtatgngcaaatcctnaantaccaaacttngcagtncaatatgaaatcttttgtgnaaattcacacattgatccagctttatgcgaacgntttnggnacaaggnccaacatgctnttgtgtcattgaaagctttcntcccatatctggntnccngggttttanccctnaaagagntttctttcctgttcnacttttttncaaactcggtttttngnggtttccattttaangnntcacanncntttaaantncnttgnngnncccaatttcacngnntttctngaatgncnccatanttncataaatacttt

SEQ ID NO: 2433 - DNA, 496 bp, Homo sapiens
ggaaaatttatgcaggttttcacgaatccttttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaaa

SEQ ID NO: 2434 - DNA, 402 bp, Homo sapiens
ccacattttacccatgaggaacctggagagctaggtgctgtgagtgctgaggagtgaggttgactttccgaagcacaagcttcactctgattaagaaggaccagcccacatttaccctccgacaagttggcataatatgtgagcgcctcttaaaagactatgaagataaaattcgggaggagtatgagcaaatcctcaataccaaacctagcagaacaatatgaatcttttgtgaaattcacacatgatcagattatgcgacggtatgggacaaggccaacaagctatgtgtcatgaaggctttgtcacatatctgggtaccaggtttgacctcaagagatggctgctgtacactttttgcaactggtttgatgtcacatttcagctccaactttgcatcct

SEQ ID NO: 2435 - DNA, 365 bp, Homo sapiens
ttatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttct

SEQ ID NO: 2436 - DNA, 287 bp, Homo sapiens
  misc_feature (1)...(287): n = A,T,C or G
gaatatgtnacaaagcttcatgacacatagcttgttggccttgtcccataccgtcgcataatctgatcatgtgtgaatttcacaaaagattcatattgttctggagagctaggtgctgtgagtgctgaggagtgaggttgactttccgaagnacaagcttcactctgattaagaacaacttctaaatgtctccacctctgataacgactatattcttgttttatgttctgaaaaatttgctccggagttggaaggcgccgctcgctgccgggcggggcgggctgctg

SEQ ID NO: 2437 - DNA, 2103 bp, Homo sapiens
  misc_feature (1)...(2103): n = A,T,C or G
gtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcaccacatgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaaatgccctgggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggtctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaacactgttagatgtgaggaaaggaagtgccaaaaatgcctggacagatggcttgtcccaaggccaggacacacactntaaaatccaacattcac

SEQ ID NO: 2438 - DNA, 621 bp, Homo sapiens
  misc_feature (1)...(621): n = A,T,C or G
cagagcctgggcctgacgaagagcctaggacctgaaanacccancgagtctcgggaagccaggggacttgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaatttaaaaaaaaaaaaaaaaaaaaaaaaaaaaaaaaaaaaa

SEQ ID NO: 2439 - DNA, 444 bp, Homo sapiens
  misc_feature (1)...(444): n = A,T,C or G
cccccccccccaaaaaanccccccccccccccaaaaaaagggggtttcttttccaaccctcaagggattttgggattggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattt

SEQ ID NO: 2440 - DNA, 419 bp, Homo sapiens
  misc_feature (1)...(419): n = A,T,C or G
aaaagggccaagcaaacctaacncctaaaaaaaacgaatgttncggggaaaccaaaatggaaactccttccccttttnccccttttggncccctttccaactgtaatgaacttgaaancaagttttgaaatcctanttgtaaantgtttccttgtccgtgaaggcaccctgcccatgtnctgttgccgttttccctcggcanccgtgtaagggcttcagncttccctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaatttaaaaaaaaaaaaaaaaaaaaa

SEQ ID NO: 2441 - DNA, 553 bp, Homo sapiens
aaccttgacgcccttttcgaccggttcttccacaaccttcggaggccacctgacggcatttccgggaacggggccccctggactcggagctcagaggcattcaggacctggtgggggacttccagaaccaattatgaggatgaaattcaacaagcgcaccgccggcagagaatgaatttgtgactttgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagcacaagtgactagtcctatgatgtacaaagcctgtatatctgtgatgatttctgtgctcttcgctgtttgcaattgctaaataaagcagatttataat

SEQ ID NO: 2442 - DNA, 354 bp, Homo sapiens
  misc_feature (1)...(354): n = A,T,C or G
gcagtggagaaggagttggaccagtcaacatctctgttgtcacaagcagtgtttcctctggatatggcagtggcagtggctatggcggtggcctcggtggaggtcttggcggcggctcggtggaggtcttgccngagtagcagctccagcgtgcaaatttntctccaccacctcctcctnccggaagagcttnaagagctaagaacctgctgcaagtcactgccttccaagtncagcaacccagcccatnggagattgcctcttctagggagttggtcaagccatnttttattccttttcttggagagtagtntaggaccaagccattttcagaaccacatttntttggttccc

SEQ ID NO: 2443 - DNA, 541 bp, Homo sapiens
tcaacaataaatttccctctttcatgaacaagctgcgtttcctggagcagcagaacaagggttctggacaccaagtggaccctgctgcaggagcagggcaccaagattgtgaggcagaacctggagccgttgttcgagcagtacatcaacaacctcaggaggcagctggacagcatcgtgggggaacggggccgcctggactcagagctgagaaacatgcaggacctggtggaagacttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataat

SEQ ID NO: 2444 - DNA, 806 bp, Homo sapiens
tcccctccccaccacagctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagctgtgccgccagctctcagtcccacagctctcaggcccctctctggcagcagagccctctcctcaggttgcttgtcctcccctggcctccagtctcccctgccctcccgggtagagctgggatgccctcacttttcttctcatcaatactgttccactgagctcctgttgcttaccatcaagtcaacagttatcagcactcagacatgcgaatgtcctttttagttcccgtattattacaggtatctgagtctgccataattctgagaagaaaaatgacctatatcccccataagaactgaaactcagtctaggagttctcatctgacaagtcagttgtcctgatcttctcttgcagtgtcctgaatggcaagtagtgtaccttctagtgcagtctgcattcctgcactgctttctctgctctctttgccttcttttgttctgtgtgaataaagcatattgagaatgtgaacatgttgtgttagattgtattgctgaccacttcctggtttagaaacattcgcaccccacaaatggtttcttatctttggg

SEQ ID NO: 2445 - DNA, 213 bp, Homo sapiens
aaaatgttgaatcccaagctgcttttctgtttcatcctacccactggctcaaatgtgtcccatgcctttcttcctgtagatatgaggatgaaatcaacaagcgcacagcagcagagaatgaatttgtgactctgaagaaggtgagcagatgaagccaggggttcaaattcatttagaaggagagaagtggctctgtgtcctcgctcccctggg

SEQ ID NO: 2446 - DNA, 226 bp, Homo sapiens
gtagggtgattggaaaggtgagctcaggtaactccaggttgttggctctttccccaggatgtggatgctgcctacatgaacaaggttgaactgcaagccaaggcagacactcttacagatgagatcaacttcctgagagccttgtatgatgcagtaagcaactccaccatccttctgtttactctgatggggtctgcaaaggggagaagatgtacagggctgggca

SEQ ID NO: 2447 - DNA, 2121 bp, Homo sapiens
cggccttcctcacccaccatgtctcggcagtcctccatcaccttccagtctggcagccgcaggggcttcagcaccacctcggccatcaccccggcagctggccgctcccgcttcagctctgtctctgtggcccgctctgcagcagggagtgggggcctgggaaggatcagcagtgctggggccagctttggaagccgcagcctctacaacctggggggtgccaagcgggtctccatcaatgggtgtggcagcagctgccgaagtggctttggtggcagggccagcaacgggtttggagtcaacagtggatttggctatgggggtggagttggaggaggcttcagtggccccagcttccccgtgtgtccccctggaggcatccaagaggtcactgtcaaccagagtctcctgactcctcttcacctgcaaatcgaccccaccatccagcgggtgcgggccgaggagcgcgagcagatcaagaccctcaacaataagttcgcctccttcatcgacaaggtgaggttcttggagcagcagaacaaggtcctggagaccaagtgggccctcctgcaggagcagggctccaggactgtgaggcagaacctagagcccctctttgattcctataccagtgagctccgacggcagctggaaagcatcaccaccgagaggggcaggcttgaagctgaactgaggaacatgcaggatgttgtggaagatttcaaagtcaggtacgaagatgaaattaacaagcgcacagctgctgagaatgaatttgtagccctgaaaaaggacgtagatgctgcctatatgaacaaggtggagctggaagccaaggtcaaatctctgcccgaggagatcaacttcagccactcagtctttgatgcagagctgtcccagttgcagacccaggtcggtgacacatccgtggtgctgtccatggacaacaaccgcaacctggacctggatagtatcatcgccgaggtcaaagcacaatacgaggacattgccaaccgcagccgggccgaggctgagtcctggtaccagaccaagtacgaggagctgcaggtcaccgcaggcagacatggggatgaccttcgaaacaccaaacaagagatctctgaaatgaaccgcatgatccagaggctgagagctgagattgacagcgtcaagaagcagtgttccagcttgcaaacggccattgctgatgcagagcagcggggagaactggctctcaaggatgcacgggccaagctggtggaccttgaggaggccctgcagaaggccaagcaggacatggctcggctcctgcgtgagtaccaggagctgatgaacatcaagctggccctggacgtggagatcgccacctaccgcaagctgctggaaggcgaggagtgcaggttgagtggagagggagtttctccagttaacatttctgtggtcacctctactctttccagtggctatggacgcggcagcagcattggaggtggaaacctgggcctcggtgggggcagcggctactccttcaccaccagtggtgggcatagcctgggtgcaggcctgggaggttctggattcagtgccaccagcaaccggggcttagggggcagtggttctagcgtcaagtttgtctccaccacatcctccagccagaagagctacacgcactaagagagccccatggctccctctaccctgccttgaggcctgtttgcagtcacacctggacaccagggtcctcctccttcctctctccttgtaaggtgcacctgtgctgctgggagcctggagtactggctatacccattcccaggcctaagccagcctctccctcctgacagtgcccagactgccagcagcacccgtctgttacacatgtgaaaccaaagcctgctctctcctaaggctctcattcagcctatcttgcgaggcccgggcagctggaaagtcctcctccagctccacctccctccctccctccagatgcagaggctggggagtctctcaatgccaggttgtcacccacctgtctcatagtgtttataagtggcctgctgggagtgagtgctccctctgttccctccctggaatgtgtctattaaatgcatgtgtcacctg

SEQ ID NO: 2448 - DNA, 686 bp, Homo sapiens
tggggggtggctcagctctgttgagcgggcaggtcaccatcaagtccacccccctcctccctccagcagaaagaggctacaagcactaaagtgctgcctccagctctcggtcccacagtcctcaggccctttctctggctgcagagccgtcttctcaggttgcctgtcgtctcctggcctctagtcttccctgctctccgaggtagagctgggtatggatgcttagtgccctcacttctctctgtctatacctgccccatctgagcacccattgctcaccatcagatcaacctttgattttacatcataatgtattcaccactggagcttcactttgttactaaattattaatgttcttgccgtcgcaaaagttggttctgctgctgaggctgagcattataagaaaatgatctctgttccttttcatgtacgtgaaaatcgcctggggcgttatgttcagaacaacttcgcactgtattttccattgggcccccaaactccctgaagttaaaagtattgtgaacccccgccccgcagtatgcatgggaaggcacaagtgattagttcgtatggatgtagcacagtctttctccctgtgatgatgttctctgctctttgctctttgtaatttctaaataaagcaggttttagaataaaaaaaaaaaaaaaaaaaaaaaaaaaaaaa

SEQ ID NO: 2449 - DNA, 981 bp, Homo sapiens
attgtggcttcttgtgtccttgtccctccccaccacagctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagtcgtgccgccagctctcagtcccacagctctcaggcccctctctggcagcagagccctctccctcaggttgcttgtcctcccctggcctccagtctcccctgccctcccgggtagagctgggatgccctcacttttcttctcatcaatacctgttccactgagctcctgttgcttaccatcaagtccaacagttaatcagcactcagacatgcgaatgtcctttttagttcccgtattattacagggtatctgagtctgccataattctgagaagaaaaatgacctatatcccccataagaactgaaactcagtctaggtccagctgcagatgaggagtcctctctttaattgctaaccatcctgcgccattatagctacactcgaggagttctctatctgacaagtcagttgtcctgatcgttctcttgcagtgtccctgaatggcaagtgatgtaccttcgtgatgcagtcgtgcattcctgcactgctttctcggctcgcgttgtccttcttttgttctgttgaataaagcatattgagaatgtgaacatgttgtgttagattgtattgctgaccacttcctggtttagaaacattcgcaccccacaaatggtttcttatctttggggaactgctgctctccccactgaccagtcatcatggaggagagtcgggagactccccctccgcagacctacgccta

SEQ ID NO: 2450 - DNA, 2579 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaaccctggggggctccaaagaggatatccatcaagcactagtggtggcagcttcaggaaccggtttggtgctggtgctggaggcggctatggctttgggaggtggtgccggtagtggatttggtttcggcggtggagctggtggtggctttgggctcggtggcggagctgggctttggaggtggcttcggtggccctggctttcctgtctgccctcctggaggtatccaagaggtcaatgtcaaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatcaaatcaacaagcgtaccactgctgagaatcactttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaagaccatggccggcctgcggcgtaagtcccagaagctcatgaacacccaagcgtggccttggacgtggagatcgccaccttaccgccagggctgttggagggcgaggaatgcagactcagtggagaaaggagttggaccagtcaacatctctggttgtcacaagcagttgtctcctctggatatgccagtgccagtggctatggcggtggcctcggtgaaaggtctggccgccggcctccggtggaggtcttgccggaggtaagcagtgaaagctactactccagcagcagtgggggtgtcggcataggtggtgggctcagtgtggggtgctcttggcttcagtgcaagcagtagccgaggggctgggggtgggctttggcagtggcgggggtagcagctccagcgttcaaatttgtctccaccacctcctcctcccggaagagcttcaagagctaagaacctgctgcaagtcactgccttccaagtgcagcaacccagcccatggagattgcctcttctaggcagttgctcaagccatgtttttatccttttctggagagtagtctagaccaagccaattgcagaaccacattctttgggttcccaggagagccccattcccagcccctgggtctcccgtgccgcagttctaaattctgggttcaaaatcaagcctttcaggttttccacaagaattggcccctgctggacaacgagaaacccaaagtttttccaaaatctaaatcatcaataacagaatccccaccccaattcccaaattttgttttggtgtctaactacctccagaatgtgttcaataaaatgcttttataatataaaaaaaaaaaa

SEQ ID NO: 2451 - DNA, 582 bp, Homo sapiens
tggcacgagcggcttcaaaggtgaagcaggacatgcctccgccggggggctatgggcccatcgactacaaacgggaacttgccgcgtcgaggactgtcggggcttaccagcatgctggcccatagggattggaacccctgatctacgggcactggagcccataatgaaagtggaaaccggtgagcccgcaggcgccttacaaaatcgaggactttcgaggcttcgcatcgcgcttttgccactgttaaaggcagaaaccgacccggaggaccttgcagatgcttcggggagaacctggaggaggaggccatcatcatgaaggacgtgcccgactggaaggtgggggagtctgtgttccacacataccgtctgggtgccccccttgatcggggagctgtacggcgtgcgacacgcacgagaaggaggctctccatcgccagccacggcttcatgtggtacacgtaggcacctgtgccctccggccacctggatccctgcccctccccactgggacggaataacatgctctgcagacctggaaaaaaaaaaaaaagtcgagcgccgcgaatttagtagtagtag

SEQ ID NO: 2452 - DNA, 2791 bp, Homo sapiens
  misc_feature (1)...(2791): n = A,T,C or G
cactcagggcattgtcgataaacagcctagcatgcagaacctttgctgaagacagtgactaattccaacttcatgaattgagaatactcttattgtgctgagatctcgagtcaaagctggaggcaggaacattttgccctgactaaaggaagcgaaaaatgcaatctcggtatttcataacttttgtaataatgcaggtgtgaatctcactatttgtaaagccccagcccttcccaacctgcaagctcaccttccaggactgggcccagcccatgctctctcataatatataagctactgccccgagcccgattcctccgtcctgcttctcctccctctggcctccagcctctcacactctcctaagccctctcatctcctggaaccatggccagcacatccaccaccatcaggagccacagcagcagccgccggggtttcagtgccagctcagccaggctccctggggtcagccgctctgcgcttcagcagcgtctccgtgtcccgctccaggggcagtcggtggcctgggtggtgcatgtagaggagcttggctttggcagccgcagtctgtatggcctggggggctccaagaggcatctccattggagggggcagctgtgccatcagtggcggctatggcagcagagccggaggcaggctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggccgcctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactctcacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatacgaggagattgctcagaggagccgggctgaggctgagtcctggtaccagaccaagtacgaggagctgcaggtcacagcaggcagacatggggacgacctgcgcaacaccaagcaggagattgctgagatcaaccgcattgttccagaggcttgagatcttgagattcgaccacgtcaaagaagcaagtgcgcncaacctttcagggccgccatttgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggctgaatggcgaaggcgttggacaagtcaacatctctgtggtgcagttccaccgtctcccagtggctattggcggtgccagtggtgtcggcagtgcttttaggcctgggggtgaagaagccagctactcctatggcagtggtcttggcattggaggtggcttcagttccagccagtggcagagccagttgggggtggcctcagctctgttggaggcggcagtttccaccatcaagtacaccaccacctccctcctccagcagaaagagctacaagcactaaagtgcgtcctgctagctctcggtcccacagtcctcaggcccctctctaggctgcagagcccttatcttaaggttgcctgtcctctcctggcctccagtctcccttgctgtcccaggtagagctggggatgaatgcttagtgccctcacttctctctgtctatacctgccccatctgagcacccatttgctcacccatcagatcaacctctggattttacatcaatgatgtaatcaccactgggagcttcactttggttactaaattaagcaatttcttgcctccaagtgttctatctctgaggctgagcattatgaagaaaatgacctctgctcctttttcattgcagaagaaattgccagggagcttatttcagaacgaacttcgaacttactttcgaactggctcatcaaactcatctaaacttataagtgttggtgaacccccaccccaggcagttatccatgaaaggcagcaagtgagctagatcctatgatggaccaaagcctgtacccctgtgatgattccggtgccctcaactcttggcaatggcaaaataaagcagatttataatacaatatattcttttactttgccttgctttggggccaaagttttgggcttaaacttttttatctgataagtgaatagttgtttttaaaagataatctatctttatcacata

SEQ ID NO: 2453 - DNA, 2293 bp, Homo sapiens
gcttgggcctcagggatctctcaggttcttcactccctctccaagcatcctcctccgggaagccttccctcactgagtccgtttccaatgggctggaactgggtcccccgctgttctctgcggccgtctagggatggcgctcctgcctagtccggaccatccctgcttggactgaaagcctgggcttcggcggggcgggcgggcagagggcggagggcggccccaggaggggcctggcagcagagaaacggtggcccgcggccagccccgcccctacctgtggaagcccagccgcccgctcccgcggataaaaggtgcggagtgtccccgagaggtcacggcgagtgcgcgctcctcctcgcccgccgctaggtccatcccggcccagccaccagtgtccatccacttcagcaccccggtattcacctcgcgctcagccgccttctcgggccgcggcgcccaggtgcgcctgagctccgctcgccccaggcggccttggcagcagcagccgtctacggcctcggcgcctcgctgccgcgcgttgccgtgcgctctgcctatgggggcccggtgggcgccggcatccgcgaggtgcaccattaaccagagcctgctggccccgctgcggctggacgccgacccctccctccaggcgggtgcgccaggaggagagtcgagcagatcaagaccctcaaacaacaaatttgcctcctttcatcgacaacggttccggtttctggcgcaagcagaaccaggctgctggagaccaaagtacaccctgcctgcaggacccagaagtcggcccaagaagcagccgccctccccagacatctttgaggccccagattgcctggcctttcggggtcagctttgaggcacttgcaggtgggatgggcgtgccgcctgggaggaagcttgcgcggacattgcaagggatgttggttggaggactttcaagaataagtaccaaagatgaaaattaaaccgtcgcacagcctgcctgaagaatgagtttttttgtgcctgacagcaggatgtggatgctgacctacatgagccaagttggagctgggaggcccaaggtggatgccctggaatgatgagatcaacttcctccaggaccctcaatgagacggagttgacagagctgcagtcccagatctccagacacatctgtggttgctgtccatggacaacagtcgctccctgggacctgggacggcatcatcgcatgaggtcaaggcgcagtactgaggagattggccaaatgcaagccgggcttgagggctgaagcttgggtacccagaccaagttttgaggaccctccagggcccagggttgggaaagcatggggaccgacctccggaatacccggaaattgagattttcagagattgaaccgggccatcccagaggcttgcaggctgagattcgacaacatcaaggaaccagcgtgccaagttggaggcccgccatttgccgagggctgaggagcgtggggagcctggcgctcaaaggatgctcgtgcccaagcagggaggaagcttggaagccgcccttgcagcgggccaagcaggatatgggcacggcagctgcgttgagttaccagggaattcattgagcctttaagtttggccctgggacattcgagattcgccaccttacccgcaagctgctgggaggggcgagggagagccggtttggttgggagatggaagtgggaagcccgtgaaatatctcttgttgatgaaattcccactggttggcagttagcagttggccgttgccttttgggttgacccttcgggggaaaccattgggcaagcaatgcctggagctttcttccagcaagtgcgggtcctggggctccttgaaggcttatttcatacggggaccgcatcccgcccagtcgcaggaggtgcccgcgactgaagccgcctcccaccactccactcctccagccaccacccacaatcacagccattgccgaggctgaggagtgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctagccctcgggggaaccatgggcagcaa

SEQ ID NO: 2454 - DNA, 8868 bp, Homo sapiens
tcaacggatctcgctcttttttttctttggagatggaatctcgctctgtcgcccaggctggagtgcagtggcaagtctcagctcactgcaactctgcctcccgggttcaagtgattctcctgcctcagcctcctgagtagctgggattacaccatggccagctaatttttgtatttttagtagagatggggtttcaccatgttggtcaggcttgtcttgaactcctgacctcgtgatccgcctacctcagcctcccaaagtgctgggattacaggcgtgcacagcgtgccctggccttggatctctttttatcttgcaccttcagatgtagagggacgacagccactgtgtgtgtatgtgtatgtgtgtgtgtgtgtgtgtgtgtgcgcgtgtgatgtttattcactcatttatttattcattcattcattccacaaatatctacccagaccctcttggcactgcaccaggtcgtaggggtagaacagtaacctggaaagatgaggcaaatggttgatttcagattcaaggctttggactccagctgttctgtcatccagctcaggcaggccctcataatcgcttcaatcagggagaacacaggagagtttctctggggtgtcggcagctcagaggagacccaaatactaggagaccccttttcccatgcttcccagtcctccagtttatttcccccaggaaggagggagacaagacccagagtcagggttgtagtggctgggcggcccaggcaagtctgcttgttacacgacttgtgccaggacaggatttcttccagtttcatattcactgaactgccttttcctgggtttctgggggtggtgctggagtgggctccagggttggaacgggcccttgcgacgcgtctctgctgcccccacctgagtctgccccgaggtggcaggtgacgggttaggcccagcccctctggccatagccactcaggtacgaggcctttcccccccatcccccggggctgggatctcttttataaaaggccattcctgagagctctcctcaccaagaagcagcttctccgctccttctaggatctccgcctggttcggcccgccatgcctccactcctgccatctaccatgtccatcagggtgacccagaagtcctacaaggtgtccacctctggcccccgggctttcaagcaagccgcttcctaacaacgaagtgggcccggtttccgcatcagctcctcgagcttctcccgagtgggcagcagcaacttttcgcggtggcctgggcggcggctatggtggggccagcggagatgggaggcatcaccgcagttacggtcaaccagagccctgctgagcccccttgtccttgaggtggaccccaacatccaggccgtgcgcacccaggagaaggagcagatcaagaccctcaacaacaagtttgcctccattcatagacaaggtgagggtcccctgcgtggctgactgtgccccgcagcccctttctcctggtagtcccggtccctatgcacatctccagcccccagctggcgtcctgctgggcctcacccgccctgggcacactctcccttccatcctccgacctcacccctcccgtgcaccttggtttgggctgggtgagggtggggagagggtctggacagccgggatgaatcctggggcttccttcttcccttttaaactggagggtcttggaagagagagacaacttaagggtacagcctagttcccaccacccctctctacaaatcccgttcttcctcaggtcattctgtcccaaattataaaaaataatagcggttattgttctcaccccaacccagttctgaccgtcttttaacgtatgcctgcggcagtcccagctgttcgggactaccctcctccaggttcgcctcttcgccagcactacccaaggctccccagtggtgcctttgtgattttttttctttcttttttttacataggggtttggtgtgattctagcattctaggagaaggaagtgggtgtctcggttcaaacgggcaaatattgattgaggcctttggccgccggaggcctgagtgcgggggtcacagaatgagtcatacggcccctggcccggcagcgtgggcggggccgagggcggggtgagggctgcgggcagcagtctgcgggacgctctcctccactggcggagctcggcgtcgggggcggtgtgggtggggtggggtggggtggggtgggctggggtggggtggaggaggcgagggcctggcctcggaaagcccatgcaggattcaaagtctcctgggacgccgcccggggtttacgtcctgttaagtttatggcttcagataacgcggtcgcccaccaacgcccctcgcccattcagcccgtgtccctttctcggcgtcctgtccctgctgcccccagcctcggctccagctttccacacagcaggagccagggccgggttttgcagcctgggactccgctgcctgagccccggcccccggcggccccgaggattgggcccttcacgctgactggctcctgggaggcattgtgggaacgggaggagggaaatcctggggcagagtaagccgggaggaaccggagccccaggaacccagtggtcgggggccctcgctgtccaagcgcctggacttgacttgttgactgcgttttgctagccctggggtccttatagagagcagctaagcataggctttggaatctgaattcttggtctgcactcgtctgccggttcctggttatggactcccttgccaagtcttatttcctcatctataaaatgaatatgagagcccctaaatccatatagcaaaagtttttgccttattcaaacttacatatgtaaagagttcagcagtgcttggcccacattccattaggataagatgttataatcacttttttttaaaaaataattttggggcagaatgactggggaagaaagcgatttgcagagagtggtggagggaactaggctgtacccttaaaagatttctgtcccctccagtttagaaggagttacaagtttttttgtttgtttgagacagagttactctgtgcccaggctggagtgcagtggtgtgatctcagctcactgcaacgctccgcttcctgggttcaagcgattctcctgcctcagccaccgagtagctgggactacaagtgcgtgcacagcccggttaattttgtaattattgtaggcaaggttcaatatgttggcaggctggtctcgaactctgacttcagaaatccgcctgccttgaccacccaaagtgctggaattacagcgtgagcctccacgcccggcctctttttcaatcttaacatctttagaaaggttggctatttttggccgggcgcgggcttacgcctataatcccagcactttgggaggccaaggcgggccaatcacaaggtcaggagttcgagaccatcctgcctaagacggtgaaaccctgtctctactaaaaatacaaaaaaattagtggggcgtggtggcacgcacggctgcctgtagccccagccactcgggaggctgaggcaggggcaggagaatggcatgaacttgggaggcggagcttgcagtgagctgagatcttgcactgcactctagcctgggccggagactcccaaagaaagcttggctatttttattgatgtgtaatatacaacctatgtaaatgaagttaggcctattggtttgcaaatgcagctttaacataattaccttacctgtctccttcccctacccaatgctgagggacattgctccccacctcaccatcatgccatgctttctccccctggtcataggtgatctttccagaacagctaaccaggtgcctggggtctggagacttactgcttgaggagtgaattaagagaaaagactgcttgctttcctccagactttgagccctggcctgatgtagacctttttgctctctcctccttcgtataggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtgagcaactcccaccctccacccaactgaagtcaccgtgctctcctccaccccttggaccttgggactaagtccccatggccctctgttgtgggaagtgcagtcctatctaattagggtgaccacctgatgaggtttgctcggaacagtctgtgtttatgcccaggttcctagcacaattgttgatagtacccaccccctttcaatctcaactgtctggatttgaagaacaaattatgtgtcaatgttgacatggtaaacctgagacgggagagataggcagcctgtgggcctcacttttgtacttaacattctggcccctctttagtcttgacccttgacctctagcaaactctagaaagttctgtctgaggtctcatgtcaggccctgctgttaacactctcaaggtgtccaatccgatgtgtattcatggatttggagagagatttcctgtttcccacgggctaagggaggggtgagggtggagagggcagctggggaatgcagaaggaccagccttctcatatcctgcatctctgtgaactgaattttcctgattttcacaacgcccctgtctcccaaaagaccaagggcaacctcccttttgccttcatcctctaattgtaagtcttttccccacaggtatgaggatgagatcaataagcgtacagagatggagaacgaatttgtcctcatcaagaaggtgagggagtctcccttctcctatctggacactggaggctggggctcagagactcagaccaagaagctttctgggttttgtccctaaatattcctaagtagtgggacaaactcatttatgtaaacatttgggtgcacagaaaggtagacaaggatggagtggtaggtgcatttggacagaactcttgacatcggtgttgggacatggttcagaaaacagagcagtagaactggagatctggctctagaaggctccctagagaaggaggtggaagagggtgtgttgcaggaagcagaggtgaaggtgtgtgggctgagaatgcacatgtgatgggcagaggctgggctggaagatcaatccacaaagtggcaactagaaagtcctgtgaccaggccattgggtggaccttgggagccccttggttggggttgggtgtggaaacccagctcaggctcccctctcctcatcccccaggatgtggatgtggatgaagcttacatgaacaaggtagagctggagtctcgcctggaagggctgaccgacgagatcaacttcctcaggcagctatatgaagaggtatgttcctggtcgcaggagagtgagggtcccccagccttgtcagcgcctccaccctgagactcaaccagaggctcctcccagcccccagcacactaataagacaaaggaccccactgctgactaattacagccaccaatatttgctcggctagtatttattgggtctatatgttctgtccctcgcatgagggatgagtcattaccccatttcacagacgagaaagtgggctcagagaagtgaaataacgtatccaaggtcatcatagggtgtggtgattcagcagcaactctgtccccaaagcccttgttcctaatctttgagctgcattggatccctctgtgcacctagtattggtgcacccagttcctttttcaggaactttgcccctctccctgaccctgactcccacctgctcctctcctctgctgcccctgtcttataccctaagaaaggctgttgtggaaaagggggctccctgtgtgcagagacagggcctcaccacttgccctcttcccccacaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccaggtatgggccgggttgggggtgggagggttccttggacacaatcctggtgagaggagataatgtaggaagagtgaagtttctgggagtcggggaaggaatcctagaccagggttcaggagttggaggggcagccacagttcagcttctcagtctgcttctgagaagcaaagggatgcagggaaggtcccttgggccaggacagaggtgaaaggggactggggcaggtatgttggggactcgtgatacatgctccaagcctgctttaatcagtcatatgcatcaggggtaaggttgagctctgctgctttaaggaaagtctagaacccagggatctagtccagttagggtagggggaccttacagtgtcgcaggtcgagaagggtgtggaggggaagcacctggaaactgctcatgtctccctgatctgcttccttagtctcgtttatttatttatttatttttgagacagagtcttgctctgtcgcccaggctggagtgcagtggcgtgatctcggctcactgcaagctccgcctcctgggttcacactattctcctgactcagcctcctgagtagctgggactacaggcgcccgcaccaggctggctaattttttttgtatttttgctagagacggggtttcactgtgttagccaggactcgtcgatctcctgaccttgtgatctgcccgcctcgcctcccaaagtgctgggattacaggcatgagcactgtgcccggcccttagtctcattaattgagctggggagtcagcctagtgtgtggaggacctgagggagggtggacgcacggaggaagagaaggcatacccaacctgacctacttacctgtcccctacccacagagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggtgggtgtgggtacctctgaccggacctgcttccctatccctgggacctggggtggggacggtgggagccccctgaagccccttggacttggggtcctgttgttctgggccaagaagggctaggagttggtcctgacaccccatttgacagggtacaggctggagtctgggatgcagaacatgagtattcatacgaagaccaccggcggctatgcaggtggtgtcccagggccctggatgagggcgggaggcagggccagggaggctcagctccagggagggggctgtgctcagtcgctcacagtgacctcagcctgagcactcatgttcttgggagaatcctagggtggggaggcacatattcagggaactccagtaataactttattacttagtaacttcatattagaagatacaccaataaccatagctgtgtgccaggcacttgcgtaagtatcctacaggttttatgtgatttattttatttattaatttaatttaatttttttgagacgaagtctcgctgtcaccaagctgagtgcagtgctgatctcagctcactgtaacctcacctcctgggttcaagagattctcctccgtcaggcctcccaagtagctgggactacaggcgcataccaccatgcccatgctaatttttgtatttttagtagagacggggtttcactgtgttgggcaggctggtctcgaactcctgaccttgtgatcagtgctgggattacaggcatgagacactgggcctggctgtaatttattttttatatgacacctgtaaacgtcttcagttgaggaaggctgaggtgcagctaaatgtccaagctgacacaggctatatatatggcagctgttttccaccctgctcctggttttccctgacagttctggagtagtgaaccatgcaatcactgatcaggcagagctgggttaacctcccatccctggggctatgttgggaatgagcagggagaaggggcatggagcctgccatggggtgggcttctgtactcatgtggctacctctgtccctcaccaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctcgccgaatgtccttgctt

SEQ ID NO: 2455 - DNA, 2485 bp, Homo sapiens
ttcatcatgctccgagccgggcggcgcgcgccgcttccgtcgccaccctctctggacagcccagggccgcaggtcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaaaaaaaaaaaaaaaaaaaa

SEQ ID NO: 2456 - DNA, 3036 bp, Homo sapiens
accaccagcaggaaggcgctggagaccttacgacgggttggggatggcgtgcagcgcaaccacgagacggccttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtccctttttccttggactggtatcttttcaactattgttttaatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaaaaaaaaaaaaaaaaaaa

SEQ ID NO: 2457 - DNA, 544 bp, Homo sapiens
  misc_feature (1)...(544): n = A,T,C or G
ggagcngcggcccccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaa

SEQ ID NO: 2458 - DNA, 1129 bp, Homo sapiens
gcggccgccgcccattggcgccgaggtccccgacgtcaccgcgacccccgcgaggctgcttttcttcgcgcccacccgccgcccgcgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagactt

SEQ ID NO: 2459 - DNA, 591 bp, Homo sapiens
ggtccccgacgtcaccgcgacccccgcgaggctgcttttcttcgcgcccgccccccccccccgcgccgctcgcggtgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgcccaaaggacacaaagccaatggggcaaggtctggggccaccagcaggaaggcgctggagaccttacgacgggttggggatgccgtgcagcgcaacccacgagacggccttccaaggatgggtttgtggagttcttccatgtagaggacctagaaggtggcatcaggaatgtgctgctggcttttgcaggtgttgctggagtaggaactggttggcatatctaatagatagcttactgtaaatgcatagttgactttaacca

SEQ ID NO: 2460 - DNA, 484 bp, Homo sapiens
cccgtgcccacctgctctggtgtccgctcgaggagtatgtattttccggctgccgacgttatcattgttcgcccgaagaggagtctgtatgggcacgatccggagcctctcgggaagcggtcggctgttctgctgtgctggagtcggtcggggaatctggtaataacaccagtacggacgggtcactaccctcgacgccgccgccagcagaggaggaggaggacgagttgtaccggcagtcgctggagattatctctcggtaccttcgggagcaggccaccgcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaaca

SEQ ID NO: 2461 - DNA, 656 bp, Homo sapiens
gtttccctgctgtagttgctccattcaaatgttccgtcctcccactgagccaaaaccaggagttcatgccatttgtcaaggaattatgtaagcaaattcaattgggtaaactccatgggaacaccatcaaggagactgaattttaggaaatgtatcatttatttcaataaaaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagctgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaaggatttattaaactttagggatatttcttt

SEQ ID NO: 2462 - DNA, 729 bp, Homo sapiens
aaaaacattccagtaacgaaagacatggtccgtgtgaagagattccagaataacactgcatgtggaagaagttgttccgagtgtaattggagccctcctttggcttggcagggatcatgtataccatattggaacatacattccatgtccgagagggagatgaacagagaacgttcttcagtttccctgctgtggttgctccattcaaatgttctgtccttccactgagccagaaccaagagtttatgccatttgtcaaggaattatccgaagctctgaccaggaacggcgtgtctcataaagtcgatgactcctctgggtctattggaaggcgctatgcaagaactgatgagattggcgtggctttcggcatcactatggactttgatacagtgaacaagacgccccacactgcaactctgagggaccgagactccatgagacagataagggcagaggtctctgagctgcccaatgtggtccgcgatctgccaacggcaacattacctgggctgatgtggaggccaggtacccactctttgaagggcaagagactggcaagaaggagacagtagaggaatgagaacagctggcagcttatgaccatcgtgctaataaataactcatcatgtccactacacagagcattgtgactgcatccagggacggtttttcctcagtggctgcttggttttactcccacaattaaagttgaaggaattctgaaca

SEQ ID NO: 2463 - DNA, 663 bp, Homo sapiens
  misc_feature (1)...(663): n = A,T,C or G
tttagagagaatctgaaatgcattatgtggtatttgagagaatgttattgaatttctatctctttttcagtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgtgccgtcctcccactgagccaaaaccaggagttcatgccatttgtcaaggaattatcggaagccctgaccaggtatggagtatctcacaaagtagacgattcctctgggtcaatccggaaggcgctatgccaggactgatgagattgggcgtggcttttggtgtcaccattgacttggacgcagtgaacaagaccccccacattaaattctctaggggcccgagtttaattgggnggttngaggagggggtttttttgntttccccaaatngcccaaaccccgccnnaggnaaaannnanatggttttttgtggggcccattttccccttnggggggaaaaaantttttntaaaangaaaaaccgngnntgngaaaatnggnaaattnggccccgnttctttggtttccttttttttnnnnnnnnnnnncccccnttccccnccc

SEQ ID NO: 2464 - DNA, 433 bp, Homo sapiens
agctttcccctgccatccctgaactctttctagcccttttagattttggcactgtgaaacccctgctggaaacctgagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacatcttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattc

SEQ ID NO: 2465 - DNA, 361 bp, Homo sapiens
gccgccgcccattggcgccgaagtccccgacgtcaccgttacccccgcgaggctgcttttcttcgcgcccacccgccgcgcggcgccgcttgaggagatggaagccccggccgctgacgccatcatgtctcccgaagaggagctggacgggtgcgagccggagcctctcgggaagcggccagctgtcctgccgctgctggagttggtcggggaatctggtgataacaccagtacggacgggtcactaccctcaacgccgccgtcaacagaagaggaggaagacgatttattccggcagtctgtggaaataatttttgggtctcttgaggagaggcccagggccatagaaacaaaaccaatt

SEQ ID NO: 2466 - DNA, 305 bp, Homo sapiens
cgcgcccacccgccgcggcgccgcttgaggagatggaagccccggccgctgacgccatcatgtcgcccgaagaggagctgtacgggtacgagccggagcctctcgggaagcgaccgggtgtcatgccgctgttgtagttggtcggggaatctggtaataacaccagtacggacgggtaactaccctaaacaccgccggtacctgcggaggaggatgcccatttttaccgcatacccttgagaatatcttccgggaactttggggacaaggcaacggggcccaagggcacaaaagccattgggcaa

SEQ ID NO: 2467 - DNA, 285 bp, Homo sapiens
gcacgaggtgctctagtgtttttccctgagagaagcgtaagacaaacagaagtcaaaaagtagtcactgggaaaaacatgcagtgctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaaaaaaaaaaaaaaaaaa

SEQ ID NO: 2468 - DNA, 265 bp, Homo sapiens
agaagttgttccgaatgtaattgaaccttccttcggcctgggtaggatcagtgatacggtatttgaacatacattccatgtacgagaaggagatgaccggggaacattcttcaggttcccggcggaagtggctccatccaaatgttcggtcttcccactgggccaaaaccaggggttcatgcaatttgtcaaggattatcgggagaccctgacaaggattggggattttcccaaattggcggtttctttggggtaattgggaagg

SEQ ID NO: 2469 - DNA, 434 bp, Homo sapiens
cgggtccctgcagggcgcttttcagcctaagacttcaagccccattgaggtggcccgccgggctggtgcggttcacacactcctgcagaaagcgcctggggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagac

SEQ ID NO: 2470 - DNA, 270 bp, Homo sapiens
  misc_feature (1)...(270): n = A,T,C or G
ccagcgtgagtttcttnccgtccttccctcctgccatcccgggactgcccaccctgctcccacaccccngccccttcggtccctgcagggcgcttttcagcctaaggtgtctgacccgtaccgggcggtggtcaagaagccggggaggtggtgtgccgtgcagtgcagatcgcctggcagatctaccgtcaccagcagaagataaaggagatgcagctggacccccacaagctggaggtgggtgcaaagctggacctgttcggcagaccc

SEQ ID NO: 2471 - DNA, 2360 bp, Homo sapiens
ggaagtgcctgcaaccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagacttcttacttcatggcaaccaacagcctgcatttgaccacatttagcctgcagtacacacctcctgtggtggcctgtgtctgcattcacctggcttgcaagtggtccaattgggagatcccagtctcaactgacgggaagcactggtgggagtatgttgacgccactgtgaccttggaacttttagatgaactgacacatgagtttctacagattttggagaaaactcccaacaggctcaaacgcatttggaattggagggcatgcgaggctgccaagaaaacaaaagcagatgaccgaggaacagatgaaaagacttcagagcagacaatcctcaatatgatttcccagagctcttcagacacaaccattgcaggtttaatgagcatgtcaacttctaccacaagtgcagtgccttccctgccagtctccgaagagtcatccagcaacttaaccagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcctactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttggggaaaaaaaaattttttttaaaattttttccccaagggacgggggaaaattttatttttaaaatttttt

SEQ ID NO: 2472 - DNA, 455 bp, Homo sapiens
  misc_feature (1)...(455): n = A,T,C or G
ttgaaaagacgttgctgttgatctgtcacatagctggccaaaggtgacttgattcagatgaaaatagttagttagtagttcaggttattcttgtttcattacttctgtttctctcagtctttcttgaatgttctgttttacttgtagaactgacacatgagtttctacagattttggagaaaactcccaacaggctcaaacgcatttggaattggagggcatgcgaggctgccaagaaaacaaaagcagatgaccgaggaacagatgaaaagacttcagaggcagacaatcctcaatatggatttcccagagctctttcaggacacaaccattggcaggttttattgaggcatgttcaacttcttaccncaagtggcagtggcctttccctggccagttttccgnaggagttcatcccggcaactttaacccgtgttgggagntgtttgccnggg

SEQ ID NO: 2473 - DNA, 352 bp, Homo sapiens
tcgactgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggtaggagattaattacacatctgtttttcttaatttttttcctttccttttttttccctactcccaagcatgcctggatctttatgtatttcaatgcaacttaattttataacttcgatttattgaagtttagattggtgttgt

SEQ ID NO: 2474 - DNA, 802 bp, Homo sapiens
tcctctttccgggcacccagaagccaaagcccacagcccccttgtcccatcccagggatggcacccatcccaggatgaggctgccagggccgggcgggcaggccccaggccaggcctcatggagccgggccacctccccgtgaagagaggccacatcctcatggagtccagccgtgtcctctgtcccccgcctgttcaccatctgctccctggagcaggaggagtccctgcccgtcagaccagtctgtggaaagaccgacctccctcctgtctgtcggggacactggctctgccctgcaccaagtggtgtttcctcatcacgctttgttgcccagcagcctgtggggtgaagtcccccgtgcagctggcccagccccgtggtccccacgtcctgggtcatgccccagtgcaaagccggctgtgggccttgtctgctgagtcgggctctcacgttggcagggctcactgcggttttgaagtccaaactctccgtcataagcctcttctgccggtcctatctctggtgaagaggtgaaccgtaggcggggcaggggggctgctctgaacttgcctctccatgctgcagcccacctccctctggcagtggggtggccgtgctgggtcctggggcagggcctggagccccgccagcccatgacgcatttcatgagcccccaccttttgatatgcacatgcagctgaggctaccctgaccccacattcaaagtcggaaatccccaaaacccaagaccttttgagcactgatgggctcggggtgcacacagaacatttgggatttcac

SEQ ID NO: 2475 - DNA, 465 bp, Homo sapiens
ggtcattcttgtccagtttgataggttcaggaaattcgttgtacagctccacctccgtttcctgcttaagtgcattccgtgcaatcgtctggaacgcctgctccacgttgatggcctccttggcactggtctcaaagtagggaatgttgtttttgctgtagcaccaggcctgtgcccgctttgtggccaccagaacgcagcagtctgcacctctgtagaaggccacaccgagagactggaaccgttcctgtcctgctgtgtcccatatctgcattgtgactagcctgtcatccaccatcacctccttggtcagaaagtcagctcctattgtggctttgtactgattgctgaatttcttattcacatactggttcatgagtgatgtcttcccgactccagaatctcccaggatgataaccttcagcaacactttcttcctagaggtcatccttcaaacgcggccgc

SEQ ID NO: 2476 - DNA, 380 bp, Homo sapiens
gaaaaactgttaatttattgattcaaagttgttttttttctttttaaaaaacaatccccaatacatgcagttcagggttaagtatcacatttgtagcacattgttgagtctcaaaacaaaaatatgcatcacctgtataatcccatcacatctttttccagcctctacaatacctagttgggggtgttttcatttatacatccacatagctcagaagcatgttattaacggttgatctggcccgatgcttctccgccacctcagtcttaatttattaagatcactgacaaactttggcttcttgtgtgctcatgtggtccctgcttttgctttcggaagggtttatattgaaacgactgtgactctgatcggttattatc

SEQ ID NO: 2477 - DNA, 541 bp, Homo sapiens
gcagctggatgtgagagatcaatgtatgttttgtttggaagaggagaggggaattgtgttgaaggcctacgtgtgttcttggtttgtgaaggactctgtgctcaactctcactgccccctcagcaactgcagctttctgccgaggccttggcccggtcattcttgtccagtttgataggttcaggaaattcgttgtacagctccacctccgtttcctgcttaagtgcattccgtgcaatcgtctggaacgcctgctccacgttgatggcctccttggcactggtctcaaagtagggaatgttgtttttgctgtagcaccaggcctgtgcccgctttgtggccacctgcattgtgactagcctgtcatccaccatcacctccttggtcagaaagtcagctcctattgtggctttgtactgattgctgaatttcttattcacatactggttcatgagtgatgtcttcccgactccagaatctcccaggatgataaccttcagcaacactttcttcctctacgtcatccttcaaacgcggccgc

SEQ ID NO: 2478 - DNA, 515 bp, Homo sapiens
ggctggagtttgattacgtcagatctgtgtgtgtgtgtgtgcgtgtgtgtgtgtgtgtgagagatatgtggggtgtaactgtgtttgatggggttttcttttggcagctggatgtgagagatcaatgtatgttttgtttggaagaggagaggggaattgtgttgaaggcctacgtgtgttcttggtttgtgaaggactctgtgctcaactctcactgccccctcagcaactgcagctttctgccgaggccttggcccggtcattcttgtccagtttgataggttcaggaaattcgttgtacagctccacctccgtttcctgcattgtgactagcctgtcatccaccatcacctccttggtcagaaagtcagctcctattgtggctttgtactgattgctgaatttcttattcacatactggttcatgagtgatgtcttcccgactccagaatctcccaggatgataaccttcagcaacactttcttcctagaggtcatccttcaaacgcggccgc

SEQ ID NO: 2479 - DNA, 474 bp, Homo sapiens
ttttttttttttttttttttgacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgcgagcggccccctggctctctgcgttttgcctttaacactaactgtactgttttttctattcacgtgtgtctagagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccgtgactcaggggcgcccactctgcttcgattctcctcctgtggaagaaaccattttgagcatgacttt

SEQ ID NO: 2480 - DNA, 521 bp, Homo sapiens
atttatgcagggctttaattgaagtgagagaacaagctatgcagatagttgagggaagacattccaggcagaaggaacagtgaggaccaagcccttgggtcaagattataattagtgaattctaaggacagcaatggtagttgagaggttggaacagaatgaaagttggggagaatgatagaaagtgatgtcagagagttactcagacatgcaatgcaatagctttttttttttttttttttttttttttgcagttgcaagatttaatagagtgaaaacagagctcccatacaacgggaggggacccaaagggggttgccactgcctgctcgaatgccctgggtttatatcctgatcattgtccctccccctgtgccctcaggcgatagatgattgactatttctttacctcctggcttttagcctgattggtattttagtgagccctttttttaatacctgattggtcgggtgtgagctgagttaccagccccgtgtttaaaggtgggtgccatcacctt

SEQ ID NO: 2481 - DNA, 503 bp, Homo sapiens
ttttttttttttttttataaatatatgtatatattttatttacattatatacatggcatatctatacagttacatttacacttgacttagagtcaaagtcatatacacacacacaggacttggactcaaagcttttaatgacaagcatgcaaaatttcttagtatagaccctaagagtacccttaatataagtatgtttatttaaaaattctatgtatctactactgttaccagggggtccttgctcccagagctcccaagatggtggcaggccacttccaaaatggtggcaagcctcatgttctctgacctggggttcttggcctcacagattccaaggaatggaatcttgggccatgcggtgagtgttatagctctattagaagccgtgggtcatggaagagaactgtggcacccagtgactagtgttcagctcaattaggacgaacccagggacttagccatgcaggaacaatggcaagcctttagcccgatcgggagcg

SEQ ID NO: 2482 - DNA, 515 bp, Homo sapiens
ggtgattgtgataccaatctgaagtgggagcggccgcgttttttttttttttttttgcagttgcaagatttaatagagtgaaaacagagctcccatacaaagggaggggacccaaagagggtagtcgttgccggctcgaatgcctgggtttatatcctgatcattgtccctcccgctgtgctctcaggcaatagatgattggctatttctttacctcctgtttttgcctaattagcattttagcgggctctctttcttacctgatgggtcgggtgtgagctgagttgcaagccccgtgtttaaaggtggatgtggtcaacttcccatctaggcttagggattcttaatcggcctaggaaatccagctagtcctgtctctcagtgggggtggttactctcatgctgttctcatgatagtgagttctcacaagatctgatagttttataaagggcttttccccaccttcgctctgcacttctccttgctgctaccatgtgaagaaggatgtatttgc

SEQ ID NO: 2483 - DNA, 1607 bp, Homo sapiens
  misc_feature (1)...(1607): n = A,T,C or G
tttttttttttttttttattgtcaacatttttatttaagaaaacaggatttaacatgggcatttttcttccctctaagggcagcagcacataaatcatacatcagtcatccagtgatacaaagaggtggccaattgtgtctgaagtagtcacttgtaaaggatcacaacccaggcagtgttgcttttctgcaaacagaaggaaacagaaggctccatggtccttgaagattatccaagttttccactagttgtcaagatttctgtcccaacctcttagtcaccatttacagcaagaagagccagcaagtgaaaaactgttaatttaattgattcaaaagttgttatttttcatttttaaaaagcaatccccattacatgcagttcagggttaagtaatcacatttgtagcacattgttgagtctcaaaacaaaaatatgcatcacctgtataatcccatcacatcctttttccagcctctacaatacctagttgggggtgttttcatttatacatccaccataggctcagaagcatgttaattaacgggtgatctgggcccgatggcttctccggcaaccttcccctggccctggggcttcaacctcggggttattttttcctaaagggcaggatgttcactcagtcttaacttattaagatcactgacaaaactttgggcttcttgtgtggctcatgtggggccctgcttttgctttcgggaaggggtttatattggaaacgactgtgactctgatcgggttattatcccccccattttttgtaggaaataagtttgcttgtttctgtgggtgctcacacagtaacacaggtttcctaaagtaaccatttaaatctggaactggtattacacaggaaactgttaaccaggctgtcttatatctatttcagttcatataaaaaaactcttccaattgttgcttgtgtctcaaagtagttctgcttccatccttatcaacagagcacctgggagaacctaagtcatttccctgagtaggcacagaccacgaggacccgcggcacccagctctctctgggactaagagcctgactcgagagcaccacctttnagtccactgggaccaaacccaagtggcagcgccctcccccgggtacatcccagaacataaacttggtaccctctaatttatcccctcaagaagttaatttcctcctcaagagctacctttagatggattttcttattggtcccttttcttttaacagcccttcccctagccactctcttcaagtccccaaggattacgagtttgtctgtctcctctaatctatcagtctgagagcaccttcctctctgcaagggaacacatttgctttaaaccttgtgagtgctgacatgttacagaatgtctgggaggaggcctggctgagtgactggtgtttaagtgcctcaatgaacgacatcagcgcttctctagttggtgagaaggcccaggaaagcttggtctgcgtcatacactcaatagcttctcctacccagccacctaccctgccctacagggataggatgaaagcaaggcccagctgacagcatcccaggggagagtgaactgccaccacaccaga

SEQ ID NO: 2484 - DNA, 1957 bp, Homo sapiens
ttttttttttttttttttttttaaaaaatttggctccatttaataaaaaataattttaaaatagtataaaccatgaaagtatacgtactgccaggaaagtataaatataaccggggaagtataagtataaccaatgaaagtataagtactgccagtgttaccagggggtccttgctcccagagctcccaagacggtggtgggccacttccaagacggtggtgggccgcttccaagatggtggtgggtcgcttcccaagatggtggcaagccctcgtgttcttctgaacctggggtttcttgccctcacggaattccccaaggaaatggaaatccttggggccccatgtggtaaattgttaatagttcctattaagaaacccgtgggtccacagaagagaacccatggaaccccagtgactagtgtttcagctcgatttaggatgaattccagggcatttttagccttgcaggaacaatgggcaagcctttagccccaattggggactggcaatgggcgcctcgctggatcaggagcacagcacacaccttgccgggatccagagggatggaagtcagcagcaggtctgcggtggtggcaaacaacagcagacagcaaatggcagtggtggatggcaagcgaaagctcagctccagccataacaaacacggaccagaagagtgtgcagttgcaagatttaataaagtagagtgaaatagcatgaaaacagggctcccgtacaaaaggagggggaggggacccaaagggggttgccgttcgctggctcgaatgcctggggtttatagcctgatcattgtccctccctctgtgctctcaggtgataagatgatttgactatttctttacctcctgcttttagcctaattaggcattttagtgagctctctttcctacctgattggtcaaggtgtgaacctaaagttgcaaagcccccgtgtttaaaaggtgggatgtgggtcaccttcccaggctagggcttaggggattcttaggtcagccctagggaaatcccagctaatccctgtctcctcaggtcccccatcttcaacagggaaaaccctaaggtgctgttgggggaggtttgggccgacgaccgctcctaactgcttcctgctggaactgggggctagtaggaggtttttgcagctgagatttcctcaggaggggtgcccttcaatatcattaacatcggagcatgggctagcaggctggtcccaggggtcctgcggtagatcttaagttatggactgcatctggggctccatttgaagaacgatttgtagttttacagcttcaattctggaagatacaaacttaacaaggaggttaaaaagatacagggattgaaatgtatggcctgcagtgcaggggattatttctttggcacacttcacaggccctgactatctgcttgttagttttgaaaaggcctggtccagtaaataaagattcagccatctgatgagtgctatcaatgcctaagtgaaaggtttggtgaagagttttaagtaatttccattggttagctgcaggcaaaagtatttttccttctttggtggctaaccatcctgaggggaggaaactatgtcctcatgaggttccccattctatttctcctgctgagtactggggcttggtttcccagaggggattaccccatactagaggtccttctataagcatttctaatggagggtcctgccttgcggctcttttggcttcaatatccgcttggtggttcccttctacttccctttccttttttttttttttttttatgaccccggcagtgtaagactgccacctctttaggtttctgtacagccaataataatatcctaatggcttcttgatgtttgataggtgttcccttggaagttaggaattccctttctctccatattgctgcatgggcatggagaactaggtaagcatac

SEQ ID NO: 2485 - DNA, 5641 bp, Homo sapiens
  misc_feature (1)...(5641): n = A,T,C or G
gggccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgatctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatccaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccaatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaagaccccctctaccccctcctgagtaccccaaccagagtgtgcccgagaccactcctctgaaccaggacaccatgggagagtacacgcccctgcgggatgaggatcccaatgcgcctccctaccagcccccaccgcccttcacagtacccatggagggcaagggctcccgtcccaagaacatgaccccataccggtcacctcctccctatgtcccaccttaacccgcaagcgcctgggtggaggcagggtagggcagggccctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttgggggacttttttattttcattttttgcctaacagctttttgtttgttcatagaaaagtcttcgcttcatttttgatggctggctctgaagcactgtttgagtagaggtagaaggagggagcgaggaaccgtgaatgaactcgcaggcagtgccggagcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacggttaaatcctgctgtttacctaaacttgtatgtataatttttgggtgggtatggggaattgctttgctaaaaataagccccccagggtgtttcaaacttagagaagaccaagggacagtattttttatcaaaggaatactattttttcacactacgtcaacttggttgctctgataccccagagcctgattgggggcctcccggccctggggctcaccgcaaagtccctgggtgctgggtttgctctcccgctgttgccaggggctggaagctggaggggtctcttgggccatggacatccccacttccagcccaatgtacactagttggcccacgaccaaggggtcttcatttccatgaaaaaagggactccaagaggcagttggtggctgtggccccccaactttgggggctccagggtgggccaagctgcttgtggggggcacctggggaggtcaaaggtctcccacccacatcaaccctattttgttttaccctttttcctgtggcattgttttttttttttcctcctaaaaggaatatcacggttttttgaaacactcaagtgggggaccatttttggtgaagaatgcaatatttttatgtcatgtgatgctctttcctcacttgaccattggccgctttgtcctaacagtccacagtcctgccccgacccaccccaatcccttttctctggcactccagtcgccagggccttgggcctgaactactggaaaaggtctgggcggctgggggagggagtgccagcaatagtttcataataaaaatctgtttaggtcttcaaaggttaatttttttacttaaagtttttatacagcctcaaattgttttattaaaaaaaagatttaaaatgggggatggctttacagcagtttgtacggggctcttaagtgtttgaattccatgggagcttgacgggctttgcttgttttggattcttttccccctaacttttcctaatgggttaaaatcctggaatttacactgggggttcttttggccttttttaggcaggaacatccgtccgtccatctggcatctctgtcccatgactcaggggcgcccactcatgcttcgattctcctcctgtgggaaggaaaccattttgaggcatgacttttcttggatgttcnggaaggcgttattttggggtactttttaggggaggggattgccttttcggcaataaatgtatccatttccctgattgaggggtggggtggggtgggacccaggggtccctttgcacacagagcagctactttctaaagcccatatcgactgttttgcagaggatttctgttgtgctgcctcaggaggggagggctggtaagacgggggggacaaggtctctgtaaagccttgctctccagagggccatttccccttgcgccttctcccacagggccccagcccctctccccttgccccagtccccagggggtactctggagtgagcagtgcccctgtggggaagtcctgtaaatgcgggctcagtggaccactggtgactggggctcatgccctccaagtcagagttttccctggtgcccccagagacaggagcaacaaagtggggatctgaccctggtgaaaattatttctggatgaccttcatcaaaaaaaataaacaattccccaatggttccccaggtgaggggctttgaaaggccttcccaaacagnttccgtcgccccctagcgaactcccacccattgggcaactgccatgcagagacgtggcttggcccagaatggccctgttgccataagcaactgggaggcgatgggggcagtgaacagaataacaacagcaacaatgcctttgcaggcaagcctgcttcccctggagcgctgggctggtgatggccgttggactctgtgagatggagagccgaatctcacattcaagtgttcaccaaaccactgatgtgtttttatttccttctatatgattttaagatgtgttttctgcattaatgtaaacaaacatatcaaactaaataaaagcggagtctttattaaaaaaaagtcgacg

SEQ ID NO: 2486 - DNA, 2832 bp, Homo sapiens
ttttttttttttttttcattgttcttgttcaattttatgggcattggcgttcatctttttacagaaaaactcagcccacaccctaaaatgtaaacctttggaaaaaaggagaagtgcccccgttaaagcaagcctacaatgcagggggcagatcctaggaagggaagcagaactgccccgggttcccacccaaagaaagaggttaattaataatgggccaattattggggaagatggttggggaaaaaggaggaaaaaacgcccgctaacctagggaatacccaccaacccctggaaaggagccgccttctagaaccaaaggtaaaatccactagggacagatcctgttaagggttttccctttccactcttgtaagtagaatggctgatcctaccgggagttttgaagtttgggagcagggggggaaaaaaaaggaaaggaaaattgaggatttttaattttttgaaataccgggcaatttatcccattggcacatacccactgtattaatgcaaaatcaaacgttttgggaaaaatttaggacacaggaaggggaacctaggacagttttcccccctgggggaggatggaaaagcttttttgggctccttaaggtcttttggattaaaagggcgtacataattcttgtggtctactggtacagaatactgcccgcctagctgggatttcccccaattcctgaagtaacactcctgcaatcccaaacaggggttcaacccctcccacctttacagggccttgcatttacaggggctttaaacacataatcccagggatttctttacacttaatttatacattttaaattggttggcatatattaacatggtactataaggattcttttctaaggaaggcattacataaataaatgggatacttgttaaaaaagatctgatttagttaaaaagttacccagccattaaccggattggataccattaccaaaactcagccctgaatcagactggggtgtgagcctggtaatgggggcatgggggcacccagcccttccccaaggggtaagcccttcaaggatgggagggggaaagggggggtaaaaaagacccacaagacccaataaaaaaaaccagaaaaataagacacagatttaactgtaaacagttctctcttctctccagtggaacaaaaaggtttaaggtttcccatggcccactcccttttcaggatggactttccaccgttgggctttgtccccgctggccttatttcgcggggttcctgttggggtggggcagggcagacccccaaggagccatccacgggcaaagggcctggaatttgaattaacgtcaagatctgtgtgtgccgtgtgtgccgtgtgtgtgtgtgtgtgaaaagaatatgtggggtgtaaactgtgtttgaatggggttttccttttggccagctggatgtgaagagatcaatgtaatgttttgtttggaagaggagaggggaattgtgttgaaaggccctacgtgtgttcttggtttgtgaagtactctgtgctcaactctcactgccccctcagcaactgcagcttttctgccgaggccttggcccggtcattcttgtccagttttgataggttcaggaaaattcgttgtaacagctcccacctcccgtttccctgcttaagtgcattccgtgcaatcgtctggaaagcctggctccaacgttgatgggcctccttgggcactgggtctcaaaagtaggggaatgttgttttttgctgtagcacccaggccctgtgccccgctttgtgggccaattgtcttgtttttcgagggtcaatctttgttttcccaacaacaacaaaatggggaagtttttcaagggatctcgggggactgggcctgggatgaggaaacttcatcttctccagctattcttagtgttttgaaatgtgttgggggggcagtcaacattcaaataaccagaacgcagcagtctgcaactctgttaggaaggccacaccgatgagactggaaccggttcctgtcctgctgtgtaccatatctgcattgtgactagcctgtcatccaccatcacctccttggtcagaaagtcagctcctattgtggctttgtactgattgctgaatttcttattcacatactggttcatgagtgatgtcttcccgactccagaatctcccaggatgataaccttcagcaacactttcttcctagaggtcatccttcaaacgcggccgctgcgctgaggggctccgggccgggcgcggtcgcgagggctcccgccgaggaggagactaaacggaggacagaagcgagaaggtccaagttctggttcccagggaactctcccgagctctccaagccgccaactgccgccgctgcccccgaattcggggtgtttcaaacttagagaagaccaagggacagtattttttatcaaaggaatactattttttcacactacgtcaacttggttgctctgataccccagagcctgattgggggcctcccggctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaatgccc

SEQ ID NO: 2487 - DNA, 773 bp, Homo sapiens
  misc_feature (1)...(773): n = A,T,C or G
tttnnnccaaatctttaaacnnttnagggananaantnnttnaccnttggagtncnagnttnattnccctaaaatttttnnncttgccttaaggatgggaaanagntaaacnccggttntaaaaaaaanaanaaaaaaaagttnacaccnttcccgagaaccggttttnancanccaatcccaaaggcccannttgaaaggccacacaatgggttntattgccaaaaatttttgccaacccaataacctnccaagaaaacccaaggtaggggaatnaaaaaccggggaaggaaaattggatctnaaagggacaacagtgttncctaagaccacacagcannagatnacagagggncacaatactccacacaccacttgctcacaggntgattctagaacttgagtagtaaaaggccactggagaccnctacacttgacttccctattttacgggaagncaggcanccttcagaccaggatcctgaccacgtcaccagttggcaacagggaggaaccccctggagctcccatctgcccagagtccctgcccggggttaccttggtgctctgcttctccttcataatgatccgggacaggaggaccacccagatgggcatggtggccttnacggtgtgtgcataggacacgggcaccttccagatgcttacgtncgctgacacggacgcgaagtacttccgaaggcgagcggtagcacgtagcgcgggtagaagcgcggcggcagcagcgggccgccccttcctcgtccgaattc

SEQ ID NO: 2488 - DNA, 930 bp, Homo sapiens
acacggagtctccctctgtcacccaggctggagtgcagagcgaggttctgtctctaaaaaataaacatttaaaataaaaaatgagtaaaaataaaaagtcaatgtgctatctggactatactgtcaggaggtgaaagagtcaccttctcttccttgacgctactggcgcacacacagcagctatcagcacctgggatcaagcacaccagagaaggaaatacacaggaaacccacttcctcgatggcgtgcatcgtcaccgtgaggcattacagaggactgactgctgaaacgctggctgtcaggtgcccaaaagataccacaatgttaacatgcagctacagctcctcaacaaagcacctattctggaactagccaagaaaatggcgtgttcttggtgctgtacaactcaccaagtcgctgctgaccaggaaagccgagaggtccaccagaacccaggtggcgatcataaagaagacggcgtggcagcccaggatgttgagcagccggagatggtggatccgtgaatctcgcaagacctttttggagaaaatgttctgaagcgagaagcacagcgtggcggcgagggcgctgacgagtccccacatgtcaaaagacaactcggtgacggtggccagcaggacaccgctgatgatggggatgagtgacaagtataccttggtgctctgcttctccttcataatgatccgggacaggaggaccacccagatgggcatggtggccttgacggtgtgtgcataggacacgggcaccttccagatgctgacgtgcgctgacacggacgcgaagtacttgccgaaggcgagcggtagcacgtagcgcgggtagaagcgcggcggcagcagcgggccggacgacggatgccgactgggtccggggcccgagccacagtgcgcggcccaccgcggccc

SEQ ID NO: 2489 - DNA, 612 bp, Homo sapiens; identical to SEQ ID NO: 1601
  misc_feature (1)...(612): n = A,T,C or G

SEQ ID NO: 2490 - DNA, 472 bp, Homo sapiens
  misc_feature (1)...(472): n = A,T,C or G
cgggcggcgcactcctatccatgcgcccaaacccgaagcggcgggcccggccgccgcccccgaggccgggcgcggaacctaccggtgtgtgcataggacacgggcaccttccagatgctgacgtgcgctgacacggacgcgaagtacttgccgaaggcgagcggtagcacgtagcgcgggtagaagcgcggcggcagcagcgggccggacgacggatgcggactgggtccggggcncgagacgggcggcgcggggggcacgcgccaggcgcgcagcagcggcgggagcccagcgcacagagccaggatgtggcacagcgacacggtcaccgggaacgggaaggcgctcaggatcaccttgttgaccacgttgccgcccgcgctcagcgcgtaccacagcaggcacagcgccgccacccgcgcgccctcgcgcgccccaccactgctgctcgctgcgcccgggccccccgcgc

SEQ ID NO: 2491 - DNA, 392 bp, Homo sapiens
ctgactagaaagctagccaggtccccacagggttagacttcctggaacagaaacgccaggaagttgagggctccctcatatgtcgggaatttatggagtgatccaagcgtcttaagctctctggaattattttattgatttacatctctggagaatggagcagcctgactacgtttcctgggggaggttttcatctcggctttcaattttcacttgttaatgatctgtcatttgtagctaagtggagatacaagaaataaaatacttcattcaacaaaatagttagggtgcgggtcccatgagccaggtgccattcggggactgggagtatagcagaggacacggtagtcccagcccccgagctgcccagactcatctgaatgagcccagcc

SEQ ID NO: 2492 - DNA, 258 bp, Homo sapiens
cacactaacacccagggagaaacagttcagacaagagggaaagcactggcagaacctgaggtgagagtctgcttgtacatttatgggacatggcccatgtgccatgaacaaggggaagtaataatgatttctctaccttcctgatggctcatgtttgcctgacataaatattgacatttccttctatattccccaagtaaataaatagagctgcgttctgccattgtctgtactctaaagagtttctcacaatctggc

SEQ ID NO: 2493 - DNA, 871 bp, Homo sapiens
tttttttttttcctttttttttctttttttttttttttttgcaagttaaactcttccttaagttctactttgaaaggaatgacctgttctagaattctggacttgagaggcaccttggaccttgttctgtttcctccttttctcatatggccctgtgcttccccaggctgattcacattcctgtgtgcatttcaggttagttgcttctagctgctgcgtagtatcccatagtgttcatccgccatgtttcattcacctgctccccagcaaaggggtccgggttgtctccaaaactctgctccacacacgatgctgcagtgaaaattcttgcccatgtgccctctggtcctctgtgagaattgttctgggacacatctcagaagtggattgcggggccataggggacacatgcacttcattcgagcaagtttttccagttacaacagcaacgcagaagagctaccgtttctctacgttcttgccaacacttagcattgcccaactttctcatatttggaacacatttatctggagtccctggaaactgtcatcctccaaccgtccctaaggaagatggagtgtggggtttcaaagaaggtatgactcagaaccagatggtcatatgctagagaacgtccctattactgcagaaaggtctgtgggacagcattgctgcaaagctctacccggagcactttgatgattttgctcattcacagagcatcactcacccggatgaccaaggaccgcctagctgagctttgtccttccctgtctgctccctgcatttgagtcccaacacagcagccagaggatgcttttaaactcacatcaggacacttgtctgctccagacctcaatgattcctcac

SEQ ID NO: 2494 - DNA, 3366 bp, Homo sapiens
gagttctcgcggtacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctcttaatcgtccctctcctgcttcagggtggcatcgtgtgtcccagagtgccggagcgagtcccagaagagaggcgaggctaagcccagagcgctgggttgcttcagcagggaagactcccttccccctgcttcaggctgctgagcactgagcagcgctcagaaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaaaaaaaaaaaacccgaattcaatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaaagcccacctgggctgggcgccggtggtcacgcctgtaatcccagcactttgggaggccaaggtgggcggatcacaaggtcaggagttcgagaccaacctagccaacatggtgaaaccccgtctctactaaaaataagaaattagccgggtgtggtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcactttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttaaaaaaaaaaaaaaaaaaaaaaaaaaaaaaaaaaaaaaaaaaaaaaaaaaaaa

SEQ ID NO: 2495 - DNA, 535 bp, Homo sapiens
tatttggctttggacaaaaacctagccactctctgcctccgtctcttcaactcttagtggaagaagtaatagtccttacttcaaagagctgtttatgaatgaagtgagtaaatactcagctagccctagaccacatacaggaaagggtccatctctgttagctgttattatttataacatggcatgactgttagtatttgcatttgcattagtgctggcatggtgtcagcattgttggtgttagtgttcatattaatattagttttagtttaagtgttagtgttggtattggtgtttgtattagtgttggtgttagtattattgttagtgttggtgttggagttagtgttagtgttgggacatagcatttgttttattatggaattggtgtatatcatgaagccttgctgaactaagttttgtgtgtatatatttaaaaaaaaatcagtgtttaaataaagacctatgtacttaatcctttaactctgcgggtagcatttggtaggtagtgattaactgtgaataataaatacac

SEQ ID NO: 2496 - DNA, 1386 bp, Homo sapiens
  misc_feature (1)...(1386): n = A,T,C or G
cgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgaattcggggctgctgagcactgagcagggctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctgccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcttccttttttctcttctgtccatcagtgcatgacgtttaaggccacgtatagtcctagctgacgccaataaaaaacaagaaaccaaaaaagctggtattctctctatgcaaaatgtctgttttagttggaatgactgaaagaagaacagctgttcctgtgttcttcgtatatacacacaaaaaggagcgggcagggccgctcgatgcctttnctgtttagcttcctccagaggagnggacttgtaggaatctgccttccagcccagacccccagtgtattttgtccaagttcacagtagagtagggtagaaggaaagcatgtctctgcttccatggcttcctgagaaagcccacctgggct

SEQ ID NO: 2497 - DNA, 550 bp, Homo sapiens
tatttggccttggacaaaaacctagccactctctgcctccgtctcttcaactcttagtggaagaagtaatagtccttacttcaaagagctgtttatgaatgaagtgagtaaatactcagctagccctagaccacatacaggaaagggtccatctctgttagctgttattatttataacatggcatgactgttagtatttgcatttgcattagtgctggcatggtgtcagcattgttggtgttagtgttcatattaatattagttttagtttaagtgttagtgttggtattggtgtttgtattagtgttggtgttagtattattgttagtgttggtgttggagttagtgttagtgttgggacatagcatttgcgttggtgtcagtgttggtgttggcagtgacattagtgcttgccttagattggtgttagtgtcggtattgttgttagtattgatgtgggtgttagacttagtgttgggacatagtattactgttagtagttatggtgtaagtgttagtatttggattggtacctgggtaaatattagtg

SEQ ID NO: 2498 - DNA, 1093 bp, Homo sapiens
  misc_feature (1)...(1093): n = A,T,C or G
ttttattncccccntctttccttttctcttgtttcttccccggggggncgggaacaaaggaaagaggggggtcgtttctcttttaaaccaattttaatcaatttatggtggcccctgggggaagnnnccngccaggggaggggtgggtcggcccgggaaaagagggtccccccctttccccataccttggtttgggagaggggggggaaccctttccccctttgggggtttgcccccccccccctaaattgccccctgaaccaccagtccaaacaaggagaggggggggagtctttgccccccccccccttttgaaaggttttctttctcatggggggggaacaagggaagggccacctttcccatgtgccggttttaaattggccaaatgctttcatcctgtgcccctaaccctgccaggtgaggtgaaaggcagcaatgggaagttgaagtcctgcttgggcctcctttcccaatgggctgtgttgactgttgcttccacacctctccaaatggtcccaggaagcagggagagttggggaaggcaagatggaaagacaggaagaccaaggcctcggcagaactctctgtcttctctccacttctggtcccctgtggtgatgtgctgtaatcttttctcacccaaacccctccccacgcaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 2499 - DNA, 587 bp, Homo sapiens
  misc_feature (1)...(587): n = A,T,C or G
cacgancggcacgagctgggacacaggccgattgnagggcggggttgccttcaatcctggccactgatcttaatcgtccctctcctgcttcagggtggcattgtgtgtcccagagtgccggagcgagtcccagaagagaggcgaggctaagcccagagcgctggcgttgcttcagcagggaagactcccttccccctgcttcaggctgctgagcactgagcagcgtcagaatggaagccatcgccaaatatgacttcaaagctactgcagacgacgagctgagctttcaaaaggggggacatcctcaaggttttgaacgaagaatgtgatcagaactggtacaaggcagagctttaatggaaaagacggcttcattcccaagaactacatagaaatgaaaccacatccgtggtttttttgggcaaaatccccagagcccagggcaggaagaaattgcttagcaaacagcgggcacgatgggggcctttctttatcccgaggagagttaggagcgctcctgggggccttttctccctctctctgttcaagtttgggaaacgatgttgcagcatttcaaggtgttcctt

SEQ ID NO: 2500 - DNA, 626 bp, Homo sapiens
gaagcttttccccaggcgcctttgtcatgagtcagtagggagtccagggcgctggcccgggggccccattttcaaatgtctccctctatagaaagagtgacccacggttagtgccttggtggttttttggcaaaatccccagagccaaggcagaagaaatgcttagcaaacagcggcacgatggggcctttcttatccgagagagtgagagcgctcctggggacttctccctctctgtcaagtttggaaactgatgtgcagcacttcaaggtgctccgagatggagccggggaagtacttcctctgggtggtgaagttcaattctttgaatgagctgggtggattatcacagatctacatctgtctccagacaaccagcagatattcctgcggggacatagaacagggtgccacagcagccggcatacgtccaggcccctctttgactttgatccccaggaggatggagagcgtggttccgccggggagattttatccatgtcatggataactcagaccccaactggtggaaaggagcttccacgggcagaccggcatgtttccccgcaattatgtcacccccgtgaaccggaacgtctaagagtcaagaagcaattatttaaaaa

SEQ ID NO: 2501 - DNA, 372 bp, Homo sapiens
tcaattctttgaatgagctggtggattatcacagatctacatctgtctccagaaaccagcaagatattcctgcgggacaatagaacacggtgccacagattgggccatggctttcatcctgtgtcccctgacctgtccagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttcaaaaaaaaaaa

SEQ ID NO: 2502 - DNA, 639 bp, Homo sapiens
ggaacccatctggcctcggaggtggccagtcagagaccaggaatgcaatgtgggttttcctgctcctgttttgcagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaaaaaaaaaaaacccgaattca

SEQ ID NO: 2503 - DNA, 542 bp, Homo sapiens
tggttttttccccaattggggccccccggggagaggcgccgaaaactttttctcacccaaaccctttcccgggcaaaaccaaggctgccctccttttttccgggagctgtgaacaccctgggccttacagtcccaaagcggccgatgggagtctccctccgactccagatatgaacagggcccaggcctggagcgtttgctgtgccaggaggcggcagctcttttgggcagagcctgtccccgccttcccctaatttttccctaaccctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttaaaaaaaaaaaaaaaaaaaaaaaaaaaaaaaaaa

SEQ ID NO: 2504 - DNA, 298 bp, Homo sapiens
  misc_feature (1)...(298): n = A,T,C or G
ctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttnctgtttagcttcctccagaggaggggacttgtaggaatctgccttccagcccagaccccagaagagaggcgaggctaagcccagagcgctgggttgctttcagcaggggaagacttcctttccccctggtttcaagg

SEQ ID NO: 2505 - DNA, 286 bp, Homo sapiens
ctatatggaaataccctcgatttgccaagtagagcctttagccggtcacatgtggtttctgtccctcccaggtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacaggtaagcctcatcagggtgagatgggatcatttttagttaagaatag

SEQ ID NO: 2506 - DNA, 212 bp, Homo sapiens
ctttgtgggaagcagatgttgaccagcttgccttccttccttaggtggttttttggcaaaatccccagagccaaggcagaagaaatgcttagcaaacagcggcacgatggggcctttcttatccgagagagtgagagcgctcctggggacttctccctctctgtcaagtaagtatttcctgctgcagttgcttggaatcctgtctctgatag

SEQ ID NO: 2507 - DNA, 207 bp, Homo sapiens
  misc_feature (1)...(207): n = A,T,C or G
gcagagtctgtgcctgtgnggtagacggctngcgggacaangcgctgccctcgcagagcagccttggggtcgccggccgctcgcagcgttgtggaggggcgggccggacgctgagggacagcttgcgccacgggtgnatttgtgtgtcccagagtgccggagcgagtcccagaagagaggcgaggctaagccagagcgctgggttgc

SEQ ID NO: 2508 - DNA, 165 bp, Homo sapiens
agacgttccggttcacgggggtgacataattgcggggaaacatgccggtctgcccgtgaaccggaacgtctaagagtcaagaagcaatcatttaaagaaagtgaaaaatgtaaaacacatacaaaagaattaaacccacaagctgcctctgacagcagcctgtga

SEQ ID NO: 2509 - DNA, 4770 bp, Homo sapiens
aaccaggatggtctcgatctcctgacctcgtgatccacccgtcttggcctcccaaagtgctaggattacaggcatgagccaccgcgcccggccttagtgaacaattattatcaggatgatcagcatccatttttccatcacctggcaacaacaactagcatttctcaagggaaatcccctcctcattcataagcaccatagatggagtggaacagtccccacctcagcttaaggagggctaaataaccaaagcataaagcaatcagtccactacacttcagtggacccaatgatgactcattttggttcaataaatatcaagtccagaacttttgtgcagaactgtggaataaaaaaagttatctttgtcacagaatatttatatttaaagaggggattctaaatatcccaaaaatatgaatctgagatagtggtaagataggaatgggttgccatttgcagtatttgttgggtgtgtgcaactctgcatactgctaaggcaagtccagcctccgtctcacaccaacaggcagatttccccaccacggcccttaccatcttgtgctctaaccccagattttcagtctactcttgctaaccatcaattcttcaagggcaagagccatgtctctcatatccctggatctggcttgctaaataattattcatgattttatctgagtagaaaaagagccaagaactgagaaaaggagacattcttggttctcagtcactgaggagcttctgcagtaccagcctttctgctagctgcagccacagcttcaacagctccacctccttgttctttattcttgctttcaccttgttactcagcagcaggggtgtaaatgtgacagtgccatgtcaacaccaacagctctgacctgggcagccttcctgagaaaatgcagccattcctcctcctgttggcctttcttctgacccctggggctgggacaggtaagtgactatccctattccagaggcctgaacccatcttataagataccctgtacccatgagcactggtcaggaattttcctcaatctgagcccacctcccattccacacccagacttataaatctgaggctagatagacactcagcaaagatcgaaaaatgaagggtgttccctaaaaggtttaatgggtgttagcctctccctagacctctcctttatgacctggagtgtggattgttcttagaaaggcatttggtagggaatgtgaagctaaaaaagataagtaattattactctacactccaacccaggaaagaggagctcagacaccaagttgcagtcataggagttgttactggactcagcttaagaaccacttattcagtgcccccacccagtcacccctgccaggagggaagcccatggtgcaactgatctcagagatggcaagatgactgtgtccatagctctcccattaccttggctccacctgggctttgcgattcatttttagttgatttctccacttccttctgcctttgcaggccctcagctactccactgacctggtgataaccccctctaacatccctgaggtcctgaatcccaccagcactacccccactaaacctcagccaaaggctaattggaggctattcatttatgcaccaaacaacacttactgagaacctagaatgtgttcagccctggcacatgagaattttagaaaatccaactccagaagctcatgggtagatcattagaaaatggcaccaatcaggaggacagcagaggctcagaggaatcagagagactcactaaaaaggaggagcctgggaagtcctgtccaggatcctctggggctctaccactgtgaaaatagatctttcttcctccatgtgtgtttctgcagtaggatgcagaagtcaagcactgtccattctttctgagagaaggttctgagacttaaagttcagaaaagcttgctctgcctgcaaggagtactgcctgcagagctcaggaggacccctccctcactgtctgcagcacacaaaacacttcaccctcaatcactgtcgtcctaagccttctctcctgactgcagccatccccagctactttatcttccagtctttcctttcagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaaggtaaggagcagcaccagctcacctcctgagttccccctacagggacccttgttttctcctggggactgcagcccaggggagcttccagagttcctggtaacacaagcccatgaaagctcatcggagcagccacctgggaataggactaagatgatgaaaggctgagaaataggacagggtcagagggtcagagggtcagaggtcagagcaagtggcatggtttcacacactggcccaataaggcagtagtaaaggttgaatccatgcattaaggatcaaaatgcaaactcgagcaatttcatgatatttcctgaaggcaagagagagcccccagaagccctactcttcatgtctttgtgaagtagagggcacagtcactcagccctggagccctcctgtcccttcaacttcccctcagctgcagccctaccctgccacagctgtcatctgctcttcactgctcctgggctctatcccctgtgactccacccccatcctcactctgctctctgtgcagctccataaatgtcaccttgggggcccacaatatcaaggaacaggagcggacccagcagtttatccctgtgaaaagacccatcccccatccagcctataatcctaagaacttctccaacgacatcatgctactgcaggtgaggcacactcctgccactcttgctcttcttggtccagttggttccactcccactgggatgccggccctttcctcctttccatcctgacctcttggtcagttcctgtgccttagaggagagggaagattgtgcagccccatcactgtgtcggggcccagaaggccattgcctgacctggactttcttgcttcttccccaccagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaaggttgggtttccagcctctacccagaaagaccacagggagagaggaacttgagggagttctggggtatgacagtggccagatctttatgctctcagcccagagcttgggcagcctgtgtccccctggaatctagtctttagtccactccttgggtggactggggtggctggaggggaaggatctgtcatccgacagtcacttatcaccaaagtgtccgtgagaattgcagagaaaggcttggtctggggagagccagaaagcacagccagggccatgctggagacccaggactgagggaggtgagtgacaaggcctgcctggcactgatgtcacacaaaatccataacagagaccacccatcccagggaacactagctcagtctttcctctctctgttcacagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaatatgactgaagtcttatttattcactgaaccatcttcaatatgcaacaacactgctccaggcagccgtctgctgtcagttctggcttttgcttcttcctttctcccccagccctccctcctccctaaaccccatgctgtacagttttttcactaatttctcaatcacatgtctttgatactgaaccctctgttagagctggtttgaactccattataaacaacaatcttcaacccctctacccttcacaaaaaaaaataaacctctctggacgttaggaatttcttatcgcctctaaaccaactacctactcccctaacaacgtagcagagaatggagcagggcagtagcagatggagtggaaaggaaataactccagggactcagaaggccaggggcatgccatgagtactcagtttcctattttcagggcctgtccctccaatgggggcaggcttctcccacagccaggtctgcctgcagcttaggaggttgagatgctcctctgcacctaggtccctcttccctgccctgggcccagccctgagctcagtcaaccttcttccttcctggccggccttcccagctcccaagagtttttcacccaagtgcctggctaccagtttctttcccttctagatcaccctgttctgaagccagcctctctctcatgtccctaacagagttcccagctctgtgtgaattcacacaccctttgaaagaagcaggacactgct

SEQ ID NO: 2510 - DNA, 4751 bp, Homo sapiens
gaattctatattttgagatataccattcctcatagaaaaatttcctcacagaaaatataaaggtggaaacaaatcacaagaatcgaaccatgtagagagacttagttgtcttttaacagaattgggcacgggctgttcagaaacaacaatctttcacatccattataatgatagcattagtgtagtttgtttagcaaatgtttactgcgagcctgttatgtgctgagcctgctatgtaagaagtgtggctctctggacaggagacagaatactaaacaacacaactactgatctttggctgcctggcatgcttcctcacttcatatggtatcagcaatttagcaccacaaacgtcctttagagaccagccctttctcattcttggttctagtggcttgagtagactgaccccactacccaagtggatttgactcctagcaattcattaatctagcccataaatgtcaagtacaggactttattgaagcattcagaaagaggaataggggatgttagaatctctagaaaggaagctatgataataaatgggttgctagatgggtctagtagatggtggccatgctttgttactgccttgtgtattgtgctaccatagccctccccaaactgtactctggctcctggcatttccgtctcttcaaccagatggtcagctctctaagtgaaggagacacatctccaacatgcttggttctagcacaacagaagggctcaaacacatacctgctaaagaaactatcctgatggatttagcagcatggccatgaggcattggcggttctatcactgggaactcaggtttctggtgctccagtacctctactggctgataccacatcctacagttcacttcataggcttgggttcctgctctgggctgaataggtggtccactctgagtcatcagctgtggtgatgatgtggtcactgcatgattctcacacaagcacccagaggacgtcatcaggcagaggcagtgggggtgggcagcatttacagaaaatctgtgatgagacaccacaaaaccagaggggaacatgaagtcactgagcctgctccacctctttcctctcccaagagctaaaagagagcaaggaggaaacaacagcagctccaaccagggcagccttcctgagaagatgcaaccaatcctgcttctgctggccttcctcctgctgcccagggcagatgcaggtgagtgaccgtcttccaacctcggggcccaacccatcccacaggtctcctgccctttctccacattcctgatccatctatctaccaggaatgttctgaactccagctcccattctaccaagaccccccaagtgtgatgctggataagctatcagcaggaatggcagagcagcaggccattctcaagaagagccagtgggtactatcccttccccagagcccacctttgtcacctggagagtaggactttcctagaagtaaatggcagaggatgggaaactagaaaagagaaatattaaattattctagagtaggcctggcttctgtttctgggataagacaggtgcttctctcactgtacttaggagagaaacccagagctcagctgacagcagaattggtacaatcactgtcctcagaacactgttaatgtgtttgctcagtcccattctccaactctgcttttcttccctggcctttggtggctcccctctttccaaggatgaggcactacggcaggccccagcttccctgctttctagaattccaccagcactgctctaccagccctcatccagaggctaactggagccagtccatcatgcagccatgaacatttactgggcacccactacatgtcaggctctaggaaacaggatatgacagtatctagatccctccacttacaccctggccattagaaagcagcactatcctagacaccacaggactcataagggtcttggaaactcacctgaaacaaagcaaagtcaggagaggaatgatcaggagcctctgggatttcactgtccctaagacaggtatgctcgccttcaactacatatggaagaaagatttacagaccaaagtctgctgttcttccctttttcagagcaggaaattgaagccccttcctccaggccactcccaactccaggctatcccaggctcccaaatgcccaggagttctggagccactaagcaggtgcccacccagcagattccatgggtgcccacaagcagacagacttttccttcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaaggtgaggagcagaaaacagcccacaccctcctggaaacactccacagagacccctgccttcttcccaaggagctccctgggctcctgtgaacacacatgccaggaggtctccttagagggtgagaaaagggcagttaagtttgtggagagaggggaaggttggttccagaggtgctgctgaagtaagaaacagcagagtgaccaagcctgccatatttagaactgggggcatactttggcatagaatacaaactgaagcaattccacctgtgtttctagggggaaccgaaccctgagaaacctggtgcaattaccagaattccaattcctggggaccgactgtccttaatttcccctcagctgcagccctgccccagctgtcacctgctcttcactgtctctgggctgtatacactgtgactccacccccatcctcactctgctctctgtgcagctccataaatgtcaccttgggggcccacaatatcaaggaacaggagccgacccagcagtttatccctgtgaaaagagccatcccccatccagcctataatcctaagaacttctccaatgacatcatgctactgcaggtgaggcacactcctgccactcttgctcttcttggtccagttggttccactccccctggaatgccggcccttccctcctttccatcctggcctcttggttagttcctatgcctcagaggagagagggaagattgtgcagccccatcactgtgtcggggcccagaagttcgttggctgacctggactttcttgcctcttccccaccagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaaggtaagactatgcacctgcctggattggctcttgggagaaagatgtttggggaatatctgagacctggagactcaagtagtgggggactccttcacccactagactgtgatatttctctctggaaagagaaaaggggactagactgagctggggagaaattagggcctctgcaaacttaccaagaggccttatggtggatggtgccttctttggaaggatgaatttgcaacactccacccactccaggtcacagatattaggaaactgtgcccatgggggtgcagctaattataaccaggtgtgtcttcagaggctggtacccaacgtggttaatgggctggtcctccatggtggacatcagccctccttgcccacttctgggtccttaaacagccaacggtcccacatacctccgatctcaggatctgggggacatgacggaggctggcccctgggatgaggtgaagcagtaacaatgtccagggccagagcttggcagctggggccaccagcggcctgccctgccctctggtctcccacatgtaggctgtgcaagttggccttttctaaaagggggcttgagatggaagagagggcaggacccggaggagcatcagctcagtccttccactctctattcacagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaagctggtttcttgtttattcattgaccctcattctcaggcaccacatctgcgctatgcaggccaatgacacaattttgctgttttctgctttctcctctcccctcaccccttgccacctccccaaacccccacatgaagctgatactcagctccttcctatccacaccagtttctccagggcctgccttctgccaaggctgaagctgagcaccatcaggagacaacatggaccactttggtcctggggctttgggtaaacttcttacctccttctccagtgttacattgacagagaaaaaagggataataccatgggacctaactcctcatcccactggggctcctcattctcccctgggcttagtttctctaccctcctctgagctc

SEQ ID NO: 2511 - DNA, 1244 bp, Homo sapiens
ttttgagatggagtctcgctctgtcacccaggctggagtgcagtggcgcgatctcagctcactgcaagctccacctgggttgacgccattctcctgcctccgcctcccaagtagctggaactacaggagcccgccaccacgaaaggctaattttttgtatttttagtagagatggggtttcaccatgttaaccaggatggtctcgatctcctgacctcgtgatccacccgtcttggcctcccaaagtgctaggattacaggcatgagccaccgcgcccggccttagtgaacaattattatcaggatgatcagcatccatttttccatcacctggcaacaacaactagcatttctcaagggaaatcccctcctcattcataagcaccatagatggagtggaacagtccccacctcagcttaaggagggctaaataaccaaagcataaagcaatcagtccactacacttcagtggacccaatgatgactcattttggttcaataaatatcaagtccagaacttttgtgcagaactgtggaataaaaaaagttatctttgtcacagaatatttatatttaaagaggggattctaaatatcccaaaaatatgaatctgagatagtggtaagataggaatgggttgccatttgcagtatttgttgggtgtgtgcaactctgcatactgctaaggcaagtccagcctccgtctcacaccaacaggcagatttccccaccacggcccttaccatcttgtgctctaaccccagattttcagtctactcttgctaaccatcaattcttcaagggcaagagccatgtctctcatatccctggatctggcttgctaaataattattcatgattttatctgagtagaaaaagagccaagaactgagaaaaggagacattcttggttctcagtcactgaggagcttctgcagtaccagcctttctgctagctgcagccacagcttcaacagctccacctccttgttctttattcttgctttcaccttgttactcagcagcaggggtgtaaatgtgacagtgccatgtcaacttaaaccaaaccagataattttaataaaccaccttctataatgacacccatcaaaaccagaaggggacaagtctaggaggtctctgaggttactgtacccatccctccttcatctccctccagcatttgtttctggaaggagtcaacaccaacagctctgacctgggcagccttcctgagaaaatg

SEQ ID NO: 2512 - DNA, 918 bp, Homo sapiens
gaattcggcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggccattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaaaaaaaaaaaaaaaaaaaa

SEQ ID NO: 2513 - DNA, 692 bp, Homo sapiens
  misc_feature (1)...(692): n = A,T,C or G
ggaagtccccaaaaatgtccgcttgggcgccccaattataaataccgggagccaccaccgagtttatccttgtgaaagaccccatcccccctcacgccattaattctaggaattctccaacggccatctgggtttggcagctgagagaaaaggcccagggcccaagagtttgtgcaccccttcagggtacctagcaaaaaggcccaggttaagccagggcaaacattcagtgtggcgggttgggggcaaanggcccccctgggaaaacactcacacaccctacaaaaggtgaagatgccagtgcaggaagatcgaaagtgcgaatttgacttacgccattattacgacagtaccattgagttgggggtgggggacccaaaaattaaaaaaacttcctttaagggggactttggaggccctcttgtgtgtaacaaggtgccccagggcattgtttcctatggacgaaacaatggcatgcctccccgagcctgccccaaagtttcaagctttgtaccctggataaaaaaaaccatgaaacgctactaactacaggaagcaaattaagccccccctgtaatgaaaccccttttttggagccaagtccaaatttaccctgggaaaggggccagcaactgaataaaaaccttttagctgaggggaaaaaaaaaaaaaaaaaaaaaaaaaaaaaaaaa

SEQ ID NO: 2514 - DNA, 490 bp, Homo sapiens
ctcatgctacctagcagcaaggcccaggtaaagccagggcagctgttcagtgtggccggctggggttatgtctcaatgagcactttagcaaccacactgcaggaagtgttgctgacagtgcagaagggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaaaaaaaaaa

SEQ ID NO: 2515 - DNA, 197 bp, Homo sapiens
agggagacaagggtggtacgagctcggatccactagtaacggccgccagtgtggtggaattcgcaaggaggaaacaacagcagctccaaccagggcagccttcctgagaagatgcaaccaatcctgcttctgctggccttcctcctgctgcccagggcagatgcagacttttccttcaggggagatcatcgggggaa

SEQ ID NO: 2516 - DNA, 825 bp, Homo sapiens
ttatcaattataggttttaaatttaccctggcttttaaagaaatagggttcacttttttctttactacttctatctttctctttctctctttctttctcctttctgtctttgtagatggattttggaaacccagtggaaggatgttcgctcattgcccccatttgccactataggactatgcgcctcccttttatttactcaatttgcttttatcctgatctattatgttgttgtagacccagttccagttgttacaatactgggttatcagttctaaggccctggcaagggtggtgtggaacaggtcccacataactgcccatgtcgagagctctaagcctaaattgggagggacaccagggacaagactcctgggttcatagcctaggggcctaaggtcgcagcatagagcttccttagatccctttggagttactaatacttgcgagaggaagggaaagtctgaaccattagtacctaggaggcagggatcagaggaagtagattcagaggtaaggagaattttgggactacactttcaagaaagtcatggtcaggacccaggaggtatgggtcagaaggaaaggtaggatgcccgcatgggcgactgttgagtagagacttctgtgcgccatgatctcaaccagctaatgccgggagtttgggatgactgctttctgcctctagtcgcccttggcttccccaggaaaactgaaagtggaagctggctccaggcagaccaatgttcccaactcagaagggttggggattgttagaaagcccttccccagatagcttcacacatgagtcttaagtctggcgcc

SEQ ID NO: 2517 - DNA, 405 bp, Homo sapiens
ttttttactatttctatatttctctctctttgactccctctttttctctctgtctctcttctctgtctctctctctcctctctgtctctctctcttagccattacaaacttggggcaggtatacagcccatgttgagagctgtatacctaaattgggagggacaccagggataagactccctgggtttatagcctagatgcctaaggacacagtgtagagcctccttagatccctttggagttacaacttgctagaggaaaggaaagtactgaaccattagtacctaggaggcagggatcagaggaagtagattcagaggtaaggagaattttgggactacactttcaagaaagtcatggtcaggacccaggaggtatgggtcagaaggaaaggtaggagcgccc

SEQ ID NO: 2518 - DNA, 370 bp, Homo sapiens
  misc_feature (1)...(370): n = A,T,C or G
gtagaaaagaaaagcctggattctcccctaaagcctccagatggaacacagccctgcctccaccttgatttcaggacttcttaccccaagaatctcacccgggaggaaccatctatcatcctgccttgaaggtagtttctgctggntctggtcagacctttgtatgatggattttggaaacccagtggaaggatgttcgctcattgcccccatttgccactataggactatgcgcctcccttttatttactcaatttgcttttatcctgatctattatgttgttgtagacccagttccagttgttacaatactgggntatcagttctaaggccctgggcaagggtggtgtggaacaggtcccacataact

SEQ ID NO: 2519 - DNA, 1941 bp, Homo sapiens
  misc_feature (1)...(1941): n = A,T,C or G
ctatatgttttgtgcattttgttttgctctgtatatagtatatataatggacaaatagtcctaattttncaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttaggagacactcaaattacagtctgtgttatgtatgtataccatttattcaatgctactgtgtatataatggaaaacttaagtccagtttgaaacatctagtctttctaggtgtttaaaagtgtacaacagcctgtcgcagtggcgcatgcctgtaatcccagcactttgggaggccgaggcaggcggatcacgaggtcaagagatcaggaccatcctggccaacatggtgaaaccccatctttactaaaaatacaaaaattagctggtcgtggtggtgcccacctgtagccccagttactcgagaggctgaggcaggagaatcgcttgaacttgggaggcggaagttgcagtgtgccaagatcgcaccactgcactccagcctggcgacagagcgaggctccgtttcaaaaaaaaaa

SEQ ID NO: 2520 - DNA, 473 bp, Homo sapiens
aagttatatgaaatatctagtcttttcagctatttagaagtgcttgatgtatttaaaagcagaagtagttgaataacactttgtaaatagcttttaaagactgatgggaaatactgtatttggaagtggaattgttaaaccacctctctgaacagtgtgctctctacttgttcgttgagttgagggaggtaggaggaaagaaactgcaaaaggtgttttgctagtgtgtactagaaaatttcagcttatccattgccttatatgttatgtgcttttcatttaactttgctatactgcgcatattgtgtatatactggacaaatgagttgttgagtgtatattttataatatacagtctctatatattaaattttataatatctagtcaattttgtaacatctagtctctagatattaaagagattgccagtgtatgacaaaagtagtgttaataaactaacccattttgtaaa

SEQ ID NO: 2521 - DNA, 592 bp, Homo sapiens
ccagagcgcccataacttagacatactaaatacatgggacttcaaccacaggaacagtatagccattaaataaatattcattgtgctgtaagaaggctttctaatcttaactttctgtattttatatagaattttagtaatttaatatataaaacaaaatacattccatgtagcatcctacccaattagaaatattaacaactgcggtattctactgtgggctggcagcagtcatgaaaaatgatcaattaggtctgttcaggcccaagtgacaagtccgatccattctgagtggaggctgcgtttgtaacagtttattctatctgataacaacagcattaacactttcaatattttggttaaaatttagttatcttttatactccaataattcatattactgaggagatcaccacccctcccatttctaacttgcattttaaagccacttggatccctggaaatgattattgctggcagagcttggatggaggaggcaggtttgcagccagtttagaaaaatgcaatcctactaaataaaacacgcactcactgttcccggaagagctgaggcagaattccacaagaaaag

SEQ ID NO: 2522 - DNA, 911 bp, Homo sapiens
  misc_feature (1)...(911): n = A,T,C or G
nttttttttttgggatggagtttcactcttgttgcccaggctggagtacaatggcatgatctcaactcacggcaacctccgcctcctctagaatattgatccagatccagatttctatattaaccatcccttgtttcttctgagcttcagccagagatcactggttggttcacagaataagtagggttagtctaaaatacagacaaaaacttaaaaacaactaataaaactagaatttaatgacaagtgtgataagttttgaaactctccagtcttcatttttgttaaaaacaaatcataataggattgtttgcaaaataaactttagtcttatacttggcctgattatttgcataaagtacagcaagaataattatttttcacatatgcttttaaaattggctctgatggaattctgttccataaggaatatcagaaaagactttttaaagtcaagcccagcaatgggtttgtaccctccaatacctatgagttgggtaaattcctctcttcttgaggtcccaagataacttggggctcctggacctgttagaaagtgacattctttactcatcacaggttaggagccctgtacaaggactgtgtagacaaggtatgaggccagtttctccttttttttggctctgcaagtcaagcttgattccttaaagggaagcacacccttctatcagaaactggtaaaaccaccagtttctccaattgtgtcctgttgcaaaagaaaatggattcttgttgcacttatgcaaataactacattgccataagaatactcacaaatagtttctgaattctagagaaaccagcagaggaacaaatacactccaaattttgttcacaggagtataccttactcaattgttaaaagctgtaaatagttcaaaataaaagtt

SEQ ID NO: 2523 - DNA, 584 bp, Homo sapiens
  misc_feature (1)...(584): n = A,T,C or G
ttttttttttgggatggagtttcactcttgttgcccaggctggagtacaatggcatgatctcaactcacggcaacctccgcctcctctagaatattgatccagatccagatttctatattaaccatcccttgtttcttctgagcttcaaccagagatcactggttggttcacagaataagtagggttagtctaaaatacagacaaaaacttaaaaacaactaataaaactagaatttaatgacaagtgtgataagttttgaaactctccagtcttcatttttgttaaaaacaaatcataataggggttgtttgcaaaataaactttaggtctttatacttgggccctngattattttgcattaaaggtacaggcaagggattaattatttttttccaccatatggcttttttaaattgggcctctgatggggggattcctgtttcccntaggggggnttatccagggnaagggctttttttnaggtcaggccccaggcatggggggggtttgtacccccnccccattcccttgggggtgggggggggaatnccccctcttcttgngggggccccagggactggg

SEQ ID NO: 2524 - DNA, 976 bp, Homo sapiens
  misc_feature (1)...(976): n = A,T,C or G
gggacgtggagacccggggtcccggccagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaaaaaaaaaatttttctttcttccctcattcttttntttttgaaaaaaga

SEQ ID NO: 2525 - DNA, 1803 bp, Homo sapiens
  misc_feature (1)...(1803): n = A,T,C or G
nngcgggggggtcncnnnnnnnnnnnnnnnnnnnnnnnnnnnnnnnnnnnnnnnnccnncctgannnannnnnanncttnnnnnnnnncccccnttagccagtttcaatttttttttttttttttttttttttcactgttcaaggtttattgggggttttagttggtataacacttggatagttggttgcattgtttgtatgtagatctttttacattatatggtaatgtacactactgatatagttcacaaaataagatcctttggaagaattatgcacaagacatgatattggatttatacactggatcccaggatgtgactcactgggaaaaaatgttggactaggcatgttcagtgaaggagccaggaagttatataacacacggtaaacatccacctggctcaaggggcaaatgcagtacgtacagcattggcagtggtgcgtcagaggtggcagaactatttcacactaaccagttgaagactacacaagattaataccatccagcatcaggatatagctgtggattttacaaaccattcttatttctaacttcaggagttgatgtttttcccagtccatcttaaaatattactgctttaatcacagatcagataaaaaggacaacatgcacaacctccacctagaatcctgttgtagcctagacagtgaaatgatatgacatcagaagactttaaaattgcagctccttttggatcccccaaagtgtatctgcactcttcttcaaacgggcctcttcctcagaagtcagagtcaccttcacaaggtctgagattccattctgtcccaaaatgcaaggaacactaaggaagacatcatcctttattccgtaaagacccttaatcatggtggaaactgggtgcacccgcctaagattcttcattatactctctgccaaatctgctacagagagtccaatagcccaggatgtgtagcctttgagtttgatcacctcataagcactctcaaccacctgcttgtgaacctctttccactgttccttatctttatcagtccctaaatctgggtgcagagtcttcagagagacaccagcaacattcattccactccatacaggcacactggaatctccatgttccccaaggacccacccatgacagcttaatgggtgaactcccagcctttcccccatcaggtaacggaatcgggctgaatccagattgcaaccacttccaataacacggtttttgggaaaaccacttatcttccaagccacgtaggtcaagatatccactggatttgaaacaataagcaacttgcagttcgggctgtattttacaacattaggaatgatgaatttaaagatgttcacgttacgctggaccaaattaagacggctttctccctcttgctgacgtgccccagccgtgataatgaccagcttggagtttgcagttacattatagtctttgccagagacaatctttggtgttctaaggaaaaggctgccatgttggagatccatcatctctcccttcaatttgtcttcgatgacatcaacaagagcaagttcatctgccaagtccttcattaagatactgatggcacaggccatgccaacagcaccaaccccaacaactgtaatcttattctggggggtctgttcttcctttagaagattataaatcagctgatcctttagagttgccatattggacttggaaccaaaaggaatcgggaatgcacgtcgggcggtcgtcgggggcgcgtggcaatgagatccggaatcggcggcagcggtttggatccactagtgt

SEQ ID NO: 2526 - DNA, 588 bp, Homo sapiens
  misc_feature (1)...(588): n = A,T,C or G
nnttactcacagatcagataaaggggacaacatgcacaacctccacctagnaatcctgttgtagcctagacagtgaaatgatatgacatcagaagactttaaaattgnagctcctttgggatcccccaaagtgtttttnactntncttnaaacgggncnnttccncaagaggnagngnnaccnnnanaagggnntgnattccantcctgcccnaaattgaaggganaantagggaggnannanccctttttcccgnaaggcccctnatnnatgggggaanttggnngaacccgcctangatcctccatnttcntctctgccaattttgttnaagngggtccattggcccagntttgtgtggccttgggttngggcacaccnacataggannctctcaaccacctgttgggngaccctcttccccactgcccctttttntttatacagcccctaanntntgggtngaggggtttccaggggagacaccagnaatatncnnnccnctccanagaggaanaatggtttctccatnnccccagggcccccccntnaaaggggttccanggggtttcacagggtgnntnacaa

SEQ ID NO: 2527 - DNA, 596 bp, Homo sapiens
  misc_feature (1)...(596): n = A,T,C or G
acaccntgacccaanannnnncccnaaanccnnccaaaannnncccnaaggntnnacnttgccaantnaggacnntgganacnaaccttanccgnaaacctaanaangggaanaggggaaccccnaaaancncanaanccnncaaaatnccaaanagccaanncccagattnancctttnntngccncnnataagaccncaaccactgcttggaaccccttccactggtcctaccttataagcccctaaactgggtnnaaagncttcaagagacaccagnacattcattcactccatacaggcacactggaatctccatgtccccaaggacccanccatgacagcttaatgggtgaactcccagcctttcccccattaggtaacggaatcgggctgaatccagattgcaaccgcttccaataacacggtttttgggaaaaccacttatcttccaagccacgtaggtcaagatatccactggatttgaaacaataagcnacttgcagttcgggctgtattttacaacattaggaatgatgaanttaaagatgttcacgttacgctggaccaaattaagacggcctcgtgccgaantc

SEQ ID NO: 2528 - DNA, 561 bp, Homo sapiens
  misc_feature (1)...(561): n = A,T,C or G
ccnnncggggttggcttnccttgaatcccaggacctgaatcactgggaaaaaatgttggactaggcatgttcagtgaaggagccaggaagttatataacacacggtaaacatccacctggctcaaggggcaaatgcagtacgtacagcattggcagtggtgcgtcagaggtggcagaactatttcacactaaccagttgaagactacacaagattaataccatccagcatcaggatatagctgtggattttacaaaccattcttatttctaacttcaggagttgatgtttttcccagtccatcttaaaatattactgctttactcacagatcagataaaaaggacaacatgcacaacctccacctagaatcctgttggtagcctagacagtgaaatgatatgacatcagaagacttttaccaattgtagctcccccgggntcccccaaagtgtttcttgcactcttcttcaaacggggctcttcccttagggttcccttggattttggggacaagaattggcatctcaaggggattcagttgggctttaccggtcctcaan

SEQ ID NO: 2529 - DNA, 561 bp, Homo sapiens
  misc_feature (1)...(561): n = A,T,C or G
ctctgggtccaggatgtgatcactgggaaaaaatgttggactaggcntgttcagtgaaggagccaggaagttatataacncacggtaaacatccacctggctcaaggggcaaatgcagtacgtacagcattggcagtggtgcgtcagaggtggcagaactatttcacactaaccagttgaagactacacaagattaataccatccagcatcaggatatagctgtggattttacaaaccattcttatttctaacttcaggagttgatgtttttcccagtccatcttaaaatattactgctttaatcacagatcagataaaaaggacaacatgcacaacctccacctagaatcctgttgtagcctagacagngaaatgatattgacatcagaagacttnaaaattggaggtccttnggggtcccccaangtgtttcttgcactcttcttcaancgggcctcttcctcaagangtcagagtcaacctncaacaaggtcttgagattccattcttatatcttcggncggggggggnagttggncttancagctgctgtcaaannn

SEQ ID NO: 2530 - DNA, 541 bp, Homo sapiens
atagtctatgcagagcaatctttggtgttctaaggaaaaggctgccatggtggagatccatcatctcgcccttcaatttgtcttccatgacatcaacaagagcaagttcgcctgccaagtccttcattaagataccgatggcacaggccatgccaagagcaccaaccccaacaactgtaatccttattctggaggatctgttcttcctttagaagactgtgaataagctgatccttgagcgtatacttgagagtatattggacttggaaacaaaaggaatcgagaatgcacgtccggcgggtgttggggcacgcggcagtgagatccagactcgtcggcagcggctccagcaccttcgctacctttaaatacagtcagtcaaggaaaagcaggataaatgctgtttccttccctgtttattaatttttggaatgatgaattcatgcccctagtagcctctaattcttgtatttgtttttatttttggagtgtcattaggagctcaggtattttaaaataaatgttatgtgttttagtctaa

SEQ ID NO: 2531 - DNA, 863 bp, Homo sapiens
  misc_feature (1)...(863): n = A,T,C or G
tatgataggctctacccctcttccccagcagcacaagttaaatgacttcgtagcatttttcaaattcaggcaaaggccaaggccaaacagctcgtttagttggttgtgtaaaggtttgaaggcacttagtagatttagtttgaaaacctcactgaagccaaaataggtgtgggggttgcttacctaccctttgtctatggaacctccctgttctcaaactgctcttcttcccttttccctccaggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggagtagaggtcagtgaagagagctggcagccagtagtgggcctcccctggggcctgtaagtccagccacgccaacccttcctttagcaggtgttccagcacttgccgcgctcgctcggtctcccatttaagactggctttgatctcactgacagtcacgtagccattcttctctgccagctgcagcaccacggtgtgactccatatttgagctcagctgggaacagactcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagccgattccgttacctantgggggaaaagctgggagtcanccattaag

SEQ ID NO: 2532 - DNA, 567 bp, Homo sapiens
  misc_feature (1)...(567): n = A,T,C or G
atgacttcgtagcatttttcaaattcaggcaaaggccaaggccaaacagctcgtttagttggttgtgtaaaggtttgaaggcacttagtagatttagtttgaaaacctcactgaagccaaaataggtgtgggggttgcttacctaccctttgtctatggaacctccctgttctcaaactgctcttcttcccttttccctccaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcntgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaac

SEQ ID NO: 2533 - DNA, 469 bp, Homo sapiens
  misc_feature (1)...(469): n = A,T,C or G
nttgtaaanncgactccctcatnggncgnatngggtnccgggcccccccctcgagtttttttttttttttttcactgntcaaggnntantgggggttttagttggnataacacttggatagttggttgcattgtttgtatgtagatctttttacattatatggtaatgtacactactgatatagttcacnaaataagatccctttggagaattatgcacaagacatgatattggattaatacactggatcccaggatgtgactcactgngaaaaaatgttggactaggcatgttcagtgaaggagccaggaagttatataacacncggtaaacatccacctggctcaaggggcaaatgcagtacgtacagcattggcagtggtgcgtcagctcgtgccgaattcctgcagcccgggggatccactagttctagagcgnccgccaccccgtggagctccanttntggncc

SEQ ID NO: 2534 - DNA, 550 bp, Homo sapiens
cgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcagtaggtcttgtcttccaatcccttggagtacagaaagaggtctttaaaattcaaaaaaaaaaaaaaaaaaaaaaaaaaaaacttttctccctattcctcatgtctaggctagcttagaaatctgtatgatctccata

SEQ ID NO: 2535 - DNA, 419 bp, Homo sapiens
agacatgatattggatttatacactggatcccaggatgtgactcactgggaaaaaatgttggactaggcatgttcagtgaaggagccaggaagttatataacacacggtaaacatccacctggctcaaggggcaaatgcagtacgtacagcattggcagtggtgcgtcagaggtggcagaactatttcacactaaccagttgaagactacacaagattaataccatccagcatcaggatatagctgtggattttacaaaccattcttatttctaacttcaggagttgatgtttttcccagtccatcttaaaatattactgctttaatcccagatcagataaaaagggcaacatgcacccaatgcaaccaactatccaagtgttataccaactaaaacccccaataaaccttggacagtg

SEQ ID NO: 2536 - DNA, 411 bp, Homo sapiens
acttcatgccatgcagggaagacttcccatatgatagatgttttaatgcaggtttgaaagaaaagaagggatgtaaattaatcaataaccgagattttgtttttctgtcttgtagctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcagtaggtcttgtcttccaatcccttggagtacagaaagaggtctttaaaattcagatggaactcttttctccctattcctcatgtctaggctagcttagaaatctgtatgatctccata

SEQ ID NO: 2537 - DNA, 534 bp, Homo sapiens
taaatggtgtggattgaagttacagaaagaaaacttaaaaccatttacaaatcatcatcaactataaatagacacggccttgatgtcaagaggacatttatagtttttcaaagatgatactgcttttgtttttagattttcgtagctctctgttgacaggcctagcaaggtctcagaatccatttctcatattatggtcagttatttcataaggagagtgttaaaaaaaattaggaactagaatgttatttgctacttgtaggccactggaattgtaatgactgtcaacttatttaaagtgggtaatctctttttctgatttctgttccctgtctccaaacaggtctgataactttggaggaactacatcaacaggtgttgaagggaaggggcaagttcgcccaggatgtcagtcagtaggtcttgtcttccaatcccttggagtacagaaagaggtctttaaaattcagatggaactcttttctccctattcctcatgtctaggctagcttagaaatctgtatgatctccata

SEQ ID NO: 2538 - DNA, 337 bp, Homo sapiens
  misc_feature (1)...(337): n = A,T,C or G
ccttaattctgggggggtctgttcttccttnaagaagnttataaatcagctgatcctttagagttgccatattggacttggaaccaaaaaggaatccttagcgtggaaaaggaatatcgacgtttgggtgtaagtatagcctcctgagggttcacccatcgcggtttattaaccccaagtggggctggcctttcctcagacaagatcactctgagctactccggctcctacagcaaggacacagccaggcttctcaagtaaacaccagagatacgtgcagaaaagccattaactgccacaaagctcaagcccaaggcacaggagctgcggtganccg

SEQ ID NO: 2539 - DNA, 255 bp, Homo sapiens
ggcacgagtaagtgttggaattacaggcgtgcacatgcgcccggccagaaatgacttttagattgcctgccctctggaaccgtctgaccctgttcttcagcaggagttaccgtgagtccgattgtttcctgagtagcagatggagcagacgaacttcatgccatgcagggaagacttcccatatgatagatgttttaatgcaggtttgaaagaaaagaagggatgtaaattaatcaataaccgagattttgtttt

SEQ ID NO: 2540 - DNA, 172 bp, Homo sapiens
  misc_feature (1)...(172): n = A,T,C or G
aggatatagctgtggattttacaaaccattcttatntcctaacttcaggagttgatgtttttcccagtccatcttaaaatattactgcttttatctgatctgtgattaaagcagtaatattttaagatggactgggnaaaacatcaactcctgaagttacaaaccattctta

SEQ ID NO: 2541 - DNA, 471 bp, Homo sapiens
gtttacttggaaataatttcagacctgcacaaagctgagggaagtgagaggccagagctcctgctggccagcgcccagcagagacgcccctgcacagccagcgcccagactcacgtggaagcccagcggtctccctctctggccaacttggatctggaacaattctgcaccttgtagtgacacgccccagcacatctgggcccccaggcctcgcatgccagggcccctggtgaggttctttactttgagtcatccaagtcaggagcacgccccagcccggggaaacccgtcccaggactggctggtgtggctcgctgcagccatgagcctggctccctgccgaccttcggctcacccagaggcccgctctgtgcacctcctgcagcaacaggcctccctgggtggctgacagggtgcacacaaggcagacggtgccagtgcgaattaagggatgtcacccaggcccctgag

SEQ ID NO: 2542 - DNA, 4266 bp, Homo sapiens
caagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaaaaaaaaaaaatataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttct

SEQ ID NO: 2543 - DNA, 3864 bp, Homo sapiens
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaggctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattccaaaaaaaaaaaaaaaccatggtacccggatcctcgaattcc

SEQ ID NO: 2544 - DNA, 606 bp, Homo sapiens
cttaaactcactggttgcctaccttctgctttttggtacctggggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagtacccgtgtcttctctgttgtcagagg

SEQ ID NO: 2545 - DNA, 392 bp, Homo sapiens
tccggggaacgcttcagagtgagatcatcatccaagtctgaaggctctccatctcagcgcctggaaaatgcagtgaaaaaacctgaagataaaaaggaagttttcagacccctcaagcctgctgtaaggattgtgcaggatcagttttacttatttcagacttgaatgagatctttctattaaaaatatgtggttgagaggcctgcagtcttttctgcgagggcccctcacagatttgaggaattataaggaatgacctaaaccccagacatacttgttcccttccattggtatcgtctgctttccctgtataaagtctcaagtgagtaaaaccttttttctgttgttccagccatacacttggtgtacagtcagccttacaaaattatgca

SEQ ID NO: 2546 - DNA, 467 bp, Homo sapiens
  misc_feature (1)...(467): n = A,T,C or G
ctctaatcgtccgccagagtacagttgaccaaaagcgtgccagccatcatgagagcaatggctttgcggttcgcattcacctcttgccagatctcttacagcaaagccattcctcctccacttcctccacctcctcctccccatcctccagccagccgacacccaccatgtccccacagacaccccagggacaagctcactgctaatgagactcagtccgctagtagcacactccagaaacacaaatcttcctcctcctttacaccttttataggaccccagattactacagattttttccatctaggcgggaacaacagtggacatctgtgggtgggggtttttcctgtggatgggggatggaggaccaggaaggccntaaggggaaaggattccttacccgggaaaagggtttcagtngggttcattgttggaattccttaacccaacattagggggccacagga

SEQ ID NO: 2547 - DNA, 458 bp, Homo sapiens
ttttgaaaaggctctttgggagtctaagcttctcgtacttgacagtgttgaggatgatggtggcttagattccctggctggaagtgcttcatgaccatggtaaccattccctctcttttcttgcttttgcaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcaaa

SEQ ID NO: 2548 - DNA, 433 bp, Homo sapiens
gcacgagactcccttgtcagctgtttctgtggtacacatctccaacttgtgacttgcctttcactaggtttaagtgctggccttaagtgattgatttcttttggttactattgttattaatgatgagacctacttctggatatgcatgtaaaatatttatatttattttgctaggcaaaaaggataagttacgtgtctactatttgtcctggttaagaaataaaatacttcacaatgatccagaagttgagaagaagcagggatggacaaccgtaggggatttggaaggatgtgtacattataaagttggtaagttctagaagcgtcatattttgtttttccagagtttgattagagtttgaattttaaactttaaattttcacaggttttttgaagtttgtaataataaacttgtttctgaaaaaaaaaaaa

SEQ ID NO: 2549 - DNA, 686 bp, Homo sapiens
tttttttttttttttttaaagcagatatgaagctttaattcaccataggcatttctccaaccattctgtacattaaactttcatgtcttcacacatatacatcttttataagacagttttcttagcaatatggtactctgtaccataccaacattccatttaactagttaagggtgtattatataacatgaaccactgattaaatataaatacagaagttgaatacataggttagaaagtttaaattttaaaaaaatttaagaaaggctaaataccatgaaagtttacatgtattctttaattctagacaccgtacaacagtgacaaccaattacaataaaatcacaattgcttttagatgacagtactttcagatttctaatacccaattactttcatttccacaatgtcaacttcatgctgcattttcatttctatagagcagacaagcttccagactgcagaccaagtttcttgtgtaataatactactatcttgatcatgaccacaggaaaccaattttatattccctgtactatagagatgagacattatttggtgtatatgaaactcttcagtggtggtgttcaagaatattcaaatagtagctgaaaatagggtttgctagagcagtccacatatttcattaaaagaaaaatgcccagtcaaaacatttagaaataaat

SEQ ID NO: 2550 - DNA, 790 bp, Homo sapiens
tttttttttttggggtttaatgattgtattagatttcgtgttggtgttattattattatcagtgctggattggtgttggtgttagtattggtgttgctgttagtgtttatattatcatcagttttattactattggcaggtggggcctgcatgaggtggttagtgtttatattaggattcatgttagtgttaatattattatcagtgctggattggtcttggtgttagtatcggtgttgctgttagtgtttatattaggatgcgtgttggtgttaatattatcatcagtgctggattggtgttggtgttagtattggtgtcggtgttagtgtttatattaggattcatgttagtgttaatattatcatcagtgctggattggtgttggtgttagtattggtgttgctattagtgtttatattaggatttgtgttggtgttaatattatcatcagtgctggattggtgttggtgttagtattggtgttgctgttagtgtttatattaggatgagtgttagtgttaatattatcagtgctggattggtgttggtgttagtattggtgtcggtgttagtgtttatattaggatgagtgttagtggtaatattatcattagtgctggattggtgttggtgttagtattggtgtcgggggtagtgtttataattaggattcatgttagtgttaatattatcatcagtgctggattggtgttggtgttagtattggtgttgctattagtgtttatattaggatttgtgttggtgttaatattatcatcagtgctgg

SEQ ID NO: 2551 - DNA, 607 bp, Homo sapiens
tgtgtatcgggtgctgccttagctgagtatgtcttctgtctcatgtgtaccaggtgctgccttagctgagtatgtcttctgtcttctgtgtattgggtgctgccttagctgagtacgtcttctttcttctgtgtatcgggtgctgccttagctgagtatgtcttctgtcttctgtgtatcaggcgcagccttaggtgagtatgtcttctgtcttctgtgtcccaggcgcagccttagctgagtatgtcttccttcttctgtgtatcgggtgctgccttagctgaggatggcccccggcctctgtgtaccaggtgcagccttacctaagtatgtcttctgtcttctgtgtatccggtgcagccttagctgagtacgtcttctttcttctgtgtatcgggtgctgccttagctgagtatgtcttctgtcttctgtgtaccaggtgctaccttagctgagtatctcttctgtcttctgtgtagcaggtgctgcctcagctgagtatgtcttctttcttctgtgtattgggtgctgccttagctggtatctcttctgtcttctttgcaccaggttctgtcttagctgagtatgtgttctgtcttgtgtgta

SEQ ID NO: 2552 - DNA, 175 bp, Homo sapiens; identical to SEQ ID NO: 1677

SEQ ID NO: 2553 - DNA, 605 bp, Homo sapiens
  misc_feature (1)...(605): n = A,T,C or G
ttttttttttttttttttttttttttttttttttttttcagagggagcagaggcagctgcctttattgggggccatgggctggctgatttcagtcaaaggccacacatttgatcttgaagtcaccgtcagctgccatgtagttgatggcctccaggttgaggcggttggggaacttgaattcgtatccatctggcagcttgacggtcaggttggcctggtcgaaggtgatgcacacctctgcaacacttccaggctggaagggaaagacagcctcccgctgctcggtcccccaggccccgccgtccttgctgttgcacacgatggtgttggcgtcgccgtgggctttgaagcgagggttgaagtgcaggcacaggttgttgctgtctttgcccaggttcagcacgaagctcttagcgtcaggagccacctcgcctcgcactcgaaggcactctccaggtttgagattcaggttgctggcgaccagaccacaagccatgattgagtccaggaggatgttcccgggcaggcgcaccagctgtcagaaaactcgtgcgaatcttggcccgaaggcaaattcctaagngaggcggatnaatcgaacatg

SEQ ID NO: 2554 - DNA, 489 bp, Homo sapiens
cagagggagcagaggcagctgccttcttattgggggccatgggctggctgatttcagtcaaaggccacacatttgatcttgaagtcaccgtcagctgccatgtagttgatggcctccaggttgaggcggttggggaacttgaattcgtatccatctggcagcttgacggtcaggttggcctctgcaacacttccaggctggaagggaaagacagcctcccgctgctcggtcccccaggccccgccgtccttgctgttgcacacgatggtgttggcgtcgcgtcgggcttgaagcgagggttgaagtgcaggcacaggttgttgctgtctttgcccaggttcagcacgaagctcttagcgtcaggagccacctcgcctcgcactcgaaggcactctccaggtttgagattcaggttgctggcgaccagaccacaagccatgattgaggccaggaggatgttccccgggcaggcgcaccagctgtcagaag

SEQ ID NO: 2555 - DNA, 435 bp, Homo sapiens
  misc_feature (1)...(435): n = A,T,C or G
ttttttttncaaagttatcaaaggcagctgcctttattgggggccatgggctggctgatttcagtcaaaggccacactttgatattcgaaanncactcngatgnnctctagttagtgaattcccccatgnggggcgttggggaaacggatatgtctanctttggncatttgnacgtncagttggcccggtncgaagtgatgcacacctctgcaacacttccaggctggaagggaaagacagcctcccgctgctcggtcccccaggccccgccgtccttgctgttgcacacaatggtgttggcgtcgccgtgggcgttgaagcaagggttgaagtgcaggcacaggttgttgctgtctttgcccaggttcaacacgaagctcttagcgtcaggagccacctcgcctcgcactcaaaggcactctccaggtttgaga

SEQ ID NO: 2556 - DNA, 707 bp, Homo sapiens
tttttttttttttttttttttttcttttttttttttttttttttagaaagtaccaggttttattatctttttatcaaaaaaaatcagtaacagacaacagtgtgagaggtggcaggtgcattgttcattctcttggatttccaacgaacatttattatgcttttctgcaattgttactttccttgtctatcttggaaatgaagaaactgggttctcatctctgtgtctccactgcttagtttctttttctttctttctttctttcttttttttttttgaatagtcactctgcaattggggagggtcgcaagattaccttgttcaacaatttgttagaagaactcacagaatgtggcaaagctggtatcctcaccatcacagtttattatagcgaaatgataccgattaaaatcagcaacaagaaagaaaaggtgcttagggtaggatctctgggagcctgggtgtagaacttccagttctctcccagtgggtcacgcagagtgggctcattcctcgcagcaaaaacctgcgatcgcatgcacagagtactgctaactggggaaacccctctgggagcttggcatgcagaattcctacggaagggttgctcccacgggtcagggcttgacccacctggcaaggctggaccttcaaccttttaggttccttcccggaggtggagttcaatgtttggggtgggattcaag

SEQ ID NO: 2557 - DNA, 546 bp, Homo sapiens
cacgaggtgtgttttattttcattattcatacaaataattttctataatatcccggggcaaaccggagaatttggcagtccgattgggggggggggaacagaagttctgctgcttggaggcaaagttcatactagttcattttccgggctctgtgaagacacagaccactctgctccctgaaagtgtgcctcacgaccacgaacggaccttcagtggccctttaagagtgccaagagacacagctccagacaggctggtctccctgagaaggctctgtcctgaccatcagagagcaatgtggatgctgggatgtggggtgggtaacagtgtcctgcccctcctttctggaccccttagtatccttcaaaggaggaaggggtagagttggaggctgccctgggcttcaggatcccccttcccctgaagccgtccagggtcgactattcctggaagagaaagaggttgagaaaaggggttaagtgacacaagtaagtctagcttttcctttttttctttcttttttggtttttgagacagagtcttgc

SEQ ID NO: 2558 - DNA, 667 bp, Homo sapiens; identical to SEQ ID NO: 73

SEQ ID NO: 2559 - DNA, 405 bp, Homo sapiens
ttgaatgtttaagaaattatatttaagtattttccacaattgatttgtgtgttgtggcaacattataaggaaatgtttcttaaacagtttcagcacaaatttttgtaccaagttttaattcaataaaatttgctgtatatgttgaacagagttgttaagacttccttttactttctcttcaccttgtgacttggctgttcctcctgctgttcctctctgccgtccaccgcaaataattccccctctgctggtggcggctgaggctaggctgaatataaccaggttgctgactggcagtggagcccaccagctgcgctgtctcctgaccgcgggcccttcctctggctctggctcgggctctcccagtcattgttttctatttcttggaccgctgccctcgcccta

SEQ ID NO: 2560 - DNA, 768 bp, Homo sapiens
gtgagtctatgaatgaacgccctcctgcttgctgactttgagcactggtgtggatgatggtgagtctatgaatgaacgccctcctgcttgctgactttgagcactggtgtggatgatggtgagtgtatgaatgaacgccctcctgcttgctgagtttgagcaccggtgtggatgacggtggatctatgaatgaacacccttctcctcaccgactctgaacgctggtgtggaagatggtgggtctatgaatgaaggcccacctgctctctgactttgggcactgttgtggatgatggtgagtctatgaatgaacgccctcctgcttgctgactttgagcaccggtgtggatgatggtgagtctatgaatgaacgccctcctgcttgctgactctgagcactggtgtggatgatggtgagtctatgaatgaacgccctcctgcttgctgactttgaccactggtgtggatgatggtgagtctatgaatgaacgccctcctgctcgctgactttgggtactggtgtggatgacggtgggtcttatgaatgaacgccctcctgcttgctgactttgagcactggtgtggatgacggtggacctatgaatgaaagccctccgtattaggaatcactgtggatcagtcaagaaaccaaaagggaaaaagtttttttttttaaagattggcaaatatattgtcttccctttagcctaagggtttaattcttctggggttgtatattttggggtgggaaatagcaattaagtgaaa

SEQ ID NO: 2561 - DNA, 305 bp, Homo sapiens; identical to SEQ ID NO: 1687

SEQ ID NO: 2562 - DNA, 1485 bp, Homo sapiens
cacctccgcaccattagcccgtgtcttagtacacaagatcaggcccccccagcacgccgcctcagacgaggaggacgcctatgactctccagacttcaagaggaggggcgcctcggtggacgacttcctgaaaggctctgaacttggcaagcagggaaactgaggcccacagaattgagaatttttgtccatgattacgcagatggtctcctaacagagctggaattagattgaaccgaggcctgaagaagacctgtttccacgcctttccccatgtgccacgttctcctcacctatccaggagtgaatcatcaccttccctgcaatctgctcaggttacaaacccggaggaaaggctggagcacttgttctctgggtgaaggacccatacccccactggtttttgagatcggcattcagcgctgtcttatggcagcccccgccccaggtggccccagagcccttgacatgtggccacccggggctgagtgtgactgaggccctgaatttttacttctataaaattagttccagattagtttacattcctaattagtttacatgtaaaacagccacacgtggctggtggccaccagtgtgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaatatttagcagcattgttttatgttgtattcataacataataatataacaatatattaattgttaatatatattgttaataatataataatataacataaaataagtgatacttattttccatttacagttgagatattttctttaaaagtaacgttaaatattgattcaattcaaagaatacattcattaatcatacagatggcgtctggctaggtgacgcatcatgacagtggtagggagtgactgaagttgagctggtgcacagactgccagttttacaacccgggaagtgttccctgaccatccgcttccccatgctgcccgccccgtcacatgagcccttaccccctggcgctatcccatctgctccaagacaccgatgttctagtgggtggaagcctccacttttagttgactacggtatctctagcatttcacacatagtaggtgctcaatgaatgtttgtcgaatgaatgaatgaaagaagggaggctgagagtagctgggacatttgctctgaaaaaatcacctccattctcccaatattacaaaagcattttcattaagtccacaatgaaaaatgctcactgtaccaataaataatatctttagttatctatttttaaaagtaaaaaaaaacctcgtgccgaagtc

SEQ ID NO: 2563 - DNA, 6340 bp, Homo sapiens
atgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccgcagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaacgggcagaaaggccttgtgccctcaaacttcttggaagaagtgcctgatgacgtagaagtctatctttctgatgctccatcccactactctcaagatacgccaatgcgctcaaaggcaaaaaggaagaagagtgttcatttcataccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagttttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggttcgagatcaagttgtacaggctgtgcattttaagatactagtttcagtctttcaaagccagccaggctacacacagaaaatgtttactcaatcattcaaaaaaagagaaaaggagagaaagtaactttgtttggtaaagcaccaagtactccaaccttccagaaagcccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttatacaaaaaaaaaaaaa

SEQ ID NO: 2564 - DNA, 507 bp, Homo sapiens
gtgaagcaggagtatgtgcatctcaaccacccgctcaccttcgtgaccagagagcgcgatttggccgtgaaggagaaacactagctccaagccaagctggagaacctagaacaggtcctgaaggatgttaaacacagctgagctgtgcagtggcaggcacaccgctcctgaatggaaatggagtctgcctacgttaaagaccagaggtggccccagtggcccccaaacttcaggaattttaagctgctcctcagacgtttaatgacctttgttataaagaggatagctaaaccagaaccttgctctatcagggggtacaggtaactggatgttcctcatgcattcctgatgagctgagctctccttcaatatttagccagtgggttgatttgctattgatgccactgagttaagctgaatgaattttttcaccaagtgttaaaatttgattggattatcattctggaaaacattttttacaaaaataaaaaaataatcatctccaaa

SEQ ID NO: 2565 - DNA, 686 bp, Homo sapiens; identical to SEQ ID NO: 1678

SEQ ID NO: 2566 - DNA, 467 bp, Homo sapiens
caaaaaaagaccctttcaattctaatcaatcaatctgcctttactcacaaagaaatgtcccatcctacattatagaagcacatttcagtttgatcaagagtgaaaaggggatggctcctcttcagatttggtgggcaatggaggttatttgccctctgttaggactttagtctcttcacaaggatccaagggcttctcaagcatattgaactattagactacattcatgtttagtatctcatttttattttatttcatcactgcaagtttttctatattatatttttatatatatatttttatttctttgctcatctgcttggaaacagaagaagagtgttcatttcacaccttaatcaggcaatgtagccttcacgtaagtgagcaactgaagataccgataaagataccaacttaagctaccttaaccgggccagtgtggtagacttaaggcttcattgtggggt

SEQ ID NO: 2567 - DNA, 637 bp, Homo sapiens
tttttttttttgggggttgatgattgtataatatatatgtttaaagcgcaacaacatagcttatcaagaccaatcacatcctctctgacctaccgcaaccacggcacaaggaatggtgtagggctggtagtttcggggacaggtgaagccatgtggtttccagagcccacaatggaaagaaatctgctcattttctttttgacgggcagtgcctcagcatttttctgtgcctctgaacccatccaactgtgtccaaggcgcgggcctctttgcctctcttcagcttgaatattaagccctcattggagcagatggagctggtatttctgtaacacaggattgccctcaggggaatcttttgctccgcaaatgagaagcagcatctggagaagggtacctgcatgctcttgctgtccacatcttccggccacatcccagctagcagcaagcaccacgacatcatcaaatccatgacatcatcaaccccatgacatcatccacactgcatcaccaacaccaggacatcagcaccatgacatcatcaacactgtgacatcatcaacaccacatcaataacatcacgacatcagcaccatgacgtcatcaacacaatgacatcaccatgacaccatcaaca

SEQ ID NO: 2568 - DNA, 520 bp, Homo sapiens
tgggggttgatgattgtataatttaaatgtttaaagtgcaacaacatagcttatcaagaccaagcagatcctctgtgacctagcaaaagcagggcagaaggaatggtgtagggctggtagtttcggggacaggtgaagccatgtggtttccagagcccacaatggaaagaaatctgctcattttctttttgacgggcagtgctcagcatttttctgtgcctctgaacccatccaactgtgtccaaggcgcaggctcgtttgcctctcttcagcttgaatattaagccctcattggagcagatggagctggtatttctgtaacacaggattgccctcaggggaatctcttgctccgcaaatgagaagcaacatctggagaagggtacctgcatgctcttgcttgtcaaatcttgcgggcaaattcccgctagcagcaagcacacaagggtctttggtaatgatcctgaatgtcttccggtccgcattgggccttccggagaagctttaatgacccggtgaa

SEQ ID NO: 2569 - DNA, 412 bp, Homo sapiens
cgcccccacctctcctgccaggccctgctgcacgtggtcactccgcttctcagcccttggacttgtctatttcagactgtaacatccctggcactcccccacgcgcagcacaatctctggctactctgaaatgtaaatgggtgacttatccaaagccacctaaatgagccagaatttacaacttcacttctatgtaagtcatttgtcttttctagagggaaggaatggacacagttcagggagcatcagagaagcttcagggtggatttatgctcagcatttaaaatctttaacccaaaccaagcccggtatacccaaaggacttcccgcttactgctctttagggctcagatatttcaaagacataaagcaaaccacacaggtcagcatttttctaatgttctggacacca

SEQ ID NO: 2570 - DNA, 1595 bp, Homo sapiens
  misc_feature (1)...(1595): n = A,T,C or G
tttttcagaacacaaatttggcattattttatcaatatatcaagcaatataactgctagatacaatgttcacagcagcattgtttcaacagcaaaaacaaataaacaaaactcaaatgtccatcaagaatgaataagttgtagtatatttatataatactatatagcaataaaaatgaaagaaagtcacagaagtaaacattttgccatttatataaaattcagaaacatacaaaattaacatttcacttacagatacatacgtatgttgtaaaactataatagacaaatgacaaacacaaaattccaaataattatttgagagggagagggccttagggaacttctaaaatgtcgacaacatctgtatcttaagctggctgatgagtacacagatatttacatttattatccctttatatatacgtttatgtatttttgtagtatgaaatacttcattaaaaaaagagtgaaaatgtaagacttcaaaaatgaagactaccatttatgtataacaataaaattagtgtaaaaaagtatacaaagaaaatgttcaattctttatctttccgtgctctatataatcagtattaatctaaagaccataatcctagtatgaaaaaaataacaagctttgacacaaaatctaagcatctgctttcctggcactcttaagttagacaagagtaaatatgttagcctctcaattctgcctcttcatctttcatctatacttagatttttctttatctttggacttctttggacttctgcttcggtctctctttttactcctttctctttcataaagatctgtttggtattttgatttatgactattactataatggccatccctctctcggagatcggctacgacttcnggttctgagttcgggtctctcttttcactcttttgtttctcccaacagctttcttcttcttcatagtgaccaaaccccatttctctatagatatcctgattagtatttttgattggcatgtagtcctcatcttctttctcttcagaacagtgatgggttttcttcttgtgttttttacttgtgtgtgagtgacttgattttgagtcttcggcctgctcatctaatataagatcgtattttgtatcctgtttgggctttactttatctttcagaaccaaattaggtggtttatcctgttctttttcatactccttgaaatcactcttggtgtatttcccaccttttcctttccatttaacctttgcaaccgactggctaaaatccacatgtattcttctgtcatctataagcacattgtccattttgaagaatgctttctcacaatcttcttccttttcaaattcaataaaagcgtaacagagggactctcctgtcttccagtctcggataacctcacaacttcttattggcccaaatctagagaatattatttccagatcctcgtctgtggtcactgggttcaatttacacacaaacagtacattttcctggaggtttaatatctgcatcaggtaggtctcccaccatctccaaaagtatagcctgagttttagcctcttttactgcctttatttccttttgctgctgttgt

SEQ ID NO: 2571 - DNA, 3163 bp, Homo sapiens
  misc_feature (1)...(3163): n = A,T,C or G
ggacgtgaaatctttacttagagaaaagcgacagagtcagagacccacgggggcgggcnccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctggtgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatatttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcaaaaaaaaaaaaaaaaaaaaaaaaagataaagtaaaaagng

SEQ ID NO: 2572 - DNA, 606 bp, Homo sapiens
agaaggcacctgactttgtgttttatgccccacgtctgagaatcaacaagcggatcctgcagctctgcatgggcaaccatgagttgtatatgcgccgcaggaagcctgacaccatcgaggtgcagcagatgaatgcccaggcccgggaggagaagcatcagaagcagctggagcggcaacagctggaaacagagaagaaaaggaatggagaaacagacctggagaagggccaaagctggaatatattttgggcccaagttgacccagatactggagggccagagaaagcaagcttgaaacagagaggaacgggtcactttggtggaggaaattgggccaccaagcagccctatggagaggccaatgtggagagaaactgaggccttccaccaaaagccagcaccaacttgctatccatgtgagtgaaccagcttgcagtacagagtggtcaaccccagtcaagctttcagataactacaagcctagttgacatcttgactacaacttcaagagagacatcaaggcagaactcgtcgctaaactgctcttgaattcttgacccacagaaactgagagagagaataaactctttattgttgtttcaat

SEQ ID NO: 2573 - DNA, 946 bp, Homo sapiens
  misc_feature (1)...(946): n = A,T,C or G
cactatggggaatataagtattttcctactggnnctaagtggatagacaggtgtttagcccagaggtgcagaagaagatttccccctccagtcaagtcgggccaagttttcaccggaaagatgtgtttgagcagctcacccaggacatcccccccanaactttttctcctccaagtatagaaggaatctctagagatgagatatttctgccccccatgatctgcccgtctcttggggtcatctctgtgcaggccaagtgtgcggcataccacaaataagtctcaagtatgggtacctcagctgtcatcggctgatccctcaaagagtgatggtccagcgcaaacttcccagggaccagtgggaggacggatccaggtgtggcatgcggaacacgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtgcactgctttctccttcacagctaagatgccatgtgcaggtggattccatgccgcagacatgaaataaaagctttgcaaaggcaaaaaaaaaa

SEQ ID NO: 2574 - DNA, 690 bp, Homo sapiens
cagccaaaagctgttgcccttttgagtgagtttctcatgagtgttgagcctctctctctctcacgcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgataaggaaactggagcaactcaccctgtcttttgttttctgttcctttttgtttgtgtaaaagtttttacagacaaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaacttcaaagagtggataattccattaaccaaccaaaaagaaaagtagtaagataaacattttcttcaaactctgaaaattatcctttttttttttgaaacccccactgtcctcccaagtcacagcaacaagttaaaaagataatgggaggtggggaagagtggaggacgtcgac

SEQ ID NO: 2575 - DNA, 537 bp, Homo sapiens
tgtgttggtgctgggagatagatcgatttacgtacagagtactgcatgttaggtctgagtaagcgtcttcaggctggtctgtgtgaacaagagtcagcatcatttaagtcaagctgtcatgccttccttctgtgccatccttgttatgattcagaaatgagccaaattgatttgttaatttctatgaaggatccatcttagagtatttacatgcttagaggggtgaaaattttattggaaattgagtctgaagcactctcgcacacacagtgattccctcctccagtcactccttgcagctggcagagagcacagtgatccccagcgtgagtggtggaggaggacacatggatattaatatagtattttttatcttggctgaacagttatagcctacattgtacttatacaccttaataatgatcagtaatattctatttatatacaagtgataatacagatttgtacctttcgttataaagagggagagttttgatctgtatataacgcttccttttgcagaataaaagattttca

SEQ ID NO: 2576 - DNA, 520 bp, Homo sapiens
acagttgaggtacagagacagcgttcgcagtcagcttgctagaggacctacacgggctcctcaagttccgctgcttcctcctccaagcttgctagtattgaaaacccaggagtttggggtcattcatcaggaggattctgctccagtttgcccccttcttggtcctaggatactggagggccagagaaagcaagcttgaaacagagaggaacgggtcactttggtggaggaaattgggccaccaagcagccctatggagaggccaatgtggagagaaactgaggccttccaccaaaagccagcaccaacttgctatccatgtgagtgaaccagcttgcagtacagagtggtcaaccccagtcaagctttcagataactacaagcctagttgacatcttgactacaacttcaagagagacatcaaggcagaactgcttcgctaaactgctcttgaattcttgacccccagaaactgagagagagaataaatatttattgttgtttcaagtaaaaaaaaaaa

SEQ ID NO: 2577 - DNA, 450 bp, Homo sapiens
aaccttctgggctggcaccagcgaggcggcatggtttgtttcctcagttgttatagtccctagcaggctcgattctgcgagttgtcccgagatcacctctgtggttgtgctgggacgaggcctgattggattacggacgatgcttgtacagtctgagtaagaaccttcatgctggcctgtgtgattccagagtcagcatcattgaaggagacgtggcaggacttccatctgtgccctacttgttctgtattcgaaatgagctcaaattggttttttaatttctatgaaggatccatctttgtatatttacatgcttacccgggtggagcttgttttgggaattgagtctttagcactttggcacacgcagtgattccctcctcccgtcactccacgcagctggcagggagcgcagtgatccccagcgtgagtggtggaggagcacacttg

SEQ ID NO: 2578 - DNA, 369 bp, Homo sapiens
gcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtgtctgcccaggaggtcaggaaggagaatcccctccagttcaagttccgggccaagttctaccctgaagatgtggcttgaggagctcatccaggacatcacccagaaacttttcttcctccaagtgaaggaaggaatccttagcgatgagatctactgcccc

SEQ ID NO: 2579 - DNA, 353 bp, Homo sapiens
gtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggc

SEQ ID NO: 2580 - DNA, 239 bp, Homo sapiens
tgggcaaccatgagttgtatatgcgccgcaggaagcctgacaccatcgaggtgcagcagatgaaggcccaggcccgggaggagaagcatcagaagcagagaagaacgagcgtgtgcagcggcagctgctgacgctgagcagcgagctgtcccaggcccgagatgagaataagaggacccacaaagacatcatccacaacgagaacatgaggcaaggccgggacaagtacaagacgctgc

SEQ ID NO: 2581 - DNA, 340 bp, Homo sapiens
  misc_feature (1)...(340): n = A,T,C or G
ggctggtttggagaagggttaatnagatcccaggaagagagaggaaccgtgccacatgactcagccaccaagcagccctatggagaggccaatgtggagagaaactgaggccttccaccaaaagccagcaccaacttgctatccatgtgagtgaaccagcttgcagtacagagtggtcaaccccagtcaagctttcagataactacaagcctagttgacatcttgactacaacttcaagagagacatcaaggcagaactntcgctaaactgctcttgaattcttgacccacagaaactgagagagagaataaatatttattgttgtttcaagtaactaaa

SEQ ID NO: 2582 - DNA, 293 bp, Homo sapiens
  misc_feature (1)...(293): n = A,T,C or G
tggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagttacccaacagaaacattctgggctgggaaccaggggaggcgncctggttttgttttccccagttgtaatagtgccaagcaggcctgattctcg

SEQ ID NO: 2583 - DNA, 858 bp, Homo sapiens
  misc_feature (1)...(858): n = A,T,C or G
tgtaatcccaacactttgggagcccaggacagatcacttgaggtcaggagttcgagacccagcccagccaacatggcgaaaccatgtctctactaaaattncaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtaaaaaa

SEQ ID NO: 2584 - DNA, 387 bp, Homo sapiens
ggtcgacccaagttaataaaagaccaagaaactccttattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttatttgaccaaaatgtagaaaaagtgatactattacatatgatacagttgcaagaatctaaagtgtggattttattccattgcacaatttgctagtgtatttcctgggtagtgtggtgctgaataaatgtcgacg

SEQ ID NO: 2585 - DNA, 816 bp, Homo sapiens
ctgagaggaactcctcactcagctagcttcaggagccatgacatcatctctaccatggaaattccactcactctcctgtgcccccacatttgtcctaggcctcagagtccttccccccccccccccccccccccgcccgagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagacagttaaaaaaaaaa

SEQ ID NO: 2586 - DNA, 536 bp, Homo sapiens
cagggagtctgcttccagtgctgctccaggaaggatccatccaccagagctgccccacatggaccatggtcaggcagaggaagatgcaaaggataaagccagatgacctcaaaggtctcatgagattctaatctgtccgctccttgttctacagattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaat

SEQ ID NO: 2587 - DNA, 526 bp, Homo sapiens
tgaagcttctgagttctgcagcctcacctctgagaaaacctctttgccaccaataccatgaagctctgcgtgactgtcctgtctctcctcgtgctagtagctgccttctgctctctagcactctcagcaccaaattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaaa

SEQ ID NO: 2588 - DNA, 479 bp, Homo sapiens
  misc_feature (1)...(479): n = A,T,C or G
ctcttgttcacacaactaccatgaatcatagtgtgactctctcttcttctcctctagncaagtaactacttctgtcttttagtactatcagtatcaatggctcagaccttcgcgacccgtgctgcttttcttaccctccgagaagcttcctcgcaacttagtggtagattactatggcaccatcagcctctgctcccagccagctgtggtattccaaaccaaaagaggcaagcaagtctgcgctgagccccagtgagttctgggtccaggagtacgtgtatgacctggaactgaactgagcctgctcagagacaggaagtcttacagggaaggtcacctgagcctggatgcttctccatgagcacgcatctcctcatatactcaggactcctctcgcgcagttcctgtctcttctcttcactgtaatctcttatatgtgctgtaatattgtattagagtgttatttccattatttatat

SEQ ID NO: 2589 - DNA, 423 bp, Homo sapiens
  misc_feature (1)...(423): n = A,T,C or G
tttgggggctttccttccacccaaaggaagggaanggggnaacnccccaaaggggggggnaaaanaaggtgttttctccttttttcccccaagggggnggnaaaaaaggggggtcnccaacccccctttggaaaaggccccgcgngaaaatggtcttttctccacattagaagacaaacatcttcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaaaaaaaaaaaa

SEQ ID NO: 2590 - DNA, 300 bp, Homo sapiens
  misc_feature (1)...(300): n = A,T,C or G
agaagctgagaggaactcctcactcagctagcttcaggagcatgacgtcatctctaccatggaaattccactcactctcctgtgcccccacatttgtcctaggcctcagagtccctataaagagagattcccaagtcagtatcagcacaggacacagctgggttctgaagcttctgagttctgcagcctcacctctgagaaaacctcttttccaccaataccctgaaggtcttcaggganggtcacctgagcccggatgcttctccatggaggacacatcttccttccatacttcaggac

SEQ ID NO: 2591 - DNA, 714 bp, Homo sapiens
  misc_feature (1)...(714): n = A,T,C or G
gctactactacccaataattcagaatcctgatggttcaaagtgatgggatcatactaatgtaacaggtaatcacaagttcagcgttgccagagctcacatttatttttcccaaatagcaaggcatccaaatttagatgtgaaacctttcaaactgtgactattagttcactttcttttggtaccagctttatggagacatattcccataccatataattcacttatataaactgtagaattcagtggttttttagtacattcacagagatgtgcaccaatcttcccctcccctcccccagtatcaggaaactgtactaatctgcattgtctgtatggatttgcctattgcctattctggccattgcatataaatgtgatcttgccagatgtggtcttggctcacttttttgtttttttaaacttagctttagttttctcaaatgaggcaatgcaatcggattagtttactatcattcaaaaatggcagagtgtattgagcactgtttggacactgggttatcacatgattcaaatcatttgctttgctttcattccatgtttaatgttaattttactctagactntgcctgagcgtcaaacctatcagtcttagaaaaaatactcaaagattctgtctcctctaccaactgcaaagtggaagcagcactggactcataattagatataagcctttcattgaagtctgagttcta

SEQ ID NO: 2592 - DNA, 379 bp, Homo sapiens
  misc_feature (1)...(379): n = A,T,C or G
agaatcatttccacaaagtcataaagcaagcaattgtaaggcctagaagagtacagctgccagagcaagtgtcgcctttctcaaagagtgtgtacaagtacttactgacaaaattgcactcagcgctaccataaccaccaccaccagcatctgcactatctccactctcccttatgatctctatcacaggtggacagncatcgccatcaccatcatcaccatcctcacaccaccaccaccaacaccatcctcattaccaccaccatgatcatcagtatcgccgtcctcacgtcaccatcctcaacagcactaccatcagttatcttcaccaccatcactgtcgttaccatcaggtcatcgtcctcaccctcatccccac

SEQ ID NO: 2593 - DNA, 303 bp, Homo sapiens
atccggagaaggacacgtaaaacaaaaatatgagaattatgaatcctcctcaccattgccaccatcaccatcatcctcaccatcgccatcaccgccataatcactatcaccattgtcacaaccatcaccatcaccatcgtcaccatcctcacaccaccaccaccaacaccatcctcattaccaccaccatgatcatcagtatcgccgtcctcacgtcaccatcctcaacagcactaccatcagttatcttcaccaccatcactgtcgttaccatcaggtcatcgtcctcaccctcatccccac

SEQ ID NO: 2594 - DNA, 7204 bp, Homo sapiens
aagcttaccctactcatcctaattatatggcaacaagaagagggccagaaaataagtaaacagactatcaagtttaacctcagccagtcgcttcacatctgagcctcactctcgactacaaaatggggctacacctgtatctcataggtctgactcaaagattaaagagcatgaggcagagctgttagcatagcccagggcttagcagacttgccactaacaaagaacctcagctgtaactttctcaaattctgcaacctctgctcaaataccagcccactacccctgaccattctaagatgtctcttaagtttcctctggaagaggacaccgcttttagaataaaaattacccgtctacaacctagaatgaatgacttcagcaataatgaaagtaaatggctggtaactggctaaatggacaaatggtattttatcctgaataaaagtctgtcagagatgacttttgtctagttgagggtctgaatcctgactctgctgctcattaaatgtacacataaccttcaacaagtttcatctgtgcctgattcctcatccatgagtgtgatacatatattacacaaacatctcaacacttgagagataatacacaaaaaacctcaagaacttaacagcgatacttttttgactaagggaatggacaaagcaattagtctccaatttactttattcctgtccaacaatacagccaggtctgtgaaagcaaattcaaggtgcaaacatgaatttgttaccagttccatattctaacaaataacttcttgccatttcacttagagaaacgtggggttctctgcatctccaaactaaaggaatcaggaaagaccccattgtctttgtttgcaggtctacttaggagcaaagtgtcatctaccttacaaatggacaactgtgtacacattcacagagacactctctgacatgagtctattaatttgctaattttatagaagttgcaaatgcagatggaagtagagaggctcctgtcagctacccagccaaaaccgcagatctaccaaaaatctgcatttaatacacttcatgtattcggagtcatgcaaaaaacaaacactgcagggaatgctgcataaccaagtacagaaatcactccatactcccagcctttcaccatcagctaagtctactcctggaatccttcctaactgcacctagcactgtgtgttttggaagctgactataaatcagtgaaagatcatcattagactgtacatggagtacctcaaagcagaacgtaccctgttccaagagacttggataaaccaggttaccccacttgtggttttttttttttttttttttttccaagccaaactgtatccagctttattaaagatactttccataaacaatcatggtatttcaggcaggacatgggcagacaatcgttaacagtatacaacaactttcaaactcccttcttcaatggactaccaaaaatcagaaagccactataaaacccaatgaagtcttcatctgatgctctgaacagggaaagtttagagtgagggttgacatttcacatttagcatgttgtttaacaacttttcacaagccgaccctgactttcaggaagtgaaatgaaaatggcagaatttatctgaagatccacaatctagaaatggaaccactgctcttttgacaggtgccatctcagtggcatcactggaaagtccagattgcctgacacactggtaaccaatgactaggggtcaggtctcaacagatgtctgggcttaagggagttaagtctatgctgaaagatggaaagggagaagaggacataaaaacaaatttgtttttctataccacaaggcttttgtgccaaggtggccatgtgtgtcaaagtcagggaatccctcctcctgggagccaagaggaagtctctcaaaactagaagggaaaggtgttttctccacatcaatccagctttggagacattctattagtgacatatgccccttcccccaaaaacaacaatgaagtgttctgtgtgctaacaacatagcttttaaaaaaaaaaaaaaagtaaaacaaaattctgcatttttataaaacttgataaaaaatagtatttcaaactgtacagtcaccagaagtacacagttatcaaaaatgcacacacttcacttggcatctccagcaccttcagctttctgtgcctcggtttaaacagacaaattaatgcaatgcgtagatttcaaaactatctgtgttcacattccacctacagcatcactttgctcccaggccaaagttcaggtttcaggtactgagactcagtatttcttctgagaatgacttactaggtaactttgctaagtcacctctcctctgggcctcactgtaaaattgaggtaggaagaacaccagaataagagacctgaggttactcctagcttgaaaacttcatgtagtataaaacacaatgcccttcagctgacagtagagatttcaagaatccaggatttaagttaacaggaaagccacaagcacactggaccaaatggtacatttggagtgatacaagaaaagggcaattaaatttttgatatcagcaactaactgaatgaacaaatctaacaaagggtgaaacagcagttatacctggtctgttttggcatctccattttctgcagggttattcccctccttgccagcatcagcttttccctttttccctttgggtaccttctctcccttctgaaaaaggggaaaaaatagaactgtttctccccatttcgtattaccaaggtatggtctgcaaagttctgcacaaggtaggattgtttactcaagataaaacacaaaccctcacccatttgacaagaacaactgatcaaaactaggctaaattatctgtaatttgctataatctttagtacttagaatttcctaagtaacagaagaataaatcagtttaaaccctggggtatttaatatttaaatgcagattttcctataaactaacaacagaattcttgatcaggaaaccaacgttatgaatgacacggacgaggtaagctatccacacagtttataacctccattaatggaggcaccattatgctaattaagttaaggcactaaggacagtcctcattctgtgaaaatgatcagttccaatgttagcacttacctttgcaggggcctttttaggcttgggctctggctttggaggagcaggtttctttttttggcaggaagagaggaaaaagtgaacatcagtacaatggactgaagaaaaccacccacaaccaaccaaaagtaccaagggtagagaagtttctcctcctcctcaaagtttttgtggttggctttcttctagaatgttggatttccagaagcccactcaaatgtcccactttggctacaggcatcagaatttcagaaccagcaaaacccaaagggcaagagtcccaagtagaggcaatgattcaaaaccaggcactaaccataattcatggaagcaaagggaattgttttttgatgttttttagtttcagggacaagcacgaaaattcaaaagcatacacttacagcagacaacctcgcggatcttctctgtggctattaaagacaacgagaaagttagaaataggacaggtaagtcgctttgaaagtttggtatcaatttgctctagattataggagtgtaaattcaggacacaggttacggttaatcaccgagtccagtggcctctgctagtccaaggctttgacccttgaagagagaatgacttacttcgtccttcacctttgctttatctcccttagcatccccttcagcctataagaaacaagaacaaaaaactgcagattttgaggtggttcttaattacttcccaaactttagagtgctaaaaatgaaaattaaagcagtcgtccacacaacttttctaggacataaatgagtgagcccgacgttcgtataagaacgaagcgcgcgcaggagctccggctcgccgaccccgagaagcgagggctggaccggagcgcagccggggagggcagcggagcccgcaccaccgcgacaggcaggagcaacagctgcagatggcgcaaacaaaccccctccggagcggagcccagcgccgttgctatggcagccgtcgagggcgggagagggaggcgcgcgcagcccggggaactcgtgggcggcgacagcgcgcgtctcgtgcgcggggaacgtgggcgagggggcggggccataccgcacaagccccgcctcacggcggcggttttttggcggcagcgctttcccccgcccgccaaccccgagcgccgccttcccgccctttcgggtttgaattgcccgcccgcagggaggggagggaaggggccctcgcgatgggggagggggcacggggcgggggcggcgagcgaggagagcgggataaacagccgccaacatggctcctcccgccgcggccgccgctcctccaatatggcctctggcgcccgcgggcagccgagccgctcagggttagccccgagctgcccgacaccgtctccagcccccgcgcggggacggtgcgctggctcctgctcggcgccgattctcgctccctgcaccagggaggcggcggcggcggtggcggcagtggtggcccggcgcctggggccctcgcgccacgtacctttctcttgggcatggtggcggcggcgacggcagcgggacgtaggtgctggacgcgggatgcagcggcgcgcgggctttggtcggtccgggggtcgttctcgcctcttcttcacactgctcgggctccggggggtttataaagtttttatagcgctgggagccccggaccggttagaaccgatttcacctcccgccgccgttcattggcccagctggggtcacgtgggcggggtttaaactcacctcctctggagggagtgaggaggggggtgtgtggggggggtagtgcgcggagacggcggcgcgccgagggggtgggggcgcagtcggggtggcgcgcgtcgaaggcagtaaatgaggaggggtgcgcgagtcggcgggctccgggttccggctcccgccaagagctgtcttttgcaaactagcaagttccttccaccttatgcaacccagcaacccacttctccaagccgtgcgacactcacggcgcatctcagcggctttccttcctgctcccgctgggggccccagaagaggggtttgcgaggcctggctgcactgccctgctcctctggaagcaggaggaagcgcgcggctggaggcacaggctgcagttcccagagcccaggctgacgccgaagtgggaaaaaggcggggaaaccagcttggcgcagccggacgtgcatccttccgagctgccacttcggagaagcctttcgtgcacctcacctgaaagacggtcccactcgaggtgggctaggggtttcagggggagactttccatgcagaggtgccttttgggtgccgtgggtcaggtaggagctgtcctttcagcacccgttgcgcagccgcctccccaaatgctatcgaagcccccacccccaactcctctcgggtggctcccttaaggtccctgtattcccaaacctccagaccccgccacagtatggtggagagcggccgtcgaggtctaccagcactcacttccccctacactctacccctctcggagacattttgcccagctgcccaacccgacgcggccaccaagcctgggcactgcagccgcagctggcgaaatccctccttccacactgtcaagctggctgcctttcacttgcgcgaggaaaggagggtggaggaaagcgcccggggattaggaaacaagtagaggaacaggtggtgtgatggcaaaagggctcttccggtgccccctagtccaaagccagggtcttggagctagccaagtgcacctgagggagggtaggcaattgcagcagcaaaagaaggtgttcttccgttgcagttagcaaacaagttttacatctaagaatctttaaaaattctatttgagacccagcacacaagaatacgatagatgtcctcaaatgggggcttggctcacaggtggaaggacactaaattggtcccatctgatttcttgaggcaagggttgaacctggcttgcacaaatcacacctgtccaaagcaaccacgagttctactattttgcagcccttgctgctgggcgacgacgacgacctctctgcctcttctttccaccactacatcgcctcctggggcagcttctccctactccaccctgtgtacctttcccagaatacagaacctcaggccaaagagagatgccagccccattaatcacctctactgtaccccaatcatattacggaaagtcagacccaggagacaggactcaacagccacgctcatagggcagattccgtttgctgcctccagcccctcattcccgccttaattgtagggctctgcattatagccgcataattcatgcctccctaattatggctgtcaacagccccattgtaaagctgtaaaatgtacagcacctgctctccaggaaccctgtgccagggattggtagaggggagtgccaggtgtggatgggggctttgccaaagggttcactgattggcttctcaatcgccgtgtctggcatttatgcttgattctgggagcatggacaatagccaagaagtctcttgccgccaggtatcccgggacagaaaggggaagaggcgggtggggtataggaaagttaggggtttcctgtgtgctcttgctacaacttgcaagatttcacctctcccctagagggagctgctagggaaacagcttgcagaaagtaaaatgggaagtctggcatggtggctcatgcctgtaatcccagcactttgggagggtgaggccggcggatcacctgaggtcaggagttcgagaccagccaggacagggtgagatgctgtctccaaaaaaaaaaaaaaaaaaagaagaaggaaaatggactttaaagagagtagcatttggttggtgttgctggctggtacttgccggtgtggggcacctgaaatagagttgctcaggcagacagctcttcaaaggcactaatcctctcagcagctctgcagcaagtcctggcagagggaggtaagggaaaggacacagctttgaccctcacaagcagaggacctagaacaagctt

SEQ ID NO: 2595 - DNA, 5062 bp, Homo sapiens
cccttctataagggcatcttcgtgacgtcgtaggctgccgttctgggtccccgggtccgagttagtcgctacgaaacggccggccgcttcgacgaatacactcttgcttaggctcactccagaaagcttttgctaaaggtccccggggtgctcagaaccaaggccatgaactcctcctgaaactgtttcagtctttttgtggcttccaaatacacccatttaatttttttttttttttttttttttttttcatattaaacttgtagttttattcaggtttgattttaacaaatgtgtcggggagagagcccgcagggaagggtaaagcccatgggggcagggccctcccagatgcctgaggagggggcaggtcccctcccctctcctcctcttccctccccatctaaaggggtttggggagagacacaggcaggcgagggggctggtccccagtctgttggggtggtgctcagggtaaagggctataggcaacaggggaccagaccagggatgagtggggagggcacaaggaccatttgccagaatccaccgctttctgattccagattgaattaaaaaaaaaaaaaaaaaaaaaaaaaaagactaaaccacaagcagcacccacccccttctcccccaccagggctgtagtgtgaggggagaagaggagggcagcttcaccaaggccacagcttcgctcgctcctggccaagggagctaggtgaagggcaggggctccccgacagattgagggggtggggaaaaccaaaataaaacgtcaaataaattgtgtaggaggagtccagcttaggaccgggccagagccaggccaggctcggggagggggcctctgcaggttcagaggatcactgctgccaccaccgccatcctaggtaggagagagaaattagtaagacaggataataccttcaacaggaaggatagggaggacagagccaggctaggggcaggaagaagcctgaaacaattaagactacagcagctctgctgaggacaacaaaatgtgaaggggacagtgagggatttgtcacactcacctgggagccagttattttgccatggccttgattgcaacagctgcctcctctgtcatggcagacagcaccgtgatctggagaagcaagagggatagccaagagatgtctgagctcaggaagaaacgtacagaacaaagctgagcacaaaagcagggagggaggcaccataccaggatctcttctccacagtcgtacttctgctcaatctccttgccaaggtctccctcagggagacgaaggtcctctcgtacctccccgctgtcctggagcagtgataggtacccatcctggatgccaatcagctgggggcagatagggaaggaggctgaaggtagtaggcccagggaggctgacatgacagtaaaggctctgatagacaaactggactgatagcaaactaataccaaacaccctctcctgccatttccctcctctctcccagcacaatctctcctggtcagtccctatcccccaacccctccctccaccataaaccgctaacccatcctcatccagaccatctacatacctggaagtcattccttttgatgttggggacatccatattatgagttgacgggcagatatcttcatatttcttcccagtaaagatgtcaataccaaccagatggacctgtatgtatgcatcacaaagagaaacccaaccaaactctaaaacggaggaaataaaggctcaaattgaccttgcctgatgagggaagtcagaattacattgttgttggggcaaagactgggagtgttggaattgaaccagtcaactcaagaaacagtaaagcctcttaaagaaaaaaaacagaggctaaaaaaccaccgttgagattggggttgacagcacaatagaaaactgcatggcaggcttggagaagacagttaccttgataaaagataagatgctaagagtctaggggagtgggaggagtctgagtaaaagtttcgaagagttttccggacaccaggagaaggagctgagaaactggggaataaggaaggtagaagggaaaggataagaaactaagaaatgtgaaagagctgaagaaaaggacttccagggagatcagaaacaactatgtagctagaaaataaggaagccagaagagcacagagagggatccagacactagagaataaccaagatcatgtcaagtcaaagatggaaaaactgattaaggaaaaacaccacaagaaattcaacaagaacgtaatcaggttgaaattctaaagagacaggaaagtctgaggtgatgagggaagtgctatcaagaatgttaaaacccatgaaagcatggaggctcaaggaacccaaggagagtgggatggggcaggtaggggcagtttgatcctgcgtcagagttccaaagggaaagctagaactggggaacgaagcagcaagctgacctgaaagctcagaattgacgcaggagtccctccaggggaaggctagaattggagaaaccctgggcaacgtgatggaagcaaccacttacaacggctcaagggaagaaagaaaaagtgaaaaccaagaataaggaaggagcaactgaatagctagagcattaaggcctattaattcaacacattggcacaaagctggagaaacggagggactgccagagaatattgctggggacagaagggtaaccacagaagaggctgaagactgggagcaggtttagttgtctaattttataggctagcgctaaacaaaaacaatcagacagtaaaaggagagttaaaggaaagtcaggacggttggcagcttgctgctgggaggggccaaagatactggaggcatggggaaggcaagatgcggaggtgaaattctaaccttggcgtggccgtgcttgccagtcttcgaagtagacatctcgacgatcttacatggccggcctttgagcaccacaaagccattcttacgtaatgctgagcactgcattgggaaggtggctgaggcccctgcatctcctgtctcgaagtccaagtcatctgccattttaagaggcttcgatccaactaagagccaagaagagaactgaagtgaataagcatggaggtcaacaggacctccaatctatcccatttctctccagaaacattttcccaactctttattccattacccacctaaaataaagtcaaagttcctgaacttaaaatactgactgggctcaaatatctcaagaactggtgtgtgtatgggagggtggaatagctggtttctcccccataaatcaaagctaaagtggtggcttgggaaaggaaggctctagggagctggaatgtcaaatctcagagatgagaaaaggcctacttcctgggagtggggaggactcaggtgttacttgccactgaaaccaaccacccctcttccccacatatagccagggctataattaggtgagcagctataatccagcaaaagggcagggctaattggggggggggagggtggagacggagacaaggccccacccatctgttacactgcccccccccatccacacacaaaccagtcactgctacaggaaaccacaaggcctttttgggggattcccgcctcgccaaaatgcacttgcaacaagggaagggggagaaagcaaagttgtttccgaaatgatccccctgccaaacacctcgatcttggttccccaagagaacccaggaacccagccacaccaggaaggccctcccacttttcccaggatgcatctgtcctgtcggcattttcaggccgggccagtacagtcagtagaaagtgggagaggaggggggtggtgaatgacaataaaatgaaagcaaaaggttggtagtagtgagtagtagaaaatcatactaggctagtagagttaagacttcgaaaccgtggaactcccaaaccagttacaacaggaagacagtgacaaggtgaagaacgcctatcacggtgggaaactcatctgcctgaggcttttaggcgctgtccacccaggccgacagaaaagttgggctcctgtccaaacgccctgtttccccatttctccggcctcccaggtcgaaggggtgccacttacacctgctgaccgccacacttcacaggaggtttttcaggaaagctcctggggcccttgaggttgggaagcgctaacatatgcctgcagcaggccctccggggtgattaggacccgagcctccggcttccactcctcaaaatctcaggccccctcggaacccccgcgaggactagctccccgcgctaggggctgccggctcctgccgaccatgtggccgttccgggcttccggtggccgggacctggggggaggggtccccgccctgccaatgcggccccggtccacgcttggccatgcggcctgcgaccccgagggcagcctcccgtggggggcacttccggtgccgcggccgccccctcctcagagactgcgccaggccggagccacgccgcctcccctccccccggccgtccgccaaccccccccatcatgccctctctccgaatagccccctcccccaccctcacgtggccgcgtctgagccgggtcctcaacggcccaggtacccttgccccggtgcggcgcgatctggccctggccctcgccccggcgttggcgcctggcgtcctcccgcgtggctgcctcgcggctcgccgtccccccccctgcgtcgctccaacgtcaccgggccaaccccaaccgtcaccccgccccccaaccggggccccccgcctctcctcacctcgcgccgctctctggccgaacccgatcccggccgccgctcccctctgccccctccccgacccccgcgcagttccatcttctcccgggcccaagccaaggtaccgcacacgcgccctgcccgctctcacctcgcgcgaacgcactgactcgaccccgtcctcgccgcgagcccaaccgctgcctccgagccgtgccgccgccgccgccgcctctaccgccgccgccgctgctgcacacgggtcttagtacgca

SEQ ID NO: 2596 - DNA, 897 bp, Homo sapiens
  misc_feature (1)...(897): n = A,T,C or G
tggtatttcaggcaggacatgggcagacaatcgttaacagtatacaacaactttcaaactcccttcttcaatggactaccaaaaatcagaaagccactataaaacccaatgaagtcttcatctgatgctctgaacagggaaagtttagagtgagggttgacatttcacatttagcatgttgtttaacaacttttcacaagccgaccctgactttcaggaagtgaaatgaaaatggcagaatttatctgaagatccacaatctagaaatggaaccactgctcttttgacaggtgccatctcagtggcatcactggaaagtccagattgcctgacacactggtaaccaatgactaggggtcaggtctcaacagatgtctgggcttaagggagtaagtctatgctgaaagatggaaagggagaagaggacataaaaacaaatttgtttttctataccacaaggcttttgtgccaaggtggccatgtgtgtcaaagtcagggaatccctcctcctgggagccaagaggaagtctctcaaaactagaagggganaggtgttntctccacatcaatccagctttggagacattctattagtgacatatgccccttcccccaaaaacaacaatgaagtgttctgtgtgctacacatagcctttaaaaaaaanaaacagtaaaacancattctgcattttataaactngataaaaatagtatttcaaactgtcagtcaccagaagtacacacgtatcaaaaatgcacacactttaccttgcatctccagcaccctcaagccttctgtgcctcgactgttttggcatttccattttctgaagggtaattccctccttgccagcttagccttttcccttttacccttgggtaccttcntccctcctt

SEQ ID NO: 2597 - DNA, 944 bp, Homo sapiens
  misc_feature (1)...(944): n = A,T,C or G
aacccnttgttttttttngaaagggngccaatttcaagggggcattcactggaaangtccaaaattgccttgacaccactgggaacccaaagaataaggggtcaagtntcaaaaanaatgttttgggttaaaggaagttaaagtctatgntgaaaagatgnaaaggaagaagaggacataaaaacaaatttgtttttttataccacaaggcttttgtgccaaggtggccatgtgtgtcaaagtcagggaatccctcctcctgggagccaagaggaagtctctcaaaactagaagggaaaggtgttttctccacatcaatccagctttggagacattctattagtgacatatgccccttcccccaaaaacaacaatgaagtgttctgtgtgctaacaacatagcttttaaaaaaaaaaaaaaagtaaaacaaaattctgcatttttataaaacttgataaaaaatagtatttcaaactgtacagtcaccagaagtacacagttatcaaaaatgcacacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttaggcttgggctctggctttggaggagcaggtttagcagacaacctcgcggatcttctctgtggttcgtccttcacctttgctttatctcccttagcatccccttcagcctttctcttgggcatggtggcggcggcgacggcagcgggacgtaggtgctggacgcgggatgcagcggcgcgcgggctttggtcggtccgggggtcgttctcgcctcttcttcccattgctgtcgtcttctcgcagcataggagtagtagaagaacggtcaaaaaa

SEQ ID NO: 2598 - DNA, 900 bp, Homo sapiens
  misc_feature (1)...(900): n = A,T,C or G
tttatccngtttnttaaaaatttntcggnaaaanccccaggaaggtaaacccatggggnaggcctccaaatncctaggaggggnaaggcccctcccatatcctctnttccctcnccatctaaagggtttgggaaaaacacaagcaggggctccccgacagattgagggggtggggaaaaccaaaataaaacgtcaaataaattgtgtaggaggagtccagcttaggaccgggccagagccaggccaggctcggggagggggcctctgcaggttcagaggatcactgctgccaccaccgccaccctgggagccagttattttgccatggccttgattgcaacagctgcctcctctgtcatggcagacagcaccgtgatcaggatctcttctccacagtcgtacttctgctcaatctccttgccaaggtctccctcagggagacgaaggtcctctcgtacctccccgctgtcctggagcagtgataggtacccatcctggatgccaatcagctggaagtcattccttttgatgttgggacatccatattatgagttgacgggcagatatcttcatatttcttcccagtaaagatgtcaataccaaccagatggaccttggcgtggccgtgcttgccagtcttcgaagtagacatctcgacgatcttacatggccggcctttgagcaccacaaagccattcttacgtaatgctgagcactgcattgggaaggtggctgaggcccctgcatctcctgtctcgaagtccaagtcatcttgccgattttaagagcttcgattccaactcgcgcgaacgcactgactcgaccccgtgccgctcgccgcgagcccaacggctgcctccgagccgctgccgccgccgccgccgcctctaccgcgccgcc

SEQ ID NO: 2599 - DNA, 932 bp, Homo sapiens
  misc_feature (1)...(932): n = A,T,C or G
ncccccttttcgnntttcccccnttttnnaaagggggnttttncnanggggttagttggaaccccngggtttcccngcncccgtttnnaaccnncgncngttnattttaanccggccctccttttnggnnaaatttgggnnccngggcccccccctcnggggtttttttttnnnnctnnnnnnnnnngnncnnnnnnntttcttttncncanntttaaacctttggaggttttttattcaggggttttgatttttaaccaaatgttgtcggggaagagcacccccgcaaggggaagggttaaaccccattgggggccaggccccttcccacgattccctgagggagggggcaaggtcccccttccctctttcctcctcttcccctcccccatctaaagggttttgggggagagccacaggccaggcgaggggggcttgtcccccagtctgtttggggttggtgctccagggtaaagggctataggcaacaggggaccagaccagggatgagtggggagggcacaaggaccatttgccagaatccaccgctttctgattccagattgaattgaaaaaaaaaaaaaaaaagactaaaccacaagcagcacccacccccttctcccccaccagggctgtagtgtgaggggagaagaggagggcagcttcaccaaggccacagttcgctcgctcctggccaagggagctaggtgaagggcaggggctccccgacagattgagggggtggggaaaaccaaaataaaacgtcaaataaattgtgtaggaggagtccagcttaggaccgggccagagccagttattttgccatggccttgattgcaacagctgcctcctctgtcatggcagacagcaccgtgatcaggatctcttctccacagtcgtacttctgctcaatctccctcgtgccgaattcc

SEQ ID NO: 2600 - DNA, 1439 bp, Homo sapiens
  misc_feature (1)...(1439): n = A,T,C or G
cgttccccaggtacgcgagggctccgaccaggggatgtttttatactaactgtgggcgtaggattaccttggacaaagcaccaaatctttacggagtgtcggctctcctcccttttacaattacacccctgtaagaaatgatgagatacgaagccatctgatgatatgtcctgcagcattcagtgatatggaatcagtgctaccatgtancatgctacgtcagccacagatgctggttaaggagtaagctatctgaagatgaaaggagaagcgcatacaacaaattgttttcataccacaagctnttgtccaagtgggcatgtgtgcaaagtcaggaatccctcctcctggagccaagaggaagtctctcaaaactagaagggaaaggtgttttctccacatcaatccagctttggagacattctattagtgacatatgccccttcccccaaaaacaacaatgaagtgttctgtgtgctaacaacatagcttttaaaaaaaaaaaaaagtaaaacaaaattctgcatttttataaaacttgataaaaaatagtatttcaaactgtacagtcaccagaagtacacagttatcaaaaatgcacacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttaggcttgggctctggctttggaggagcaggtttagcagacaacacgcggatcttctctgtggttcgtccttcacctttgctttatctcccttagcatcccccttcagcctataagaaccaagaacaaaaaactgcagattntgaggtggttcttaattacttcccaaactttagagtgctaaaaatgaaaattaaagcagtcgtccacacaccttttctaggacataaatgagtgagcccgacgttcgtataagaacgaagcgcgcgcaggagctccggctcgccgaccccgagaagcgagggctggaccggagcgcagccggggagggcagcggagcccgcaccaccgcgacaggcaggagcaacagctgcagatggcgcaaacaaaccccctccggaggcggagcccagcgccgttgctatggcagccgtcgagggcgggagagggaggcgcgcgcagcccggggaactcgtgggcggcgacagcgcgcgtctcgtgcgcggggaacgtgggcgagggggcggttttttggcggcagcgctttcccccgcccgccaaccccgagcgccgccttcccgccctttcgggtttgaattgcccgcccgcagggaggggagggaaggggccctcgcgatgggggagggggcacggggcgggggcggcgagcccgaggagagcggga

SEQ ID NO: 2601 - DNA, 726 bp, Homo sapiens
  misc_feature (1)...(726): n = A,T,C or G
tttaaaccctgttcttgggtgggtgtggggaaaaccaaaataaaacgtcaaataaattgtgtaggaggagtccagcttaggaccgggccagagccaggccaggctcggggagggggcctctgcaggttcagaggatcactgctgccaccaccgccatcctgggagccagttattttgccatggccttgattgcaacagctgcctcctctgtcatggcagacagcaccgtgatcaggatctcttctccacagtcgtacttctgctcaatctccttgccaaggtctccctcagggagacgaaggtcctctcgtacctccccgctgtcctggagcagtgataggtacccatcctggatgccaatcagctggaagtcattccttttgatgttggggacatccatattatgagttgacgggcagatatcttcatatttcttcccagtaaagatgtcaataccaaccagatggaccttggcgtggccgtgcttgccagtcttcgaagtagacatctcgacgatcttacatggccggcctttgagcaccacaaagccattcttacgtaatgctgagcactgcattgggaaggtggctgaggcccctgcatctcctgtctcgaagtccaagtcatctgccattttaagaggcttcgattccaactcgcgccaacgcactgactcgaccccgtccgctcgccgcgagcccaaccgctgcctccgagcncctgccg

SEQ ID NO: 2602 - DNA, 920 bp, Homo sapiens
gtcgaccaagacactccttgcttcaggccactccagacagcgtgtgctgaagggtgccctgggtggtcagaaacaagtgcatgaactttctctttgaagtgtttttgtccctgtttcctagagttcttggcattttacacgtctttctttctttttttttttttttcatattaaacttgtagttttattcaggtttgattttaacaaatgtgtcggggagagagcccgcagggaagggtaaagcccatgggggcagggccctcccagatgcctgaggagggggcaggtcccctcccctctcctcctcttccctccccatctaaaggggtttggggagagacacaggcaggcgagggggctggtccccagtctgttggggtggtgctcagggtaaagggctatgggcaacaggggaccagaccagggatgagtggggagggcacaaggaccatttgccagaatccaccgctttctgattccagattgaattaaaaaaaaaaaaaaaaaaaaaaaaaaagactaaaccacaagcagcacccacccccttctcccccaccagggctgtagtgtgaggggagaagaggagggcagcttcaccaaggccacagcttcgctcgctcctggccaagggagctaggtgaagggcaggggctccccgacagattgagggggtgggaaaaccaaaataaaacgtcaaataaattgtgtaggagagtccagcttaggaccgggccagagcccaggccaggctcggggagggggccttttgcaggttcagaggatcactgctgccaccaccgccaccctgggagccagttattttgccatgggcttgattgcaacaactgcctcctctttcatggcaggcagcacccggcatcaggatctcttctccacagtcgtacttcttcttaaatctc

SEQ ID NO: 2603 - DNA, 620 bp, Homo sapiens
tattagtgacatatgccccttccccccaaaaaacaacaatgaagtgttctgtgtgctaacaacatagcttttaaaaaaaaaaaaaaaagtaaaacaaaattctgcatttttaaaaacttgataaaaaatagtatttcaaactgtacagtcaccagaagtacacagttatcaaaaatgcacacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttaggcttgggctctggctttggaggagcaggtttagcagacaacctcgcggatcttctctgtggttcgtccttcacctttgctttatctcccttagcatccccttcagcctttctcttgggcatggtggcggcggcgacggcagcgggacgtaggtgctggacgcgggatgcagcggcgcgcgggctttggtcggtccgggggtcgttctcgcctcttcttcaccctgctcgggctccggggggtttataaagtttttatagcgctgggagccccggaccggttag

SEQ ID NO: 2604 - DNA, 611 bp, Homo sapiens
cagctttggagacattctattagtgacatatgccccttcccccaaaaacaacaatgaagtgttctgtgtgctaacaacatagcttttaaaaaaaaaaaaaaagtaaaacaaaattctgcatttttataaaacttgataaaaaatagtatttcaaactgtacagtcaccagaagtacacagttatcaaaaatgcacacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttaggcttgggctctggctttggaggagcaggtttagcagacaacctcgcggatcttctctgtggttcgtccttcacctttgctttatctcccttagcatccccttcagcctttctcttgggcatggtggcggcggcgacggcagcgggacgtaggtgctggacgcgggatgcagcggcgcgcgggctttggtcggtccgggggtcgttctcgcctcttctttgggggggggaaattaatttaattaaggatccttgagctcc

SEQ ID NO: 2605 - DNA, 564 bp, Homo sapiens
aaaaaaaaaaaaagattaaaccacaagcagcacccacccccttctcccccaccagggctgtagtgtgaggggagaagaggagggcagcttcaccaaggcctcagcttcgctcgctcctggccaagggagctaggtgaagggcaggggctccccgacagattgagggggtggggaaaaccaaaataaaacgtcaaataaattgtgtaggaggagtccagcttaggaccgggccagagccaggccaggctcggggagggggcctccgcaggttcagaggatcactgctgccaccaccgccaccctgggagccagttattttgccatggccttgattgcaacagctgcctcctctgtcatggcagacagcaccgtgatcaggatctcttctccacagtcgtacttctgctcaatctccttgccaaggtctccctcagggagacgaaagtcctctcgtacctccccgctgtcctggagcagtgataggtacccatcctggatgccaatcagctggaagtcattccttttgatgttggggacatccatattatgagttgacgggggatc

SEQ ID NO: 2606 - DNA, 706 bp, Homo sapiens
tttttttttttttttttttttttttttttttttccaagccaaactgtatccagctttattaaaaatactttccataaacaataatggtatttaaggcaggacaggggcaaacaatcgttaacagtatacaacaactttaaaactccctttttaaatggactaccaaaaatcaaaaagccactataaaacccaatgaagtcttaatctgatgctctgaacagggaaagttaaaagggagggttgacatttcacattaagcatgtggttaaacaacttttaacaacccgaccctgactttcaggaagggaaatgaaaatggcaaaatttatctgaagacccacaatctaaaaatggaaccactgctcttttgacaggtgccatctcagtggcatcactgaaaagtccaaattgcctgacacactggtaaccaatgactaggggtcaggcctcaacagatgtctgggcttaaaggagttaagtctatgctgaaagatggaaggggagaagacgacataaaaacaaatttgtttttctataccacaaggctgttgggccaaggtggcccatgtgtgcaaagacagggaatccctccttctgagagccaaaagaagtttctaaacctagaagggaaatgtgttttctcccataaaacccacgtggagaccattcataccgacattgccccttccccaaaaacaacaaggaa

SEQ ID NO: 2607 - DNA, 650 bp, Homo sapiens
  misc_feature (1)...(650): n = A,T,C or G
cgcttaattaaagatttttttttttttttttttttttaaaaaacaaaattctgcatttttataaaacttgataaaaaatagtatttcaaactgtacagtcaccagaagtacacagttatcaaaaatgcacacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttaggcttgggctctggctttgggaggagcaggtttctttttttgggcaggaagagaggaaaaaggtgaacatcagtacaatggactggaagaaaaccacccacaaccaaccaaaagtaccaagggtaggagaagtttctcctcctcctcaaaagtttttgtgggttggctttcttctagaatgttggatttccagaagcccactcaaatgtcccactttggctacgggcatcagaaatttcagaaccagccaaaccccaaggggcaagagtcccaagtagaggcaatgattccaaaccaggcactaaccataattcatgggaagccaagggaatggtttttgganggtttttaggttcaggncaag

SEQ ID NO: 2608 - DNA, 652 bp, Homo sapiens
  misc_feature (1)...(652): n = A,T,C or G
ttggancatctattaggcanatcccttccccaaaacaacatgaaggtctgttntacanatactttaaaaaaaaaaagtaaacaaattctgcatttataaaacttgataaaaatagtattcaactgtcagtcaccagaagtaacagttacaaaaacacaactcacttgcactccacaacttcacttctgtgcctggtctgttttggcaactccatttctgcagggttatcccctccttgccacacactttccctttttcctttgggtaccttctctcccttctttgcaggggcctttttaggcttgggctctggctttggaggagcaggtttagcagacaaacctcgcggatcttctctgtggttcgtccttcaccttggctttatctcccttagcatccccttcagcctttctcttgggcatggcggcggcggcgaacggcggcgggacgtgggcgccgggcgcgggacgcagcggcgcgcgggctttggtcggtccaggggtcgttcttgcctcttctccttcacactgctcccacgcttttttaattgacaaaattcaaaatatagcccaattttttgtaatgccttttttggtgagaataacattgcctctaatcagggttctaagtaagtgttccctgtgatcaaaat

SEQ ID NO: 2609 - DNA, 664 bp, Homo sapiens
  misc_feature (1)...(664): n = A,T,C or G
tgtagtgtgaggggagaagaggagggcagcttcaccaaggccacacttcgctcgctccctggccaagggaagctaggtgaagggcaggggctccccgaacagattgagggggtggggaaaaccaaaataaaacgtcaaataaattgtgtaggaggagtccagcttaggaccgggccagagccaggccaggctcggggagggggcctctgcaggttcagaggatcactgctgccaccaccgccaccctgggagccagttattttgccatggccttgattgcaacagctgcctcctctgtcatggcagacagcaccgtgatcaggatctcttctccacagtcgtacttctgctcaatctccttgccaaggtctccctcagggagacgaaggtcctctcgtacctccccgctgtcctggagcagtgataggtacccatcctggatctggatgncaatccagctggaagtcatnccctnntgatgttgggggacatccatattatgagntgacgggcagatatctncatatttcttnccagtaaagatgtcaataccaaccngatggaccttggcgtggccgtgcttgccagtcttcgaagtagacatctcgacgatcttacatggccggcctntgagcaccacaaagccattcttacgtaatgctga

SEQ ID NO: 2610 - DNA, 495 bp, Homo sapiens
  misc_feature (1)...(495): n = A,T,C or G
aatctccttgccaaggtctccctcagggagacgaaggtcctctcgtacctccccgctgtcctggagcaagtgatagggtaccccatcctggatgccatccgccgggaggccattccttttgatgttggggacatccatattatgagttgacgggcagatatcttcatatttcttcccagtaaagatgtcaataccaaccagatggaccttggcgtggccgtgcttgccagtcttcgaagtagacatctcgacgatcttacatggccggcctttgagcaccacaaagccattcttacgtaatgctgagcactgcattgggaaggtggctgaggcccctgcatctcctgtctcgaagtccaagtcatctgccattttaagaggcttcgattccaactcgcgcgaacgcactgactcgacccccatcgctcgccctcgcgagcccaaccgctgcctccgagcccgtgccgccgccgccgccgccccncgtgccgaatc

SEQ ID NO: 2611 - DNA, 482 bp, Homo sapiens
tcgctcgctcctggccaagggagctaggtgaagggcaggggctccccgacagattgagggggtggggaaaaccaaaataaaacgtcaaataaattgtgtaggaggagtccagcttaggaccgggccagagccaggccaggctcggggagggggcctctgcaggttcagaggatcactgctgccaccaccgccaccctgggagccagttattttgccatggccttgattgcaacagctgcctcctctgtcatggcagatagcaccgtgatcaggatctcttctccacagtcgtacttctgctcaatctccttgccaagtctccctcagggagacgaaggtcctctcgtacctccccgctgtcctggagcagtgataggtacccatcctggatgccaatcagctggaagtcattccttttgatgttggggacatccatattatgagttgacgggcagatatcttcatatttcttcccagtaaag

SEQ ID NO: 2612 - DNA, 438 bp, Homo sapiens
ttttttcatattaaacttgtagttttattcaggtttgattttaacaaatgtgtcggggagagagcccgcaggaaggggtaaagcccatgggggaagggcctccccacgatgcctgaggagggggcaggggaaaaccaaaataaaacgtcaaataaattgtgtaggaggagtccagcttaggaccgggccagagccaggccaggctcggggagggggcctctgcaggttcagaggatcactgctgccaccaccgccaccctgggagccagttattttgccatggccttgattgcaacagctgcctcctctgtcatggcagacagcaacgtgatcaggatctcttctccacagtcgtacttctgctcaatctccttgccaaggtctcctcagggagaagaaggtcctctcgtacctccccgctgtacttgagaagtgata

SEQ ID NO: 2613 - DNA, 577 bp, Homo sapiens
  misc_feature (1)...(577): n = A,T,C or G
tcatattaaacttgtagttttattcaggtttgattttaacaaatgtgtcggggagagagcccgcagaagcggtaaagcccatggggnaagcggcctcccagatgcctgaggagggggcaggtcccctcccctctcctcctcttccctccccatctaaaggggtttggggagagacacgggcaaggggctccccgacagattgagggggtggggaaaaccaaaataaaacgtcaaataaattgtgtaggaggagtccagcttaggaccgggccagagccaggccaggctcggggagggggcctctgcaggttcagaggatcactgctgccaccaccgccaccctgggagccagttattttgccatggccttgattgcaacagctgcctcctctgtcatggcagacagcaccgtgatcaggatctcttctccacagtcgtacttctgctcaatctccttgccaaggtccccccccggggggccgaaggtcctctcgtacctccccgctgtcctggagcagtggttgggtcccctccctgggatgccaatcagcggggaagtcagtccttttgatgttgg

SEQ ID NO: 2614 - DNA, 354 bp, Homo sapiens
  misc_feature (1)...(354): n = A,T,C or G
aaaagactaaacccacaagcaagcacccacccccttctcctaanaccagggctgtagtgtgaggggagaagaggagggcagcttcaccaaggccgacagttcgctcgctcctggccaagggagctaggtgaagggcaggggctccccgacagattgagggggtggggaaaacnnaaataaaacgtcaaataaattgtgtaggaggagtccagcttaggaccgggccagagccaggccaggctcggggagggggcctctgcaggttcagaggatcactgctgccaccaccgccaccctgggagccagttattttccatggccttgattgcaacagctgcctcctctgtcatggca

SEQ ID NO: 2615 - DNA, 370 bp, Homo sapiens
  misc_feature (1)...(370): n = A,T,C or G
tttttttttttttttttttttttttttttcatataaaactgggagttttattcaggtttgattttaacaaatgggtcggggaaaaccaaaataaaacgtcaaataaattgggtaggaggagtccagtttaggaccggcccaaacccaggccaggctcggggagggggcctttgcaggttcaaaggatcactgttgccaccaccgccaccctgggagccagttattttgccatggccttgattgcaacagctgcctcctttgtcatgggagacagcaccgggatcaggatcttttctccacagncgtacttttgctcaatctccttgccaaggtctccctcagggagacaaaggtcctttcgtccctcccc

SEQ ID NO: 2616 - DNA, 398 bp, Homo sapiens
  misc_feature (1)...(398): n = A,T,C or G
cagttatcaaaaatgcacacactttcacttggcatctcaagcaccttcagctttctgtgcctggtctgttttggcatctccatttttctgcaagggttattcccctccttgccagcatcagctttttcccnnttttccctttgggtaccttctctcccttctttgcagggcctttttaggcttgggctctggctttggaggagcaggtttagcagacaacttcgcggatcttctctgtggttcgtccttcacctttgctttatctcccttagcatccccttcagcctttctcttgggcatggtggcggcggcgacgggggaccagaccagggatgagtggggagggcacaaggaccatttgccagaatccaccgctttctgattccagattgaattta

SEQ ID NO: 2617 - DNA, 410 bp, Homo sapiens
  misc_feature (1)...(410): n = A,T,C or G
tccccgctgtcctggagcagtgataggtacccatcctggatgccaatcagctggaagtcattcctttttgatgttggggacatccatattatgagttgacgggcagatatctttcatatttcttcccagtaaagatgtcaataccaaccagatggaccttggcgtggccgtgcttgccagtcttcgaagtagacatctcgacgatcttacatggccggcctttgagcaccacaaagccattcttacgtaatgctgagcactgcattgggaatggtgctgaggcccctgcatctcctgtctcgaagtccaagtcatctgccattttaagaggcttcgattccaactcgcgcgaacgcactgactcgacccctgtcntcgccgcgagcccaaccgctgcctccgangncnct

SEQ ID NO: 2618 - DNA, 320 bp, Homo sapiens
ccttacacactggtaccaatgactaggggtcaggtctcacagatgtctgggcttaagggagttaagtctatgctgaaagatggaaagggaggaggaggagcataaaaaacaaatttgttttctataccacaaggcttttgtgccaaggtggccatgtgtgtcaaagtcagggaatccctcctcctgggagccaagaggaagtctctcaaaactagaagggaaaggtgttttctccacatcaatccagctttggagacattctattagtgacatatgccccttcccccaaaaacaacaatgaagtgttcctcgtgccgaat

SEQ ID NO: 2619 - DNA, 531 bp, Homo sapiens
tttttttttccaagccaaactggatccagctttattaaagatactttccataaacaatcatggtatttcaggcaggacatgggcagacaatcgttaacagtatacaacaactttcaaactcccttcttcaatggactaccaaaaatcagaaagccactataaaacccaatgaagtcttcatctgatgctctgaacagggaaagtttagagtgagggttgacatttcacatttagcatgttgtttaacaacttttcacaagccgaccctgactttcaggaagtgaaatgaaaatggcagaatttatctgaagatccacaatctagaaatggaaccactgctcttttgacaggtgccatctcagtggcatcactggaaagttccgattgcctgacacactggtaaccaatgactaggggtcaggtctcaacagatgtctgggcttaagggagttaggtccagtcgacgcggccggaatttgagtatagtagttccccccggaattccgaccggatcttgggttgacaagtttc

SEQ ID NO: 2620 - DNA, 479 bp, Homo sapiens
tttttttttttaagaatctttaaaaattctatttgagacccagcacacaagaatacgatagatgtcctcaaatgggggcttggctcacaggtggaaggacactaaattggtcccatctgatttcttgaggcaagggttgaacctggcttgcacaaatcacacctgtccaaagcaaccacgagttctactattttgcagcccttgctgctgggcgacgacgacgacctctctgcctcttctttccaccactacatcgcctcctggggcagcttctccctactccaccctgtgtacctttcccagaatacagaacctcaggccaaagagagatgccaggttttttttttttttttttttgttttttggtggttgctttgaactttatttgagaaaaacagaagataaatgtatcaaaagaacacacaggtggcgggggaggcacagcagtggcggcacaggggttgggcatccgggctaag

SEQ ID NO: 2621 - DNA, 291 bp, Homo sapiens
atatcttcatatttcttcccagtaaagatgtcaataccaaccagatggaccttggcgtggccgtgcttgccagtcttcgaagtagacatctcgacgatcttacatggccggcctttgagcaccacaaagccattcttacgtaatgctgagcactgcattgggaaggtggctgaggcccctgcatctcctgtctcgaagtccaagtcatctgccattttaagaggcttcgattccaaacgtttcagaaaacttgctctgtggggtgggcgccttgtcttggaatcagtcccc

SEQ ID NO: 2622 - DNA, 556 bp, Homo sapiens
  misc_feature (1)...(556): n = A,T,C or G
ccccactttgcctacngcatcagaattcanaccagcaaanccaaggggcaaantccccagtagggcaangatcaaacccggcactacccataatccaggaacccaagggaaatgttttttgatgttttttaatttcagggaacaaccacgaaaaattccaaaagccataacacttaacagccagacaaacctcgcggatcttctctgtggctattaaagacaacgagaaagttagaaataggacaggtaagtcgctttgaaagtttggtatcaatttgctctagattataggagtgtaaattcaggacacaggttacggttaatcaccgagtccagtggcctctgctagtcccaaggctttgacccttgaagagagaatgaccttacttcgtccttcacctttgctttatctcccttagcatccccttcagcctttctcttgggcatggtggcggcggcgacggcagcgggacgtaggtgctggacgcgggatgcagcggcgcgcgggctttggtcggtccgggggtcgttctcgcctcttcttcacactgctcgg

SEQ ID NO: 2623 - DNA, 335 bp, Homo sapiens
  misc_feature (1)...(335): n = A,T,C or G
tacacagttatcaaaaatgcagacacttcacttngcatctccagcaccttcagctttctgggcctggtcttttttggcaactccattttctgtagggttattcccctccttgccagcatcagcttttccctttttcccttttgggtaccttctcagggncctttttaggctntgctctggctttngaggagcaggtttagcagacaactttgtggatcttctctgtggttcatccttcaccttgggctttcatctccntcagcatccccctcagccttttctcttgtggcatgctnggcaacaacagngacgggactaggttgctgggcacagtg

SEQ ID NO: 2624 - DNA, 533 bp, Homo sapiens
  misc_feature (1)...(533): n = A,T,C or G
aaaaaaaaaaaggaaacaaatctgnttttataaactggtaaaaatagattcaaactgacagcaccagagacacagtatcaaaaatgnacacacttcacttggcatctccaggacttcagtttctgtnctggctgttttggcatctccattttctgcagggtattcccctccttgccagnatcagcttttccctttttcctttgggaccttctctcccttctgnaaaaggggaaaaatagnactgtttctccccatttcgnattaccaanggatggtctgcaaagttctgcacaanggtaggattgtttactcaagataaaacacaaaccctcacccatttgacaagaacaactggntcaaaactanggctaaattatctgtaatttgctataatctttagtacttagaatttcctaagtaacagaagaataaatcatgtttaaaccctgggggtatttaatatttaaatgcagattttcctattaaactaacaacagaattcttgctctctctctctctctctctctctctct

SEQ ID NO: 2625 - DNA, 389 bp, Homo sapiens
  misc_feature (1)...(389): n = A,T,C or G
aatccttcanatttctttcccagtaaaagatgtcaaaatncccaacaagatggacccttggcgtgcccgtgcttgccagtcttcgaagtagacatctcgacgatcttacatggccgncctttgagcaccacaaagccattcttacgtaatgctgagcactgcattgggaaggtggctgagccccctgcatctcctgtctcgaagtccaagtcatctgccattttaagaggcttcgattccaactcgcgcgaacgcactgactcgaccccgtccgctcgccgcgagcccaaccgctgcctccgagcccgctgccgccgccgccgccgcctctaccgccgccgccgctgctgcacacgggtcttagtacgcaggcgccgcggacgcgtggg

SEQ ID NO: 2626 - DNA, 321 bp, Homo sapiens
  misc_feature (1)...(321): n = A,T,C or G
ctggaagtcattccttttgatgttggggacatccatattatgagttgacgggcagatatcttcatatttcttcccagtaaagatgtcaataccaaccagatggaccttggcgtggccgtgcttgccagtcttcgaagtagacatctcgacgatcttacatggccggcctttgagcaccacaaagccantcttacgtaatgctgagcactgcattgggaaggtggctgaggcccctgcatctcctgtctcgaagtccaagtcatctgccattttaagaggcttcgattccaaacgtttcagaaaacttgctctgtggggtgg

SEQ ID NO: 2627 - DNA, 340 bp, Homo sapiens
  misc_feature (1)...(340): n = A,T,C or G
acttcacttggcatctccagcaccttcagctttctnggcctggtcttttttggcaactccattttctgtagggttattcccctccttgccagcatcagcttttccctttttccctttnggtaccttctcaggggcctttttaggcttgctctggctttngaggagcaggtttagcagacaactttgtggancttctctgtngttcatccttcaccttggcttcagctccttcagcatccccctcagcctttctcttgggcatgctggcaacaacagcgacgggacggaggtgnctgggcacagggatgttggttgntgtgcgggctttggtcggtccngg

SEQ ID NO: 2628 - DNA, 304 bp, Homo sapiens
  misc_feature (1)...(304): n = A,T,C or G
ccctttgggtaccttctctcccttctttgcaggggcctttttaggcttgggctctggctttggaggagcaggtttagcagacaacctcgcagatcttctctgtgattcatccttcaccttggctttatctcctttagcatccccttcagtctttctcttgggcatggcggcggcggcggcggcgggatgtgggcaccgggtgtgggancagcagcgcgcgggctttggtcggtccaggggtcgttcttgcctcttctccttcacactgctcccacgcttttttaattgacaaaattcaaaatac

SEQ ID NO: 2629 - DNA, 388 bp, Homo sapiens
  misc_feature (1)...(388): n = A,T,C or G
ttcatattaaacttgtagttttattcaggtttgattttaacaaatgtgtcggggagagagcccgcangaangggtaaagcccatggggnangggcctcccagatgcctgaggagggggcaggtcccctcccctctcctcctcttccctccccatctaaaggggtttggggagagacacaggcaggcgagggggctggtcccagtntnttggggtggtgctcagggtaaagggctatgggcaacagggntcgtgcccaattcctgcagcccgggggntccacttagttntagagcggccnccaccgcgttgggagctccaactttttttttccctttaagttaagggttaattttcgaactttgggcgttaaatcaatggtcatnagct

SEQ ID NO: 2630 - DNA, 290 bp, Homo sapiens
aaaacaacaatgaagtgttctgtgtgctaacaacatagctaaaaaaagtaaacaaattctgcattttataaaacttgataaagaatattcaaactgtacagtcaccagagtacagttataaaaaatgcacacacttcacttggatctccagcaccttcccgctccttgctagcatcagcttttctctttttcctttgggtaccttctctcccttctttgcaggggcctttttaggcttgggctctggctttggaggagcaggtttagcagacaacctcgcagatcttctc

SEQ ID NO: 2631 - DNA, 281 bp, Homo sapiens
gcggctcgctgacacacacctacacccacatcgagagctgccagtgcgaggacaccgtatgcgggctccccaccggcacctcctccggtgtcctcctcttccctccccatttaaaagggtttggggagagacacaggcaggccagggggttggtccccagtctgttggggtggtgctcagggtaaagggctataggcagcaggggtccagaccagggatgagtggggagggctcaaggcccacttgccagtatcctccgctttttaaaagcagattgaatt

SEQ ID NO: 2632 - DNA, 293 bp, Homo sapiens
  misc_feature (1)...(293): n = A,T,C or G
canataccccttccccccaaaaaccaccattgaagtgttctggngtctaaccacattgcttaaaaaaaggtaaaccaaaatctgcaattttataaacttgataagaatattttcaaactgtacagtcaccagaagtacagttataaaaaatgcacacacttcacttgggatctccagcaccttcccgctccttgccagcatcagcttttctctttttcctttgggtaccttctctcccttctttgcaggggcctttttaggcttgggctctggctttggaggagcaggtttag

SEQ ID NO: 2633 - DNA, 283 bp, Homo sapiens
  misc_feature (1)...(283): n = A,T,C or G
tgtataaagtaatatttcaaactgtacagtcaccagaagtacagttataaaaaatgnacacacttcacttgggatctccagtaaccttcccgctccttgccagcatcagcttttctctttttccctttgggtaccttctctcccttctttgcaggggcctttttaggcttgggctctggctttggaggagcaggtttagcagacaacctcgcagatcttctctgtgattcatccttcaccttggctttatctcctttagcatccccttcagtctttctcttgg

SEQ ID NO: 2634 - DNA, 255 bp, Homo sapiens
gcacacacttcacttggcatctccagcaccttcagctttctgtgcctggtctgttttggcatctccattttctggagggttattcccctccttgccagcatcagcttttccctttttcctttggggagcaggtttagcagacaactcggggatcttctttgtggttcgtccttcacctttgctttatctcccttagcatccccttcagcctttctcttgggcatggtggcggcggcgacggcagcgggacgtagg

SEQ ID NO: 2635 - DNA, 213 bp, Homo sapiens
  misc_feature (1)...(213): n = A,T,C or G
cccttttgatgttgggnacatccatattatganttgacgggcagatatcttcatatttcttcccagtaaagatgtcaataccaaccagatggaccttggcgtggccgtgctttnatgatgtctnaccncagatnnnggcnatcgntagttggccggcctttgagcaccanaaagccaatcttacgtaatgctgagcactgcattgggaaggtg

SEQ ID NO: 2636 - DNA, 192 bp, Homo sapiens
  misc_feature (1)...(192): n = A,T,C or G
aaactgtatccagctttattaaagatactttccataaacaatcatggtatttcaggcaggacatgggcagacaatcgttaacagtatacaacaactttcaaactcccttcttcaatggactacctgaaataccatgattgtttatggaaagtatctttaataaagctggatacagtttggcttgaaaaaaan

SEQ ID NO: 2637 - DNA, 3575 bp, Homo sapiens
tttttttttttttttttttttttttttttttttttttttgctgtggctcgtagtgttctggcgcaattgctggttataattcgtggattcttctaatcgagcttctaaagcagcaattttttcttcttttatttcaagagacttcttaagagtggattctaattttgattccaaaagtttatacctactgtcatcagtactttgttcatcatgtaagagtcgctccttatttaaccctatcttctcaagctcatgagttaatttttcgagatcattgttcatctgttgggtcttcaacttttcactcaccaaatcctcacgtagtgtaaccaacgtttttatatcaatagttgctcttttcacaagctccttattttctttttctagttctttcagacggacacaagattctttatatataccaatttctttggatagggttttgttttctttttccaaatttccaatcttcacattattttcttctaatgtggtatctttaatttctgcttgttgtcggagtctcttattttccttctccaattgtttcttatccttttccagttgagaagtctcttgctctaatgatttattttctttttccagctgttctagtcttttgctagatatttttagttcttctaggtttttctgcaatgtttgattttccatctctaagtcttgtagttcactctctaattgctggatttttttattgctgttctctaaagttttttgcagtctttgattttctatatctaaaccctggtagctaacttctaagcgttctgttttcttgaaagatgctttcaggagctccaaacccttcttaagttgctctttttcactttccagttctttgttttctagctgtagctgagccattttcatgcttgcacacttcaaagattctacattccttcgcagttctaagttttcctcatcaagttgggaattctctttttctagggattctaactgaaaggtcagatttttaaagctatccaatgttttttttaattttctattttctctttctagctctgaattttcttgttctaaggcctcaattttttcacaagtaatttttaaattagttatttttttctgtaataattcattttctttttcaagatgatgcaattcattttcaagttcttcagctcgttctcctttttctttataatgttccaattcttttttaatttgtcttttttcaaattcaatcttgcttagcttgctacttgtttctttgatagattcatgaagaattttgttttctttttcaatgtctttcactcttgcttctgcacttatctgggaccgctgccttaaggaagacactgtttgattcagatgttcattttcctgttccagtatcttaatctgtctctctgaattttctctcagtgtttctattgttttttcaagctgagctttctccttcattagatccttgcttaaattctgacaattctgaagactttgcttttcttgaacaatctcattttcaagaatctcaacctttttactgagcctttgattttctttttccattttcaggattttggaagcattgccttctacagaatccacagtagtccgaagctcttctacggtttttgtcaaactttgattttccatctctagcttcaataatctacttgatgtcaactcattcacctcatggcccagggatttctggggtgcttcggaaagttcactagttctggatatctgttccagttcccagccaagatgtaatgattcatccatactttgtttctgtgccatttccaaagtcatattttcttccattaattcttcaatcttttttctatccatatctcgttccatttccatatcatgaagtttagctttcagttgtaagttctctttttctaattcatgtaatttatcagaacgagcacgagttccctctagttggtcttccaacatggtttttgtttctaataaaacttgattgtcttcttttaattcctcaactcttgccttataaaattcaatatcatgtagtctctctttatatctgctgacttcactttcaagcttatcgactctgactgctttctctcgaagtgcatctaattcatctcggtacattctggcagagcgagcatccgaaagcaaattcatgttctcttgttgcagccttttgagttctatttccatttgctcaagttcttgtttacaatccaacaactgctcagtcttttcctccaattcctgcctaagccttcttatcttggctttagcatctgccagttccaccgacagatgttgtcgactttctgttcgcttcatgcctggagaaccacagggtgactgtgcagatgaagaggcatggggtagaaaatggagaccatcccgctcttcagagagttctatgatagtctctgaatgttcatctctctcatctataagtctttttagatgcaatgccatatttttcaagagtggttctatgtcctcctgcgacatatcagtcacttccatccattgcaggtcaaacacattttcctgattatgagttacctcttgaatatgtgcggcaaccgctgcttttgtatcaaaatctaaaccttgaattctttcaataaattcctcttttttctgacactgaactgcacaacccaataaaagtaaaagcagttttttaacttcttctgtgccttgttcagaaaagggatttttgccaatgattaagacatttggcaacgacatcatgatcaattgctgcaaagtctcctggtaataaaattttatctgtctcaccaaaatggatagattgtgcattctaagtgaggcatcattattgactttttatttactctctgactctccaatttaggattaatttggagcatgacctggttcaagaataccccatccaccaaagccacatattcatcaaggttggtcccatttcctgcggccagaggtccaaacgttttaacccaagtgaccaaagggctggtcatgaactgctccagaaggggagtaaaaatttcgttctccattttacagagtatgtatttgaaaaaaggaactaccacaaaaatacgcctagggaattggtcactaaacgtggaagtaagtagaaatcaatgaaagtccatttcggcaagggagaaaaatcccatcgtggaggaggggggcactctccctcctcaaaaaacaccccagagtgaaacgagccgaaatcccaagaagtggcttcgacgacggacaccacgagcagcagcctgcgctggaaatgtctgtaccgggcgaggagggcagagaaaaggcatctggaggaggaggaagggaaagggggctggaacccaagacaaaaagcccgtcaaggttgtccagctcctggaggatccagaccagcgaaactgctcccaatgaatcaatcccaacgggggctaaatgaaatacgttaaacagagaccacgttaaggataccgaggcgccaccagactcgacctcggcgttccgacctctacacgttccacccaccgatgggcatggagccgctttcgacccgcggagcctccactgcccga

SEQ ID NO: 2638 - DNA, 642 bp, Homo sapiens
  misc_feature (1)...(642): n = A,T,C or G
aattttctattttctctttctagctctgaattttcttgttctaaggcctcaattttttcacaagtaatttttaaattagttatttttttctgtaataattcattttctttttcaagatgatgcaattcattttcaagttcttcaggtttttctgcaatgtttgattttccatctctaagtcttgtagttcactctctaattgctggatttttttattgctgttctctaaagttttttgcagtctttgattttctatatctaaaccctggtagctaacttctaagcgttctgttttcttgaaagatgctttcaggagctccaaacccttcttaagttgctctttttcactttccagttctttgttttctagctgtagctgagccattttcatgcttgcacacttcanagattctacattcttccgcagttctaaagtttcctcatcaagtggngaattctcttttctagggattctactgaaggtcagatnttaagcttncatgntnttttaattctatttctcttctactctgattntcttgtctaagcctaattatntactatcatgactgnctttgtcactganaagatcctgcttcatatttgtcanagggtctgtctgacataatgctgnttgatcat

SEQ ID NO: 2639 - DNA, 445 bp, Homo sapiens
tttttttttaattttctattttctctttctagctctgaattttcttgttctaaggcctcaattttttcacaagtaatttttaaattagttatttttttctgtaataattcattttctttttcaagatgatgcaattcattttcaagttcttcagctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaa

SEQ ID NO: 2640 - DNA, 483 bp, Homo sapiens
tgccaaatgaggacattattttatttaaaaaaatacatatagaatgctagaaaggccataaatccagaataaaaggcatcctttaaactgttaagatttaacaataggaaaaccttatgccaacctccttatttttctcattttgacacatacttgtgaaaacactgacacaagctagcaatatttccataagcttaaaaatattgtttaggtcacctttgggaccatataatttcaatgaacctcaaaaatcagcaacttacaattcctgcctaagccttcttatcttggctttagcatctgccagttccaccgacagatgttgtcgactttctgttcgcttcatgcctggagaaccacagggtgactgtgcagatgaagaggcatggggtagaaaatggagaccatcccgctcttcagagagttctatgatagtctctgaatgttcatctctctcatctataagtctttctagatgcaatg

SEQ ID NO: 2641 - DNA, 313 bp, Homo sapiens
tttttttttcactgttttaagttcttggcgcaattgctggttataattcgtggattcttctaatcgagcttctaaagcagcaattttttcttcttttatttcaagagacttcttaagagtggattctaattttgattccaaaagtttatacctactatccaagtacaaagtaatgtagttcattattggaggtcagaaaattagttttaaagataatttatgaccacaaatattcatgccataaatgggtcttataaaagcatttttgttaaagaggcaaatgaaattatcctcttcttactgccccattctc

SEQ ID NO: 2642 - DNA, 1578 bp, Homo sapiens
ccgaggttcgggctccgttggccgaggggggcgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggcctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaaaaaaaaaaaaaaaaaaaaaaaaaaaaaaaaaaaaaaaaaaa

SEQ ID NO: 2643 - DNA, 1026 bp, Homo sapiens
  misc_feature (1)...(1026): n = A,T,C or G
atacctagctcctacctagcaggaagtaggcatcggtgccactgttgctctgtgcgtatttttttgcagggtggtggagggattgacagtttggcgcttctgccatccatactatgtgctcactccacagggatccctttgctattcaccgtcagcatatgagccgtatgttgtcaggtggctttggatatagccccttcctcagcatcacagatggcaacatgccagggaccaggctggttggtgacgctttgcctggccttggataagaactcttgttttcaaattcccttgaggtctcttccaagaatcttttgcattttttctgataaatcaatcataaggaagtttctgaaattctctttcagaccctacaacccacaagttactgcaaagctgggcttctaccagaagtgagtgatttgaaattgaaaacagatttcggatctcacctgagtagctcgagtgtaagggagggactgggagagccacagagaacatttgtcaatccagaaccaaccattcatggtgttgcttgactggagggcagggaaggaaaggactagaagcaaggcgaaacaggatctttctgtagatacacacatataagtcttggatttgcattttagggtgaattgtaattagcttgagatgaccaggggcccaccaatcaagcaactctggggaaaaacacttgtctacatctttaagtttctttgtctattaaaatgttcaagatttggaactaacactacatggattcttctcggggaactcacccgttcctaaattttccactccttcttttcacagggcagtgtaactttaactccctgtttcaactttgggtgtaaaatacaggctcacaagcacttttgctttgcagcggaactnaggaagaccctgctgtggaattttgcagaggggctgagcagtggtgggaaggacagcggcccatgtaccatgttgggcccctgcattccaaggtgtctgcctagaaataaatgatagtgtatttaacatact

SEQ ID NO: 2644 - DNA, 426 bp, Homo sapiens
gtaaagtactggataaagtaattgaaccagagagccttgggaccctgtacctgctgtcatgcctgcctgaagcagccggcagcagctctcttacgtagcatacaattaaggccctgtctcttcaggtccttcttgctcgtggttggactcagaggaatttgggagggtaatgatgaggcctgatgttttttcagctaccctggatctttgcccacctcttcctcagagcccccactgtagggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaaaaaaaaaaaaaaaa

SEQ ID NO: 2645 - DNA, 568 bp, Homo sapiens
ggctgcaaggcagctcagttcaggctcccgcagagctgccatttggtagtacaagttgacatggaaagagaacaatgttctcactgacataggggattaaaccccaactcctggctcttaacgtaagttttttccgccgctatgactggtgagggccccgcgccctttccccctctctggtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgcccacacgcattgaagggtcaatgcatcttggggtgagccctacacccttctctgcctttattttttgatttgtgcaacttgtaactaggtgtttatggaataaaggagaatggaaaaaag

SEQ ID NO: 2646 - DNA, 387 bp, Homo sapiens
aaaaaaaaaaaaaaaaaaaaaaaaaaaaaaaaaaaaaaaaaaaaaaaaaaaaaaaaaaaaaaaaaaaaaaaaaacttcccatcctactcctgccatgcattgaagggtcaatgcattttggggtgagctctgggtttaggggccccctccatccctcagctaccctggatctttgcccacctcttcctcaaagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggaaaatgcaaaaaaaaaaaaaaaaaaa

SEQ ID NO: 2647 - DNA, 403 bp, Homo sapiens
gaataactttttcctctcgattcccatccccgaatttaatattaaattaacaggcaagccggcccccacctctccctgggggtctcagggagaacctttcacggcaccctttcccatcctactcctgccatgcattgaagggtcaatgcattttggggtgagctctgggtttaggggccccctccatccctcagctaccctggatctttgcccacctcttcctcagagcccccactgtagggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatgg

SEQ ID NO: 2648 - DNA, 406 bp, Homo sapiens
  misc_feature (1)...(406): n = A,T,C or G
attcccatccccaaatttaatattaaattaaccagcaagccggcccccacctctccctgggggtctcagggagaacctttcacggcaccctttccctaccttttccttctttaatctcctggtttaccattgatgacttcgcctctgcatctactgacttgatttttcattctgcccctccatccctcagctaccctggatctttgcccacctcttcctcagnanccccactgaaggccgttancctatctagggctgtggaaggagcagactggttcttaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 2649 - DNA, 418 bp, Homo sapiens
agcgaaacgcgccggatgggccgctgacgcgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaccaaa

SEQ ID NO: 2650 - DNA, 341 bp, Homo sapiens
ggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgcctttattttttgatttgtgcaacttgtaactaggtgtttatggaataaaggagaatggaaaaaagac

SEQ ID NO: 2651 - DNA, 348 bp, Homo sapiens
ggatgggccgctgagcccgaatcgggcactgtgtggagccccctggagctgagatcaggatgttccgcttcatgagggacgtggagcctgaggatcccatgttcctgatggatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaaaaaaaaaaaa

SEQ ID NO: 2652 - DNA, 560 bp, Homo sapiens
acccaacctctctcttcacagacgagcagctgacaaccatcacctgaatacattttcagctcgttcccacccccaatttaatttaacttcaacatgaaggacggcccacacactatccctggtgtcatcagggagaacctttcacggcaccctttccctacctctccttctctaactcctagtttaccattgatgacttagcctctgcatctactgacttgatttccattctgccactccatcttaaaaccacctaacctttcccatcctactcctgccatgcattgaagggtcactgcattttggggtgagctctgggtttaggggccccctccatccctcagctaccctggatctttgcccaactcttcataagtacccccaatagaggaccgataccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaa

SEQ ID NO: 2653 - DNA, 873 bp, Homo sapiens
tctccttgtattcactcccgacatctgcaagctccttgtagaggccatccccctgggacgaagcaagggccagcatagtggtgatgctgcccttcaccttctccacgattccagtcttcagctgctgaaactggtgctgcatcctttcctgggccctttcaaacatgccctcagccacctgccggtccactcctcttctgatggcatctttcatccgctcacacgcttttttgcctgtgatctgagctgcctcttcgtaacagagcttcaggtcactctggacagaggcagtgagggactcgtagatcctcctcttccttctgaggatgtggtcctccaggcccccgaggatggcacttatctcctggatcaggaaattttttttgcagctatcatatttccagccacttcttatcccaatttctgtcattagcgattctcctgcagggactgcttaaaagcatctatgtgaggcatcagagctgtaccagtgggcttccccgtcctaaaaatgcttccaaaaacagggtcgatctggtcatagacgggctgagtgagggcttcatttagatcaattctcgccagagtcctggaggcatagatgccatttttcaggcaaacagctttcagggtctgatgaaaaccttggtttcctttactcctcaccaagcatgctctgaggatgcagcggtaagaagtcctggcggtcctgaccccttcttgcagaggctgctccatgcaggcgaagcactgtgcgatggccttctccagcagctcaaccttctcttccgcaaatctccgcaggacactcatgtgcaagtgttcattcggcaggttttgcgtggagttgaaactatctgtgaggagcaacag

SEQ ID NO: 2654 - DNA, 448 bp, Homo sapiens
tttttttttggattcctaaaagctttattttgcaatgttttccataatacttaagtttttcaatgtttagatatttttctttattgaaggatgaatttctttttatggcttgttttatatcttgcaatgttttttctataatgtttaagtttttttatgtatgggtgtgtgtgtgtatatatatatatttttttctttttctttttttttttttttttttgagacatagtctcactccgtcgtccaggctggcgcgaccttggctcactgcaacctatgcctcctgggttcaagcgattctcctgcagggactgcttaaaagcatctatgtgaggcatcagagctgaaccagtgggcttccccgtcctaaaaatgcttccaaaaacagggtcgatctggtcatagacgggctgagtgagggcttcatttagatcaattctcgccagag

SEQ ID NO: 2655 - DNA, 1004 bp, Homo sapiens
cttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggtgattcgcatctaggtggcggcagtcgagaaggctcgtttaaagaaacaataacattaaagtggtgtacaccaaggacaaataacattgaattacactattgtactgggagcttatcggatttcacctgtaggatgtaagtagtaggaccttcctcctgccttacttaattttcttctaaagggtcgttctgttttattggggaacaaccacggaaagtcagggttcttaaagtccattaggtccatatggcttaggtaggccctggggagggagagatttttttttggcacgtcccctagggcagttcttcggatccccttactagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacg

SEQ ID NO: 2656 - DNA, 557 bp, Homo sapiens
cagaggtactgctccttatggagcagggatgccccataggcagtcagcccagagtagcagctcagaggcagttctgcacacatatttatacccacttgtaactatatacaaattaaggaggaggttatttagaaatttctagaaaaggggtggtaactttcaggtcattgccatggaaaggggcagtaatttccagctgttaccatgagaacggcaaactcacttggcaccagtgggtgtgtcttatggaggggtgcttttgcctgtttcagctagtctgtaatctggtccagagttcaagccctgcctcaggagtcaggtcccacctcctatctcagtctggtcacagccctaactaggcagatgatcccaatgtcagcccaaagcccagcagtcaggccctcctgtgatctgcctggggcacccaggaaggggatggggcatgctgggatgggccatgatgtgttgggccagaagtcaggccctctagggtgaagtcctaaccccagtagctgggaatgggaccttatatggagatagtggctttgcagaggatc

SEQ ID NO: 2657 - DNA, 2216 bp, Homo sapiens
cacacacgctcccacctccccttacatattgatccatctcaattttgaggaaatgctcaaattataagcaaaatttcaggattttttcccccaatcagtgatttgactgttggcaagctgctttggtgggcagcagtataagaaattgtttggaatgcctggctagaacagataaaatggatgtgatcagtgaattattgtaacctattgtagtaaacagatggatgggaaggatttaccttatgaacttccctcactcatttcagaagggagaaaattatgtcttaataaggcaagaaaaaaatcagataagaaaatacagcactttgggaggccgaggcgggtggatcatgaggtcaggagatcgagatcatcctggctaacatggtgaaaccctgcctctactaaaaatacaaaaattagccaggcatggtggcaggcacctgtaatcccagctactcgggaggctgaggcaggagaatcgcttgaacccaggaggcagaggttgcagtgagccgagatcacgccattgcactccagcctggggtacaagagtgagacttcatctccaaaaaaaaaaaaaaaaagaaaagaaaatacagtaaaatattaatactgtagtgacagcaaggaagggtaggattctcagcaccctaccttgctgggaaagtttctggcataaaacgtcaaactctctaccatcaatctttgcacaaggatggacagttgcttacatcaagaggggcagaaagccacttaaatacttttcttcaaagatgagacattcctttttgaactgagcattagagaaaggagaaagaattagggaaagctcactcaaagaggtcctcaaacatgcgttgtcccattgctatatatgcttccttttcttctggtgtcatctgggccactagctctggccgttggctcacttcactgtaggagaacggacggccagccaccatgacaatggggtcatctgctacttcttcaaactcgtcatcttcctcttcatcctcttctcgtttatgcacagccacagctgccggacggggtggagaatcatcatctgactcactggtctcgctttctgagtcactgccattggcagcggtcactggagcagctgcccccactgaaccagccatggcagaggaagtctttttctcgtgaatgagcagtgctcgcatgacctcttcgttgtcatcaggcccagcatggccttcctcacgctcctgaaatgcgtccatatctatgcccccttctttcatatcttcagaaccatatgccccttggacagtgctttctctcaaccaaataggcctctctttggcagatttcccttccagtgaggctcgatgaagatcttcttggtcatccatgttaatgacaacattctgagtgtataagtcttcataggaaggacctttggtggcccatgcttcccggtggtgcccacctgctaggctagcagctccagcagtagttgctgcatggtccttgctctgtttcagggctgggatttctgtgggttctggctcaagtatttcataggccaagttcacatcctctgtctcccgaagcaatgcataaatgggctcaatttgttcattaaaccttgccaaaagtgtgcgtgcatcttttttgggcattgctgattcatcctcttctacctctgtatggcaaaaagtacagcggaaagttcctgtcataggatcaaagagctgattagcttctaagtctgtgaaagtactactacagacaggacatttgaaggaagcccggttggtcgaatctctctcatcggtctcaattcttcttctcatgtggtccagtttatattttaccacattaacaagagtacgataattgatgaagtagtagttatggcgagtggttttcccgtctgcagcagtctctaccctcattctgcatttgataaacttgtctccctttaaattattcaaaactgatcgaagttgcttccgatcaaacttgagcagctccagcatatcctcctctttcacacaggagttcctgatcaagatgtccaaggccaaggcatgctcaatgccataaaatccccggatcacatacttggctaaccgcttcaatgctgctggaacttcagtgaggacatctgggtctgccatctttagcaacgaactccaactttaaatatacaaggcgaatcctggaacactcccactacagct

SEQ ID NO: 2658 - DNA, 1234 bp, Homo sapiens
gcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctgctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaaaaaaaaaaaaaaaaaaaaa

SEQ ID NO: 2659 - DNA, 847 bp, Homo sapiens
ggcgttcccccaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcaaaaaaaatttcaagcattgtacaatttgagactgagtaatttaacaataagtaaaaagtggacatgctaaacaaaaaaaaaaaaaaaaacaactttttctggtcattcttgacttggaaaacggtatggaaaagtatttagttacatgtttgtttgtttttttcttacacagtacttacactaatttggtatcagggtatgcaacagtgaaatatcccaataaacaaatgtaagaacagcaaaaa

SEQ ID NO: 2660 - DNA, 738 bp, Homo sapiens
atcttttcctgaccatgtaatctaaagtagaatcctactttattctttttcagtttatactgttctttttctcttcactgtaatcaccatgatttataattctacatttgtttaattgtgtcatatatatttcttttatagctcataacttctaggagaactggttagccttgggtatctgctgtgcctggcacaatgtaaattttaaatgaatgaacacaaatgaattgtatttccacaattttgaatcttggtatagtggaaagaatattactctggaggtcaaggggctgtagttcttgtcttctccatgaatattctttatgtgccacttctaccatctgtgaaatgagggatgggagggggaacttgaggaagtggtattagatgatcattaatagtcctgtcagcatattattgtagggttttatgaatattataattgcattttagaccataataaccaaacattacatattgatatatttaatttttttatttaagtggtacatgatcagcattgtccacatttacaatcgatggagaaacagtgaaattcagtgttatgttaatggacaactggtatcttatggtgatatggcttggcatgttaacacaaatgacgtaagtctttatttttctgtctgtgttttaatttgtttgagagtatgatctatcattacaaaatgaattgaataataaaatagtttggtagaaacttaaaaaaaaaaaaaaaaa

SEQ ID NO: 2661 - DNA, 565 bp, Homo sapiens
ctagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccccagaagatggggcctatggagaaattctggaataaatttttggagaataaatccccttggaggaaaatggaaaacccatatggcatagttgaaaagaagtccagaatattccctggtgatccaattctggagactggagaagtaattcccccaatgaaagaatttcctggtccacacccttaaagattatgtaaaaagttaaaaggcttatgagcctaagtttgttcctatattaccatatttactgaattttctggaaaagtaactttaataaagtttaatcccagaaattgtcatatctgttttcaagccttggacaatttgagactgagtaatttaacaataagtaaaaagtggacatgctaaacaaaaaaaaaaaaaaaaaaaaaaaaaaaaaaa

SEQ ID NO: 2662 - DNA, 646 bp, Homo sapiens; identical to SEQ ID NO: 1018

SEQ ID NO: 2663 - DNA, 708 bp, Homo sapiens
  misc_feature (1)...(708): n = A,T,C or G
cctccaggttcaacagtatggctccaaatgatgaaatttcattctgattttctggctgaagactattctgtttgtgtatgtccaccacagttactttatcccttcatctgtggatgggcagttggttggcagagaatttgaactggagatgaactttattatccaggatgctgagagtataacatgcatgacagagcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcaggtatggggttgtctgtcaggaaagtataacttaaatgtttataaagtttcacatacttctctttatattctataggtaatgtagatttgttgacactgctttgatttaaaataaatggaaatgtatagaaattttactttttatattaatggaaaacctgaaaagtgaaagaagaaaaacataattattatagtagacaaacataattactaacgttgttttctaaattttagaaaatctcagtaccacggagtgctatgaagtctatcagaaaaataaacagtatctttttatgtagtatttcattaagcttttacataattaaaatgccccaataggtattacaaanntaata

SEQ ID NO: 2664 - DNA, 460 bp, Homo sapiens
  misc_feature (1)...(460): n = A,T,C or G
gcttaagtaacaagtccgtagttcgagggtgcgccgtgtccttttgcgttggtaccagcggcgacatgacggggtacactccggatgagaaactgcggctgcncagctgcgagactgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtattcatgtttctgaaaaaccatatgggcatagtttgaaaagaagttccagaatttttcccnggtggattaccatttctnggagactgggagaaattatttccaccnattgnaaaggattttccnggttcnacatc

SEQ ID NO: 2665 - DNA, 817 bp, Homo sapiens
tgggttcacgccattctcctgcctcagcctcctgagtagctgggattacaggcacccgccaccacgcccagctggttggtggagaatttgaactggagatgaactctattatccaggatgctgagagtataatacgcatgacagagcttttagagcactgtgatgtaacatgtcaagcagaaatagggagcatgtttacagccattctatgaaaaagtgtttggaatgtacagactagcacagaagttgggctaattaaacaagtattgctgaaaatgagtgctgtagatgacatgagagcaggtatggggttgtctgtcagggaagtataacttaaatgtttataaagtttcacatacttctctttatattctataggtaatgtagatttgttgacactgctttgatttaaaataaatggaaatgtatagaaattttactttttatattaatggaaaacctgaaaagtgaaagaagaaaaacataattattatagtagacaaatggtccatggggtatacaaaaagagtatctttgttttcactcatgtacttgtacctgtctggattattcattattacatgaaggatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcag

SEQ ID NO: 2666 - DNA, 464 bp, Homo sapiens
  misc_feature (1)...(464): n = A,T,C or G
gaaaccccataggccaagttgaaaagaagccccgganaatcccccgggngaaacaaatccggnagacgggagaagtaatcccacccaaggaaagaattcccngaccaacatcattaaagattatgtaaaaagttaaaagncttatgagccctaagtttgnccctatattcccatatttacctgaantttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaanntnttatc

SEQ ID NO: 2667 - DNA, 552 bp, Homo sapiens
  misc_feature (1)...(552): n = A,T,C or G
tgcagatggcaggatttcccaaaggtttctggctgaaacatattccgtggtgtatctgtacagcagtttcctcatccctgcagctgtgtttgaacaggttcaacagtatggctccaaaggatgnaatttcattctgattttctggctgaagactatcctctttgtgtatgtccaccacagttactttatcccttcatctgtggatgggcagatggagtctcgctgtattgcccaggctggagtgcagtggcatggtctcagctcactgcaagctctgcttcctgggttcacgccattctcctgcctcagcctcctgagtagctgggattacaggcacccgccaccacgcccagaatgaaacatatatggaaatgttctgtgcaatcaaaacagcagtggtaacagaggagatgtaggctctgagtgtctcactggagactgaagtccacagatatgcaacaaagcctttgtctccctgatgtttttgcctcctgctggtcatgtgctttcacacatcaagagaggacatttaacatttgaaaaaaaaaaaaa

SEQ ID NO: 2668 - DNA, 336 bp, Homo sapiens
  misc_feature (1)...(336): n = A,T,C or G
aaccttttagagggagatttaaatatcactcaataccccagagctcaaaatcatatcctataaagggatggcatgagagagttttttggggtgacaaaactgttctgtatcttgactgtggtgacagtcataggaattgatacatgtgctaaaaattcatagaccgcaagtagcattgcctttacatataatgctaaggccactgatactcagctctgcctggaatcatcaccaaaagngaatgcatcaatttttgtgcattccccacatgctctaatgcttcaggatgtgaaagcgatagtaacacattcaattcatagtgcaattcantcaatt

SEQ ID NO: 2669 - DNA, 483 bp, Homo sapiens
aagtggtacatgatcagcattgtccacatttacaatcgatggagaaacagtgaaattcagtgttatgttaatggacaactggtatcttatggtgatatggcttggcatgttaacacaaatgacagtaccttcaagtttaaatctgagagtgatattcatttggcagaacatcataaacaggttttgtatgatgggaaacttgcaagtagcattacctttacatatactgctaaggccactgatgctcaactcttgctgggaatcatcaccaaaagagaatgcatcaatttttgtgcattcccaacatgctctaatgcttcagattcaagtgctttttccactgtttccccaattggataatcggcagctcaatgacagtcaagtggaaacaactgtctggtaagttttctttacatgtgcaattgctggtattttatacacacttagactatgcatgatgtactcagtgctgtgtaaatgtat

SEQ ID NO: 2670 - DNA, 218 bp, Homo sapiens
gcatcgacatagaagaataatccttaacagtctgcatactgacattagattacagaatgttgacaatttgacttggaaaacggtatggaaaagtatttagttacatgtttgtttgtttttttcttacacagtacttacactaatttggtatcagggtatgcaacagtgaaatatcacaataaacaaatgtaagaacagcaaaaaaaaaaaagtcgacg

SEQ ID NO: 2671 - DNA, 2033 bp, Homo sapiens
gagtagggtgctgtggtctgagctagagggtgaagctggcggacaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagaaaaaaaaaaaaaaaaaaaac

SEQ ID NO: 2672 - DNA, 416 bp, Homo sapiens
ccttttgtgagtttagggttttgatggtgctttggggctttgatcggactttgtgcttgcatttgccgaagcttatatcccaccatttccacgggcattctccatctccttgcagataccatgctgtgaagtccaggccacatggaggtgtcctgtgtagatgctccagctgaaatcccaagctaagctcccaactgacagccaacatcatttccagccatgtgtgggagccatcctggatgtccagccttaacaagccttcagaggacttcagccacagctattatcttactacatccttgtgagactctaataaagaaccaactagctgagcccaatcaacctatggaactgatagaaataaaatgaattgttgttttgtgccgctaaaaaaaaaaaaaaaaaaaaaaaaaaaa

SEQ ID NO: 2673 - DNA, 358 bp, Homo sapiens
cgatacaatggcacagtgggattgtggagacggtgtatcaccatacccaaaaacatgcattggtatagcccaccagaaaggacaggtatttctcttattttaactttctgtcttcttcacctggttaataatagacaaaacgacgtaatgattgcccaattacatgtaagcaggtttgttggttctctctctccttaaagaaataaatcgtgtatcttctctttctactgccttctctccccaacttctttgcattaccatggtactcatcaatattggttggatgaggaacttttcttatcttgggaaagccttaatggctttttttttttcttatttactcactcattaaaataaa

SEQ ID NO: 2674 - DNA, 413 bp, Homo sapiens
tggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatcccagtactataaagaacgtttcaccataatgaccctccagagctgggaaacctaccacaagatttaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgacctttaaaaaaaaaaaaaaaaaaaaaa

SEQ ID NO: 2675 - DNA, 402 bp, Homo sapiens
ttgaatctaggctggcttgtgatggttttgaccaatagagtgtgcctgaaatgacactcttctcatgaggtcctacagatcatgtgtccttaaaccagttctcttggaacactcagtcttagaacattccctctccaaacccagataccatgctgtgaagtccaggccacatggaggtgtcctgtgtagatgctccagctgaaatcccaagctaagctcccaactgacagccaacatcatttccagccatgtgtgggagccatcctggatgtccagccttaacaagccttcagaggacttcagccacagctattatcttactacatccttgtgagactctaataaagaaccaactagctgagcccaatcaacctatggaactgatagaaataaaatgaattg

SEQ ID NO: 2676 - DNA, 334 bp, Homo sapiens
atattgccattgcggggataatggtctgaaatcacggtaacatttcttttctctctttttaaaaatcagatctttggcgttgcagttccttttaccttttgtgagtttaggtttgatgtgctttggggctttgatcggactttgtgcttgcatttgccgaagcttatatcccaccattgccacgggcattctccatctcctttcaggcaatgtgacagggcagttaatacgtgaacatttcagatttataactctttggtccctaaagagacaggaagaagctaaaaggtaagtatgatgacaaaacctacctgcaaggaagatgggtccgacg

SEQ ID NO: 2677 - DNA, 4205 bp, Homo sapiens
gaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatcttcgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccgctctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagcccacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccaggttagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggaaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttaaaaaaaaaaaaaaaaaaaaaaaaaaaaaaaa

SEQ ID NO: 2678 - DNA, 4711 bp, Homo sapiens
ttttttttttttttttttttttttttttttttttttatttcactgttatcaaacaaataagttttattggcatctaaaaacaaaattcacccaacattgaaacgtactttaatatttatgttgttgttttcttgtttcttttttactcactgcagtatgaggaacaaatcacaaacacttactttggagaaacagagaccatagtgtagattttacaaaatcactttttaaaatctctgtattgtgctcctcaaatacctagagccagtctttgcataaaatatcacagctttatctataaccttaaaattctgcagcagcctaaagatatggataagatataccaccacttgctattctgaaatatatctattaccatatccaacctaatgatagtatctaaaaaattctttcttccataggaagtctctgacaagctgttattcatttccttgacgttaaaagaatctggggccaacatttgtattttatcagaaaaaaataaaaaaaaagtttacctaccatgttcatattaagaacaatgtctatacaagtcagttgtacaattattttaagagaaaggtgaacatgaacatcagattaacttaattctggcagacaaaagtgaacaactatggtccagtcagccattatctattacagagagatgacaactttacaaaaggtatcttttacctactgagtgatgattatgtcccctcagtttctgtgctttctaccactggttcactttctatatcagcaactgtgtcactcttctccttgtttatttcatttgaagatgtcagtttttcataaagttcaggatcattctgtactggtataggtggtggctgagcatgtctctctgtattttcaccattaacctgaggcacattatcaccttttcgttgagaagtggccccttcaaaataatcaaaaacccgagcatgaggagggggaacccaagtgttttgaattctgtctcgtccaagacgatttccattcatttctctgcagaaatcaaaatctctgtcatccctatccctttgcctctcccagggtcttctgcggtcatcaaaatctctgtgaacttcttgtccaaatcctcggttccaaggaccacttctaggatcaaatcgatagtttccagaccgaaatctacctctttcttcatgtaagccttttggaccaccatagaccggtagaacccgatgctctctctcatcaaaatctcctctatgcccccagggcttctctggattaaagccaaagtggtctcttcgaccaagatgatctatacctggcctcacaagattctctcttatatctacaggaggtcttccaaaatgatccctaccatctagtggaggccgtccaggaccttctcttggatctataggccgcccaaccacatctctaacatccacagggggaggtctactaatgctttccctggtttctataggaggaaaccggtaatctctatctccttcctgttgaatgttatcattcccaagtggtatccttttttctgggttagtaacattgtctacgctttgtcttccaggagctaaaaaaggtctttctggttgactaaaaatatctcctggaggaaaaggtccacggggtggtggatgaagagctgaatcaagtaccgatgggggtgggattccccgttggggtggaattccaggctgtattaaagggaatcttggcccaggtgcctgtggtattagtcccggacgaatgtctaacattggcattgtgggcatcctttgattagggatacttaaagggggtaagttttgaggtccagctggtggctgtgttcccagaagtccaggagtatttggaacatttggtggctgtactcctacaagtccagaattgttaggtatatttgggggtagcactcccaaaagtccagaactatttgacacactgggtggctgtattcccaatattccagagttatttagaatatttggtggttgggctgcaataatcccagaactactggaaacattagatggccggaccccaagaatttcagaattacttgatacatttggtctttggactcccagaattccagaattgcttgtcacatttggcggctgtcctcctaaaattgcagcattacttgaaatatcatttggaatcactgatctggtgttttcaccagaagaaatctggtggtctataagatgaggtactttttcttcaggctctgcctgtttagttggagcattaaaaacatttccagctggcagagcggaagtagcaagattgctggcaacagaaccgcctggtataacaaggctaccaaatccaacatctttcacagtttccggtgtcatggataatgacggctgcactaaagatgttggtactactggtggaatcgtagggggtggcacaacaggtgggggaactggaggcggcatgaaaccaggtggtggttgtgaagggttaaaacttgctcttaaaaaaggaggtggagggattggactgaatccaggaggaggaaccggcatcgacacaggaaatgctggtgggactaaactaactgtaggcacggctggcgccactggaatctgcaacatagcaacaggaggagggaaaacctctgcctgggttgtgaccactgtctccttttcaactggagttgggctctgagttgtctggaccgtctctttaacaggttctgagcttttcacagtttcccactcagtatttacagtctcctgatcaatcatgcctccttctgcaaaaccttccaagtcatccactttaactttttcccatggtatatatgtaactccaagatccacatcccagaattgtttgtattctgtttttacacctttgtttaaagcccaagcaatcttaatgaccttggacccaattttatatgatccagaactgagtttctgaagagctcgaaatgcatcttgtcgatgaaccatgcagacataagcacagccccggggaggaatcatattaatggattcaatctgtccaaactcttcaaacaggttggttaagtcttgctgtgttgccttcttgtccacttgcccaacccagagagtagtactacatacacttagtgttttagatctaattggaggtaatccctttttctgtcgttctttctccctttctctggctctcctttcacttgaatacgaccgtgatgatttcctctttctttctcttgagcgggagcgtgatcgctttctgtgtttacgctttctagagccagaccgtgacctagaccttcgttttcttggtgatcttgaacgagatcgtgaatgtgttcttgatcttgagcgaaccgccactttcttagcttcttgttcaaagacctcctcttccactccatcttgcccttcatctatatccatatcctgttgctgaatatctatggaatcatccaaattgacttcaggttcaagaaaatgctgctgactactcccttgtgatggtgacgctgaatgctctgacccaaaggttccttcctgactatcctgaggagtggccttttgaggctgttgctgctccaagagctgctgtctgagatgttctaggttttgctgttgtagttgttctgctatctgatgaaaaatggaattgttcacagattctgaaacgtgagaaagttgtgaagctggaatttcctttttgggttcttcactatgctcagagtcttccccaaaatcaaacctatccatcaacttcttgttaaaggagactccctgttctaagggagtaagagtgttggcagctgcagctgcagctgtaagttgtgccgtaagagcttgcaactgaacaacaagaccagcatctagggcctgcagaatggaaggctggggcttctgttgttgtatctgtaaggtttgtattaattgttgaagctgctggccttgaggactttgcaagatctgagctacagccgcaagtgtatctgtatttgttatctgagatacccacggatcaggtaagccttggaccacattggccggagtaacaggtgtcacaggagttcctggagtattgctcatagcagtggtagtgctggccaaaacaggtgtgacaactggaggcggaatcccggctgccatatccaaaaggggctgaataatctcactcttaaatacattattcttctgccataagtttagtactctcactattttactcttgtcatccccagggcaacgatataaattctggaaagtgctaatgatgttattactaaatctgggtgcaaacacatccttttcttgaccaaactgatgtcgggattgtcgcacaatggagtcaataacataaagtccaggtactttgtattctggtttacatttctgaataaacttctcaacactctgtaccacatgtttatagaacttaatagctttgatggctgccttagtaatttgggtcattttcgctttcgaaatgggtggtttatagtcattcagggaatacaactcgctattgaaggtcttcacggcctccatgttgtcgctgcggaggccccgagcccggcggcggaagaggcggcggccactgcactgggtggggagagcgagacgcgggctgctgcgtggccgcgaggagggggcgctggcgggagagcgggccgctgcgacctcggggcggagtggaagggcacgcgctggcggggaagggctccctcagcggc

SEQ ID NO: 2679 - DNA, 1414 bp, Homo sapiens
  misc_feature (1)...(1414): n = A,T,C or G
ncaccactgataccagtattgctgaaatggattttgcaaatttaacccctagaagagaagagcgagaatgaagcaaaatgcttctttcaggtgagtgtgtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataaggtgagtataactgagggggaaggacttaatttttcaagcatgaagtacacaactgaaactcaaatttttattccttccacagaaaacactagagaaacttcgagccaaaaatacatgctgactttctagaaatagtgtaaaggttttttaattgtgtatatgtagcattagacaaaattatttaaagtcaataaattgttattcgaggaattccatgttgtgatttcttccactgtccatcaaggtcactttagatcctctaaagagctggagtcaaaagatttatcttcaagtttgccctttttaatgaaactgatccagttgtcctgtcagcccataattactttggcttctgtcatctcgttttaatatggatatactgatgaagacttcaaaattcaccaagaatctttgggatctaatttcttcaaccaatttactttagggtcctttttactgtaggtggtggggatctacctggttctcaatttgacaccctctcaacatgaatgagttcaaatcacattcattcctaagcgatcactcaagaatggtacagatgtgtggagtatgccaatacctttaactccagacaccatgttctcaagataaaagcttcttgacattcatgatcctgaactcatggtttcaagcaatactcccaccctggtgtgtgngattgcaggttgacccattgcacctggctggaacgacctttatggctatcatactccatcaatcactgtctcggtatcatatatccgntctatatgtacaaactcatactgacaatgagtctgggtgcaaagagattatttttgcactatcgtagtctctcgtgcgattctggctcaggcaa

SEQ ID NO: 2680 - DNA, 998 bp, Homo sapiens
  misc_feature (1)...(998): n = A,T,C or G
ggctcaactgtaataatcccaattgtcatactctgtatctttgttcattatttaagtataactatattaaaggcaaaatatgaagcaattaacatagaaatttaatttataacctattaccaaagtatttcatatganttccacttacgttgactcctcaataggagaaatggatccatcatcatccaaaaatttggtatctacggactggtcaaaatcttcattttctaaatcttcaccaacattcatttgcttcaatgattctttcaggtggtgttcatacttcagtttttcaatatagttaaaaaatcctcttgcaacagcttgctcaaacgttaaaatttttctccaaggtgcgtttttttcattctctgattctaaaaatgggaagccagatcctctgcttctaaattgtttcttcttatctattagtgagtatataggatttctccttccttcgtggtcttccccgtggtcttcctgttggctggtacctcctctttttcttttttctatatctctttttcctgttcttgaatctttcaaaaatagcttttatagtcaatggtattggttcaaaagatgagtcacttgatgaatcacttgcgtgaacactttcaggtgtacgaacaaattttcgaatggggtttcttttctcccctttaggtgagtaagggatacactgagttttaaataagctgctatcagaagagttatcacttcgatttgcaagttccacagcatcagatgtcacatggtcaagagaatctattcctgatttatccatcaattgctctttgttttaaacagttttctaaaacggcctcgcagtggccccaaccgcgcacttgctgcttgtaacccaggcctcggcccaaaacccgcgactggcctggtgcgtgagtcctagagctctgtacacaccaccctcccgacctcagccctccaactcccgataaccagccgacctcctccaaccgtgcggaagaaaaaaaaaa

SEQ ID NO: 2681 - DNA, 918 bp, Homo sapiens
  misc_feature (1)...(918): n = A,T,C or G
gaaatgtttaaagccttgtgtttacaacttgatttcacttttctttcctcaggttcatctgtgagtcgtctaaagggcgtgaataaagtcagagcatcttttcctgaagacagaaagactacacaggctctaaggcaccaaaggggtctaaggttatacaatcaactagctgaagtgaancaacaaaaggaagaaaaaacaaaacaagaagcttatgcccaaaacagagcaagggcaaaagaattccataaggtgagtataactgagggggaaggacttaatttttcaagcatgaagtacacaactgaaactcaaatttttattccttccacagaaaacactagagaaacttcgagccaaaaatacatgctgactttctagaaatagtgtaaaggttttttaattgtgtatatgtagcattagacaaaattatttaaagtcaataaattgttattcgaggaattccatgttgtgatttcttccactgtccatcaaggtcactttagatcctctaaagagctggagtcaaaagatttatcttcaagtttgccctgaagaagagaaattttgattaacctttaaaactctcacatggcaacaatcatggattattacgttttatatctcctcaggaaaacatagcaccaaacattaggagtgctatagggcttcctatagagaacttccatctttggtcacagcgttaagagctctgggtttcacagcctcataagccctctttgaaatgacccatacaaatgtcttttctaatgcatacatacctttttaatgaaactgatccagttgtcctgtcagccctacataacaatagtataaaagtaaattttacatttccagagatgagtgtacagtgagtgaacatgaatgagtccctagaacgagcctgagttaactcta

SEQ ID NO: 2682 - DNA, 781 bp, Homo sapiens
gagtagctgggactcagtgcacgcacccgccaggctacttttgtaatttagtagagcaggtttcgccatgtcggcagggtggtcttgatcctggccctcatgatcacccgccctcagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctccaaaaaaaaaaaaaaaaaaaaaaaaaa

SEQ ID NO: 2683 - DNA, 584 bp, Homo sapiens
  misc_feature (1)...(584): n = A,T,C or G
gaaactcaaatttttattccttccacagaaaacactagagaaacttcgagccaaaaatacatgctgactttctagaaatagtgtaaaggttttttaattgtgtatatgtagcattagacaaaattatttaaagtcaataaattgttattcgaggaattccatcgttgtgatttcttccactgtccatcaaggtcactttagatcctctaaagagctggagtcaaaagatttatcttcaagtttgccctttttaatgaaactgatccagttgtcctgtcagcccataattactttggcttctgtcatctcgttttaatatcggatatactgatgaagacttcaaaattcaccaagaatctttgggatctaatttcttcaaccaatttactttagggtcctttttactgtaggtggtggggatctacctggttctcaatttgacaccctctcaacatgaatgagttcaaatcacattcattcctaagcgatcactccagaatggtacagatgtgtggagtatgccnatacctaagggaaaaaagtagatatccttaactccagacaccaggtctcaagataaaagc

SEQ ID NO: 2684 - DNA, 522 bp, Homo sapiens
caacctttaccacccctttggcttcacccattaaacttgttccagggaccatttacaaattaccaatttttttcttttaagacaataatgtttaagggcccttctgagaccactttccccattgacccccagctgctaaaaagcccttgagggaagtagagcctgggagcaaatgccccatgcggtgagaggatgaggggagcctacgcctcaggcatgtggtgagaggatgagggggagggagcccacgcctcaggtggagtgggcagaggtgcaagagagggatgtactgaagcttcttcccgtcctgccacagacacttctcctgccttcccgccctgacccggcagaacccaccaagtgcctgcagcaagcagaccttcgcatcaacacagcagacacgaaaaaccagtgagagccccgctgtctaccgcccggccccagcactcgctagctttcctgacacctggaactgtgcacctggcaccaagcggaaaataaactccaagcagccagtaaaaa

SEQ ID NO: 2685 - DNA, 545 bp, Homo sapiens
tttttagtgtaaaggttttttaattgtgtatatgtagcattagacaaaattatttaaagtcaataaattgttattcgaggaattccatgttgtgatttcttccactgtccatcaaggtcactttagatcctctaaagagctggagtcaaaagatttatcttcaagtttgccctttttaatgaaactgatccagttgtcctgtcagcccataattactttggcttctgtcatctcgttttaatatggatatactgatgaagacttcaaaattcaccaagaatctttgggatctaatttcttcaaccaatttactttagggtcctttttactgtaggtggtggggatctacctggttctcaatttgacaccctggaaaaaaaagcattgcttactattttagagtatatcaaactgaacactctgagaaacctacacaaatactgtatcagtagaaataccaggtttaacaagcacaaagccaagaaaaccaacgatgccagatactgaatttctatagccactgacctttgaacaccctagcaggt

SEQ ID NO: 2686 - DNA, 453 bp, Homo sapiens
aacactttcaggtgtacgaacaaattttcgaatggggtttcttttctcccctttaggtgagtaagggatacactgagttttaaataagctgctatcagaagagttatcacttcgatttgcaagttccacagcatcagatgtcacatggtcaagagaatctattcctgatttatccatcaattgctctttgttttaaacagttttctaaaacggcctcgcagtggccccaaccgcgcacttgctgcttgtaacccaggcctcggcccaaaacccgcgactggcctggtgcgtgagtcctagagctctgtacacaccaccctccctacagccctcccagctaaacatttggaacaaaacaccagcccttttgtagtggatgcagaataaaattgttaatccaatcacctccaaaaaaaaaaaaaaaaaaaaaaaaaaaaaaaaaaaaaaaaaaaa

SEQ ID NO: 2687 - DNA, 566 bp, Homo sapiens
  misc_feature (1)...(566): n = A,T,C or G
ttagtgtaaaggttttttaattgtgtatatgtagcattagacaaaattatttaaagtcaataaattgttattcgaggaattccatgttgtgatttcttccactgtccatcaaggtcactttagatcctctaaagagctggagtcaaaagatttatcttcaagtttgccctttttaatgaaactgatccagttgtcctgtcagcccataattactttggcttctgtcatctcgttttaatatggatatactgatgaagacttcaaaattcaccaagaatctttgggatctaatttcttcaaccaatttactttagggtcctttttactgtaggtggtggggatctacctggttctcaatttggacaccctggaaaaaaaagcattgcttactattttagagtatatcaaactgaacactctgaggaaacctacacaaatactgtatcagtaggaaataccaggtttaacaagcnccaaagcccaggaaaacccacggatggcccagatacnggaattcccatagcaccggacccttggaacncccctagcnggggntaaactggccc

SEQ ID NO: 2688 - DNA, 1202 bp, Homo sapiens
  misc_feature (1)...(1202): n = A,T,C or G
tttttttttagtttcaatttttattatgaatgtccaaagtgacagcatactgtgaaaatgctaagttctcattgattaaatttcaagagaccacagactacagcattccaagcactttaatttttgacagagccaaaaacaaataaaagaatgataaaaatattcttttgggtgtaaagagtattcatatttgagtttttgtatttttttcttccctgcaggtattgtgaacactgataatttccaaaacataaattctggtctggatacttgcagcaaatttttataatctctacctggataagaagctaataagaaatgtacttataaagtatgtttacgatacagtgtgatatgtttgtttatcttcatttccttatctatcccatgaggcttcttgtctaccacccgggtacctgctgttggtaataacaggacagggaggctgaagtgaaacactcgaagactgtacagaatcctggattttctgaaagctgcatttactctttttttttttaatgaaagcttaagactttcagtgtttgagaacgttcaaggagatacctaatgataatggattaaagccaccaatcaagaactacacagtctacacagattgtgttcaagaaaaaaagccttggtttactaaagctatgtttctagtaatctgtaggtccaacacaatatgactttctttttccccccgaaagggtttccttgccatctgtcctttccatcactggtactggatgagctacagatggagtctgttgccactgatattccaatcaaatctggtcctgggaagtgggtatctcttacagatgcaatactgttcatctgagtggatccccaaaaagaacaattatgaactagaaactcatagagtttgtgtttaaaatttataaaattaaacctgctccaacaggtaatacaggaaggcatgcttgcaacctctggattcaatcagaaacaatgcctgagagtacagagccttctcaataggtaacggcgggttccttttaacgcttccttaaacaagatccgatgtgatgcacattagaactttgaagcacgtctgtctcatttatttctacaaggcctgggacacaggaagctgccaggacntcantcatcatcatcttgcctactgagtgatgattatgtcccctcagtttctgtgctttctaccactggttcac

SEQ ID NO: 2689 - DNA, 775 bp, Homo sapiens
ccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgaggaaaaaaaaaaatgggatttcttccactgtccatcaagggcactttagatcctttaaagagctggagtcaaaagatttatcttcaagtttgcccataattactttggcttctgtcatctcgttttaatatggatatactgatgaagacttcaaaattcacctttttactgtaggtggtggggatctacctggttctcaatttgacaccctctcaacatgaatgagttcaaatcacattcattcctttgacattcatgatcctg

SEQ ID NO: 2690 - DNA, 678 bp, Homo sapiens
  misc_feature (1)...(678): n = A,T,C or G
cacaggttttaaggcaccaaaggggtctaaggttatacaattttctagttgaagtgaatccacttaaggtagaaaagtcaaatcaataagcttatgcccttttcttagcaagggcttaagaattccataagaattctttatagaaacttcgagccattaatacatggtgtctttttagaaatagtgtaaaggttttttaattgtgtatatgtagcattagacaaaattatttaaagtcaataaattgttattcgaggaattccatgttgtgatttcttccactgtccatcaaggtcactttagatcctctaaagagctggagtcaaaagatttatcttcaagtttgccctttttaatgaaactgatccagttgtcctgtcagcccataattactttggccttctgtcatctcgttttaatatggatatactgatgaagacttcaaaattcaccaagaatctttgggatctaatttcttcaaccaatttactttagggtcctttttactgtaggtggtggggatctacctggttctcaatttgacaccctctcaacatgaatgagttcaaatcacattcattcctatagaaagtaccaattaaagatttagaaaggatacatttccagttattaaaactaaaacccaagtataaatntaagatccagtttattatacag

SEQ ID NO: 2691 - DNA, 543 bp, Homo sapiens
tttttttttttttttgactttctagaaatagtgtaaaggttttttaattgtgtatatgtagcattagacaaaattatttaaagtcaataaattgttattcgaggaattccatgttgtgatttcttccactgtccatcaaggtcactttagatcctctaaagagctggagtcaaaagatttatcttcaagtttgcccataattactttggcttctgtcatctcgttttaatatggatatactgatgaagacttcaaaattcaccaagaatctttgggatctaatttcttcaaccaatttactttagggtcctttttaccggaagggtggtggggggatctacctggttctcaatttgacaccctctcaacatgaatgagttcaaatcacattcattcctatagcgagtcacctcaagaatggtacagatttagaaaggatacatttccagttattaaaactaaaacccaagtataaatttaagatccagtttattatacagccatatccagctctgtcagaattaagttttagttcatgcccgt

SEQ ID NO: 2692 - DNA, 474 bp, Homo sapiens
tttttttttttttttctatgtattttctctggtgttttaatggttttttttctaattattactacttcacaagtttctttcacaaacttcttcacagggttaaaaattttttttcttgttataaagttctgggtttcagaatttcttcaccaccagactggtacatatatccacatttatctttattcatttctatgaagtcgttttttctatatgcttcacctttgacattcatgatcctgtcacattttcaggcctctctgtccagtatttttggcttttgtagctctctttttagacaaagcagcttcttcagtaatatcctcttcttctaagtatacactcagtcttacagggaattcagaacttactatgaaactatcccctgccaatttgatatcacattcgttatcttcaagatgtgttgcatcctcatcctctgctgttgactcctcaataggagaaatggatcca

SEQ ID NO: 2693 - DNA, 704 bp, Homo sapiens
  misc_feature (1)...(704): n = A,T,C or G
ccttttgtttgtttttttttttttttttnttttaggggtgaagagggttttttaattgtgtatattgtaggcattaggacaacaattattttataagtcaaataaattgttattctgaggacattccatgtgtgtgatattcttccacgtgtccatcaanggtcacttttagatccntctaaagagcgtggagtcaaaagatttatcttcaagtttgccctttttaatgaaactgatccagttgtcctgtcagccctacataacaatagtataaaagtaaattttacatttccagagatgagtgtacagtgagtgaacatgaatgagtccctagaacgagcctgagttaactctactacaaactgcttggttattagcaacccacaagggttacaatataaaggcaaagcaaatttgcatgattcaagagatctaggagaattttcaaatctcactgattttaaagaaaaatcacatgtggttcacattttatttgtattgcatttctattacagttaatcaactgttcccaataagctgattgctagcaacgtagcagatagaaaacctactgggaaatttttttatggtcatgtccacagcaaatgagaaactgcattctaaaagccttggtaatgaccattacacccttgagcaaataacttatagttaagataaaaaccattacttgccataattacttt

SEQ ID NO: 2694 - DNA, 440 bp, Homo sapiens
  misc_feature (1)...(440): n = A,T,C or G
caantggctccaaacctggtcctctgtctcnttggctgcttnaaatccctgctcctttgtccccgaactctggcatgggcaggggctttggggtctggtttccaaaaggcttagccatggcagaacctcgttttantttaantctttgcccctacaaacaaacagcagtacttgccagaaccattcttgggattcaggagctcgggcgactgcnctngtctggccgcacccaggagggtggggttggatctgtgtagttgccaggcccanacctgccagcagggggctgactggatccatgctttactgtgtttaatgggggtaanaggggtccctacagccctcccagctaaanatttggaanaaaanaccagcccttttgtagtggatgcagaataaaattgttaatccaatcacctccaaatgcaaggccttncnaa

SEQ ID NO: 2695 - DNA, 378 bp, Homo sapiens
ctgaagcttcttcccgtcctgccacagacactactcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattcgactgtgtgcagtttgcaacaaagaatcccgctggcatcctgtccttgggaaccctttctcattgtagacaatgagggggttctcttgatgtaatgaaatgcaattttatggtttggtgcaaaaactcctattttccagtaaattaactttatttctaaagcatattttgatttgccatcaagagcaataaagcattaaatctt

SEQ ID NO: 2696 - DNA, 858 bp, Homo sapiens
tgtatatgtagcattagacaaaattatttaaagtcaataaattgttattcgaggaattccatgttgtgatttcttccactgtccatcaaggtcactttagatcctctaaagagctggagtcaaaagatttatcttcaagtttgccctgaagaagagaaattttgattaaccataattactttggcttctgtcatctcgttttaatatggatatactgatgaagacttcaaaattcaccaagaatctttgggatctaatttcttcaaccaatttactttagggtcctttttactgtaggtggtggggatctacctggttctcaatttgacaccctctcaacatgaatgagttcaaaccacattcatccctaagcgatcactcaagaatggtacagatgtgtggagtatgccaatacctttaactccagacaccatgttctcaagataaaagcctttgacattcatgatcctgtcacattttcaggcctctctgtccagtatttttggcttttgtagctctctttttagacaaagcagcttcttcagtaatatcctcttcttctaagtatacactcagtcttacagggaattcagaacttactatgaaactatcccctgccaagttgatatcacattcgttatcttcaagatgtgttgcatcctcatcctctgctctgtaatattaaaatttatcatcgagatgacagaatcttcgatgacctaattagttgtatattccactctgaaatataactgaaactgcaatactagtcaaaggaaacacaaaatttgagaattttgtgttctggagaattctagatgaacggtgtgccaagcttggctcaactgtaataatccc

SEQ ID NO: 2697 - DNA, 473 bp, Homo sapiens
  misc_feature (1)...(473): n = A,T,C or G
ttttttttcaaacaaataagttttattggcatctaaaaacaaaattcacnccaaccattgagaacggtacctttaaatatttatgtgtgtgtggtttccttgttctctttttttactgcactggcgaggtatggagggaaacaaaaatcaccaaacacctttcctttggggaaaaaacaaagaccgggnggtgttggaattttacacaaaacacttttttaaaatctctgtgttgggctcctcaaatacctagagccagtctttgcataaaatatcacagctttatctataaccttaaaattctgcagcagcctaaagatatggataagatataccaccacttgctattctgaaatatatctattaccatatccaacctaatgatagtatctaaaaaattctttcttccataggaagtctctgacaagctgttattcatttccttgacgttaaaagaatctggggccaacatt

SEQ ID NO: 2698 - DNA, 449 bp, Homo sapiens
  misc_feature (1)...(449): n = A,T,C or G
tttcctgggttnattaacattgtcctaacgctttgncctccccagnagctaaaaaaaggtcctttctggttgactaaaaatatctccctggaggaaaaggtcccacggggtggtggatgaagagctgaatcaagtaccgatgggggtgggaatntcccgttggggtggaattcccaggctgtattaaagggaatcttggcccaggtgcctgtggtattagtcccggacgaatgtctaacattggcattgtgggcatcctttgattagggatacttaaagggggtaagttttgaggtccagctggtggctgtgttcccagaagtccaggagtatttggaacatttggtggctgtactcctacaagtccagaattgttaggtacgatgccagatactgaatttctatagcactgacctttgaacaccctagcaggtgtaatctgctgagtg

SEQ ID NO: 2699 - DNA, 420 bp, Homo sapiens
tatatctctttttcctgttcttgaatctttcaaaaatagcttttatagtcaatggtattggttcaaaagatgagtcacttgatgaatcacttgcgtgaacactttcaggtgtacgaacaaattttcgaatggggtttcttttctcccctttaggtgagtaagggatacactgagttttaaataagctgctatcagaagagttatcacttcgatttgcaagttccacagcatcagatgtcacatggtcaagagaatctaaaaaatcctcttgcaacagcttgctcaaacgttaaaatttttctccaaggtgcgtttttttcattctctgattctaaaaatgggaagccagatcctctgcttctaaattgtttcttcttatctattagtgagtatataggatttctccttccttctggtctt

SEQ ID NO: 2700 - DNA, 391 bp, Homo sapiens
tttttttttagtgtaaaggttttttaattgtgtatatgtagcattaaacaaaattatttaaagtcaataaattgttattcgaggaattccatgttgtgatttcttccactgtccatcaaggtcactttaaatcctctaaagagctggagtcaaaagatttatcttcaagtttgccctttttaatgaaactgatccagttgtcctgtcagcccataattactttggcttctgtcatctcgttttaatatggatatactgatgaagacttcaaaattcacctgtggaaaaatgtgtatttcaaatttatatttactattaagtacagaaatctatctttcaagaatgaggttgcttaggttccaaagtatcctgaaacccggcaccccaagta

SEQ ID NO: 2701 - DNA, 444 bp, Homo sapiens
  misc_feature (1)...(444): n = A,T,C or G
taaagttctgggtttcagaatttcttcaccaccagactggtacatatatccacatttatctttattcatttctatgaagtcgttttttctatatgcctcacctttgacattcatgatcctgtcacattttcaggcctctctgtccagtatttttggcttttgtagctctctttttagacaaagcagcttcttcagtaatatcctcttcttctaagtatacactcagtcttacagggaattcagaacttactatgaaactatccccctgcataaaacaaacaaaaaatcatggattaagcaataactcaaatagtttagtaattacatatagctgaatgcccctgggattacttcagataacctagagactacatgtagatgttaaaaatccaaattnacattgcttattttttcatttgacatcctaactagcantaatatgna

SEQ ID NO: 2702 - DNA, 463 bp, Homo sapiens
  misc_feature (1)...(463): n = A,T,C or G
tatatgtagcattagnacaaaattatttaaagtcaataaattgttattcgaggaattccatgttgtgatttcttccactgtccatcaaggntcactttagatcctctaaagagctggagtcaaaagatttatcttcaagtttgccctttttaatgaaactgatccagttgtcctgtcagcccataattactttgggcttctgtcatctcgttttaatatggatatactgatgaagacttcaaaattcaccaagaatctttgggatctaatttcttcaaccaatttactttagggtcctttttactgtagggggtngggatctacctggntctcaatttgacaccctggnaaaaaaagcattgcttactattttagaggatatcaaactgaacactctgaggaacctacacaaatactgtatcagtagaaatccagggttacaagcacaaagccagggaaccaa

SEQ ID NO: 2703 - DNA, 284 bp, Homo sapiens
  misc_feature (1)...(284): n = A,T,C or G
gaaacggaagtttcgctcttgttgcccaggctggagtgcaatggnacaatcttggctcaccgcaacctctgcctgggttgtgaccactgtctccttttcaactggagttgggctctgagttgtctggaccgtctctttaacaggttctgagcttttcacagtttcccactctaaanaaaatagttgaaattgatttcctttggataggtgcaacttttcattttcttctttgtattcatttatttcacatctaaatccttcatctaccttggnacatctttaag

SEQ ID NO: 2704 - DNA, 416 bp, Homo sapiens
agtatgccaatacctttaactccagacaccatgttctaaagataaaagcctttgacattcatgatcctgtcacattttcaggcctctctgtccagtatttttggcttttgtagctctctttttagacaaagcagcttcttcagtaatatcctcttcttctaagtatacactcagtcttacagggaattcagaacttactatgaaactatcccctgccaatttgatatcacattcgttatcttcaagatgtgttgcatcctcatcctctgctgttgactcctcaataggagaaatggatccatcatcatccaaaaatttgtatctacgactgtcaaaatcttcattttctaaatcttcaccaacattcatttgcttcaatgattctttcaggtggtgttcatacttcagtttttcaa

SEQ ID NO: 2705 - DNA, 418 bp, Homo sapiens
  misc_feature (1)...(418): n = A,T,C or G
aggttttttaattgtgtatatgtagcattagacaaaattatttaaagtcaataaattgttattcgaggaattccatgttgtgatttcttccactgtccatcaaggtcactttagatcctctaaagagctggagtcaaaagatttatcttcaagtttgccctttttaatgaaactgatccagttgtcctgtcagcccataattactttgggcttctgtcatctcgttttaatatggatatactgatgaagacttcaaaattcaccaagaatctttggggatctaatttcttcaaccaatttactttaggggtcctttttactgtagggtggtgggggatctaccngggggtctcaatttgacacccngggggaaaaaaaggcattgcttaactattttaggaggtatatccaaactgga

SEQ ID NO: 2706 - DNA, 495 bp, Homo sapiens
  misc_feature (1)...(495): n = A,T,C or G
agaaccccctaaaaganccgggagtcaaaaagatttaaccntccaagtttgcccctttttnaaagaaaactgaacccagttgtccctgtccagccccataattaactttggctttctgtcacctcgttttaaatatggataatactgatgaagacttccaaaattcaccaagaatcctttgggatctaatttcttcaaccaatttacttttagggtcctttttactgtaggtggtggggatctacctggttctcaatttgacaccctggaaaaaaaagcattgcttactattttagagtatatcaaactgaacactctgagaaacctacacaaatactgtatcagtagaaataccaggtttaacaagcacaaagccaagaaaaccaacgatgccagatactgaatttctatagcactgacctttgaacaccctagcaggtgtaaactgctgagtgcagataccatgcagtgcaattatgactgaactgtacaact

SEQ ID NO: 2707 - DNA, 396 bp, Homo sapiens
  misc_feature (1)...(396): n = A,T,C or G
gaaacctggacccnagtggccctgtcagcccccaaantactttggncttctgtcacctcgttttaatatgggatatactgatgaagacttcaaaaattcaccgaagaatcctttggggatcctaatttccttcaaccaatttactttagggtcctttttactgtaggtggtggggatctaccctggttctcaatttgacaccctcgggaaaaaaaagcattgcttactattttagagtatatcaaactgaacactctgagaaacctacacaaatactgtatcagtagaaataccaggtttaacaagcacaaagccaagaaaaccaacgatgccagatactgaattctctatagcactgacctttgaacaccctagcaggtgtaaactgctgagtgc

SEQ ID NO: 2708 - DNA, 392 bp, Homo sapiens
  misc_feature (1)...(392): n = A,T,C or G
cctatttcaaggnaactggatccaagttgtcctgtcagccccataattactttggctnctgtcatctcgttcnaatatggatatactgatgaagacttcaaaattcaccaagaatctttgggatctaatttcttnaaccaatttactttagggtcctttttactgtaggtggtggggatctacctggttctcaatttganaccctggaaaaaaaagcattgcttactattttagagtatatcaaactgaacactctgagaaacctacacaaatactgtatcagtagaaataccaggtttaacaagcacaaagccaagaaaaccaacgatgccagatactgaatttctatagnactgacctttgaacaccctagcaggtgtaaactgctgagt

SEQ ID NO: 2709 - DNA, 493 bp, Homo sapiens
cataggaaagacaacaaagccctcattgtgtgcctcttcagcaaacagccaacccatgagagtcgaattggagaacttgttggagtgctggtgaatcatttcaagagaaaccatctgcttatactctgaataaaattcaagaaagcatagattctacataaacaggcccaagattacatggcaaactgagatgaagaggatgctggctgagaaacaaacaaaagtgttcaattatttgaatgaagtaaggaaagatattttaaaatgtaaatcaccattaaaatctgaaaatggcccagttgatattgcagaaaatagaattgatgtgaaaggaaagtttgaagtctctcagtgtgcagaatttactgttataatgggcaacatgttaacttttttagcaatatacaaaataagggtacatcttacaaagaaggcatcttatattcaataaaatatggtaatttaaaacataaaaaaaaaaaaaaaaaaaaaa

SEQ ID NO: 2710 - DNA, 284 bp, Homo sapiens
  misc_feature (1)...(284): n = A,T,C or G
ggaaaaaaaaagcatgccttactattttagagtatatcaaactgnaacactctgagaaacctacacaaatactgtatcaagtagaaatacccaggtttaacaagcacaaagcccaagaaaaccaacgatgcccagatactgaatttctatagcactgacctttgaacaccctagcaggtgtaaactgctgagtgcagataccatgcagtgcaattatgactgaactgtacaactcgtattcccaaatttgcaatattgctgagaaatgctttcacaaacctctc

SEQ ID NO: 2711 - DNA, 444 bp, Homo sapiens
aagaccaaaattttcattcgaacaccccgaacattgtttaccttggaagaactccgtgcccagagcctcataaggattgtcctctttctacaaaaggtaattttatattttatatataaggataagattttgcttttaagttcttaaaaatttgttgcatattttctttaattcaagaaatattcctggaagatatgttgttttatgtctatgcatatcttaaaatgttttctgttgccttcacacatggaaaacttacttggttgccccagttcaaaattatttttgcccaagttcaaaattattttatcttcaaaactctgaagatattttgtttttaaagttggagagatgtctgaaccagtctttctgtcctttactgttaactgtgttttttccttcagcttaaatgcataaaggacttttttttccccccccgagacg

SEQ ID NO: 2712 - DNA, 449 bp, Homo sapiens
  misc_feature (1)...(449): n = A,T,C or G
ttaggatgaaatatgtggaactgccagttaaataatgatgcaaagaacacaggaagtttcgtttggaggtatagacatgaagtctcttaattttccctctctatacaatatatacattgtaaaaatttttgcaagtaatctacaaattctgtgtatacctgaaatactgggatggtgtaatttctatttttcatcttttgagcccttgattattataagtgaaatattttacttacctctcaacatgaatgagttcaaatcacattcattcctatagcaagtaccaattaaagatttagaaaggatacatttccagttattaaaactaaaacccaagtataaatttaagatccagtttattatacagccatatccagctctgtcagaanttaagtttnagttcatgcccgttatcattcagcagtngaaacagttaaattcatcatctg

SEQ ID NO: 2713 - DNA, 322 bp, Homo sapiens
atcctatatccatatcctgttgctgaatatctatggaatcatcccaaattgacttcaggttcaagaaaatgctgctgactactcccttgtgatggtgacgctgaatgctctgacccaaaggttccttcctgactatcctgaggagtggccttttgaggctgttgctgctccaagagctgctgtctgagatgttctaggttttgctgttgtagttgttctgctatctgatgaaaaatggaattgttcacagattctgaaacgtgagccctttccctatatcacctgccaccgcaccccaaacctctcttcctccctcccatgc

SEQ ID NO: 2714 - DNA, 281 bp, Homo sapiens
  misc_feature (1)...(281): n = A,T,C or G
gcagtntggggaanaaatcacaaacacttacttggagaaacagagaccatagtgtagattttacaaaatcacttttaaaatctctgtattgtgcncctcaaatacctagagccagtctttgcataaaatatcacagcgctgaggggaaaggaagcgggcatgattgtagacaatgagggggttcncttgatgtaatgaaatgcaantttatggtttggtgcaaaaacncctattttccagtnaattaactttatttctaaagcatattttgatttgccatc

SEQ ID NO: 2715 - DNA, 1880 bp, Homo sapiens
atggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggctcctgatgacaagggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctcccg

SEQ ID NO: 2716 - DNA, 722 bp, Homo sapiens
  misc_feature (1)...(722): n = A,T,C or G
cactcacttctannctggatctatgccccagaaatatggaaggacccaccagtagtgattggctcaggtttaacaatgaaagaaatgatttttgaagtggctgatactcatctatttttcaatgacttagagacatagtcctcactcaggaactgaaagttctgtgaagaatttgacctgaatgtgttcctgccccccaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtatggtttctatgctgtttcttgtcactggccttgcaataaaactttatactcataaaaaaaa

SEQ ID NO: 2717 - DNA, 439 bp, Homo sapiens
gctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaagtatgagaagaaactgatttagttacctactttgttctttctcacttcttaagtttatcaaacatgtttttgaagctcacagagataatgtgcactatgttatgtgccctttaattcctgagcaaaataaactaaattggccacgttaaaaaaaaaaaaaa

SEQ ID NO: 2718 - DNA, 421 bp, Homo sapiens
  misc_feature (1)...(421): n = A,T,C or G
ctaagttgttgctgtgtgtccactaagataacaaaaatgagtagaatctctgccctttaatatagaaagtaaatgaacatgaaataatgagtagtagctgaacattggctctgaacagtataataccaggtcctttaaagttaatttttaataattaaattctaaagagttggcacatacgaattcttgctcccaggttggtttagtttcaccttttcttttcccttttactcccttatagaaagaattgtgtgaatgttctgatcactaccacccagctggttccagccctggccaaggttctcctatatggactanggagaaatatttcctattgagaacatctatagtgctaccaaaattggtatggtttctatgctgtttcttgtcactggccttgcaataaaactttctactcatg

SEQ ID NO: 2719 - DNA, 648 bp, Homo sapiens
gaaaggatcctaccagtaagaaaggcaaacagcggatttcaaactctaacacaaaatgatcacaggctggcagagacacagaagcaggcaacaatttatctggagtctaatcagagtcatcataactctcatcactatcttgctccttttctccagcacttacttcgtcttcttcaccatcctcagtggctttgctcttggaggcctgggatgacatgtcatcctcactctcatctgctgtgctctcctgggaattttgggacttaatctcttcaccctgcaagtcccggttttttagattgcccagccagaaagcctctctacaattgttgagagtgagcatagctttgactctgcaaactaaaagttccagggtctttttgagcagaggcacatgttgggtgagtctcgtgtcctgggggaatcttggggaacgcccacacagggtgatgaaggcaggccttgtcgtccaaccgggaagggttttccagtaaggctcagaacatcttcccggtgttttctaaaactgaagtctaggagcggcatacattgcttcagaaatgcttccacaatgagacgcccatacttgaaacatacatgcagaacaggatgactatcaaataccctttatcaagttgacgaagaatc

SEQ ID NO: 2720 - DNA, 463 bp, Homo sapiens
  misc_feature (1)...(463): n = A,T,C or G
ngnttgggcaacaatttatctggggtctaatcagagtcatcataactctcatcactatcttgctccttttctccagcacttacttcgtcttcttcaccatcctcagtggctttgctcttngaggcctgggatgacatgtcatcctcactctcatctgctgtgctctcctgggaattttgggacttaatctcttcaccctgcaagtcccggttttttagattgcccagccagaaagcctctctacaattgttgagagtgagcatagctttgactctgcaaactaacagttccaggggtctttttgagcagaggcacatgttggggtgagtctcgtgtcctgggngaaatcttgggaatgcccacacaggtgatggaagcagccttgtgtccaactgggaaggtttccagtaagctcagaacatcttccttcaaacatacatgcagaacaggatgactatcaaan

SEQ ID NO: 2721 - DNA, 715 bp, Homo sapiens
ttttgggggtgactcaagctcctggccctttattccaaatgaatcaggtgaggcaaaggattagtaggaatggcactttagcccaatgacagacttggcttttggggtcgatgattttggattttctatcagaacaactttttggcagcagacatctgtttaacgaacagcatgagatgttattcaggcctaacactgacaccaggagaaaataaggagaggctattttgagcactgaactgagatcaggaatcagaagaaaagctgctttggagggagaagctgcaaaggctgagacctcagtacgaaagtcaaaggtcagaggttggtcatccatcataaccacctgattcagttctcaggcccaggcctttagtttttagtcttgagtgaataaattcttctttttccttactaaaagttcaattctggtttgcccggaactgttgattccattcttgtgtttccttgtcctaattttcctaagcttttgttccaatggagattcattttcaggtatgtaaaagtgaacaggtcgaaggtttgaatatttatctgggggtcctatccaatcatggcaagactttcttggagggcagaatcttgagaccccactgggcgccgtatccctgcgctcggcgccacgctccggagcgagttgacagccacggcaggcgaaggcgcggcagagagggggagaaagtcttcttcccaa

SEQ ID NO: 2722 - DNA, 914 bp, Homo sapiens
  misc_feature (1)...(914): n = A,T,C or G
tttttntttccagtaaaacctttattaattatttattatttntttgatacagagtctcggtttggcttttccaggcttggagtgcagtggtggcgatctgtggatcacttgcaancttccgcctcctgggttcaagcggtcgcatgccttcagcctccagagcagctgggattacaggtgcgtgccaccacacccagctaattttttgtagagacagggttttgccatgttgtccagactgatcttgaactcctgatctcaagtgatccacccgcctcggcctcccaaagtgctgggattacaggtgtgagccaccgtgcctggccaatatttttaaatagttctgttttgaattggtataattcgttttttttttttttttttcccagtgcttgggctttatttcacaccacgtacgtgacaacaagctggcctagagcccacatcagcaggcaggcggcccacagtgccccaggacctaccctgcccccaaacaggccatggggccccttaggaagatgtggggcttcttgagatcagctccagtttttctcagagcccctgtgaaaggagctccatctgcttcctgtggaaacctggactctggctgggtcagagtggactcctagttgctcctcttcttttgtttctgtttaagcttgttccaaatcctttccagggccacttttcccatgaagaaggtgatggcaaaattgcgcttgtaccaatctctgttataatacatgtgcttctgaaaatttttacttaaaaattccttgtagaagtccgccatttcttctgcattcaatgttgctttctgacccgggttccagttactcttaaaggtcctgggcgtttaagtttttagtcctgagtgaaaaaaatcctcnttttccctancaaaagtcaaattc

SEQ ID NO: 2723 - DNA, 824 bp, Homo sapiens
ctagtgcttgggctttattttacagcacgttcgagaaaacaggctgacctataaaccaaacctgatggaggcgcacaacagtgccccaggacctaccgtgccgccagacaggccatggcgcccctgaggaagatgtggggcttctcgagatcagctccagtttttctcgacagcccctgtgaacaggagctccatctgcttacctgtggaaacctggactctggctgggtcagagtggactcctagttgctcctcttcttttgtttctgtttaagcttgttccaaatcctttccagggccacttttcccatgaagaaggtgatggcaaaattgcgcttgtaccaatctctgttataatacatgtgcttctgaaaatttttacttaaaaattccttgtagaagtccgccatttcttctgcattcaatgttgctttctgacctgattcagttctcaggcccaggcctttagtttttagtcttgagtgaataaattcttctttttccttactaaaagtcaaattctggtttgcccagaactgttgattccattcttgtgtttcttgtcttaattttctaagcttttgttccaatggagattcattttcaggtatgtaaaagtgaacaggtcgaaggtttgaatatttatctgggggtcctatccaatcatggcaagactttcttggagggcagaatcttgagaccccgtggcgccgtatctccctgctcggcgccgcgctccggagcgagttgacagcgcggcaggcgaaggcgcggcagagaggggggagaaaggtctccttccccgcccgcaagaccaccatgcg

SEQ ID NO: 2724 - DNA, 1146 bp, Homo sapiens
  misc_feature (1)...(1146): n = A,T,C or G
ttttttttttttttccagtaaaactttattaattattattattttttgatacagagtctcgtttggtcttccaggctggagtgcagtggtgcgatcttggatcactgcaacctccgcctcctgggttcaagcgtcgcatgcctcagcctccagagcagctgggattacaggtgcgtgccaccacacccagctaattttttgtagagacagggttttgccatgttgtccagactgatcttgaactcctgatctcaagtgatccacccgcctcggcctcccaaagtgctgggattacaggtgtgagccaccgtgcctggccaatatttttaaatagttctgttttgaattggtataattcgaaatttttttttttttttcccagtgcttgggctttatttcacaccacgtacgtgacaacaagctggcctagagcccacatcagcaggcaggcggcccacagtgccccaggacctaccctgcccccaaacaggccatggggcccttaggaagatgtggggcttcttgagatcagctccagtttttctcagagcccctgtgaaaggagctccatctgcttcctgtggaaacctggactctggctngggtcagagtggactcctagttgctcctcttctttttgtttcctgttttaaagcttgttccaaatcctttccagggccacttttccccatggaagaagggtgatgggcaaaatttgcgcttgtaccaatctctgttataatacatgtgcttctgaaaatttttacttaaaaattccttgtagaagtccgccatttcttctgcattcaatgttgctttctgaccttactaaaagtcaaattctggtttgcccagaactgttgattccattcttgtgtttcttgtcttaattttctaagcttttgttccaatggagattcattttcaggtatgtaaaagtgaacaggtcgaaggtttgaatatttatctgggggtcctatccaatcatggcaagactttcttggcctagagaatcttgagaccccgctggggccgtatccctcggtcgggccgcgctccggagcgagttgacagccgcggcaggcgaaggcgcggcacaaaggggggagaaaggtcttcttccccgcccgcaagaccaccatggcc

SEQ ID NO: 2725 - DNA, 528 bp, Homo sapiens
  misc_feature (1)...(528): n = A,T,C or G
aaggggcttcttgagatcagctccaatttttcctcaaagcccctgtgaaaagnagctcccatctgccttcctgtggaaaacctggaactctggctgggttcagaatggaactccctaagttgctcctcttccttttgtttctgtttaaagcttgttccaaatcctttccagggccacttttcccatgaagaaggtgatggcaaaattgcgcttgtaccaatctctgttataatacatgtgcttctgaaaatttttacttaaaaattccttgtagaagtccgccatttcttctgcattcaatgttgctttctgacttgccaggtgactctgttacgcttaaaggttctggctgtcaacagtccccggcgtggtggcggcggcaccctcagtcccatccgactgagggcgttgatgcgggagcctnggggctacgggactgttcgggataggacgcgagagcacctggacaaaagcctgaggcggctgtgcagaacagggaagntgccccgagggtcgggtttgtcttcc

SEQ ID NO: 2726 - DNA, 505 bp, Homo sapiens
cccatgaagaaggtgatggcaaaattgcgcttgtaccaatctctgttataatacatgtgcttctgaaaatttttacttaaaaattccttgtagaagtccgccatttcttctgcattcaatgttgctttctgacctgattcagttctcagcccaggcctttagtttttagtcttgagtgaataaattcttctttttccttactaaaagtcaaattctggtttgcccagaactgttgattccattcttgtgtttcttgtcttaattttctaagcttttgttccaatggagattcattttcaggtatgtaaaagtgaacaggtcgaaggtttgaatatttatctgggggtcctatccaatcatggcaagactttcttggagggcagaatacggagacccgctggggccgtatccctcgctcgggccgcgctccggagcgagttgacagccgcggcaggcgaaggcgcggcagagagcggggagaaaggtcttcttccccgcccgcaag

SEQ ID NO: 2727 - DNA, 822 bp, Homo sapiens
tttttttttttttttttttcagtgcttgggctttatttcacaccacgtacgtgacaacaagctggcctagagcccacatcagcaggcaggcggcccacagtgccccaggacctaccctgcccccaaacaggccatggggccctttaggaagatgtggggcttcttgagatcagctccagtttttctcagagcccctgtgaaaggagctccatctgcttcctgtggaaacctggactctggctgggtcagagtggactcctagttgctcctcttcttttgtttctgtttaagcttgttccaaatcctttccagggccacttttcccatgaagaaggtgatggcaaaattgcgcttgtaccaatctcttggcctcccaaagtcatgggattcccaggtgcgagccaccgtatccaacctgttataatacatgtgcttctgaaaatttttacttaaaaattccttgtagaagtccgccatttcttctgcattcaatgttgctttctgaccttactaaaagtcaaattctggtttgcccagaactgttgattcccattcttgtgtttcttgtcttaattttctaagcttttgttccaatggagattcattttcaggtatgtaaaagtgaacaggtcgaaggtttgaatatttatctgggggtcctatccaatcatggcaagactttcttggagggcagaatcttgagaccaggtgactctgttacgcttaaaggttctggctgtcaacagtccccggcgtggtggcggcggcaccctcagtcccatccgactgagggcgttgatgcgggagcctcggggctgcggg

SEQ ID NO: 2728 - DNA, 449 bp, Homo sapiens
  misc_feature (1)...(449): n = A,T,C or G
atggcgcttgtaccaatctctgttataatacatgtgcttctgaaaatttttacttaaaaattccttgtaagaagtccgccatttcttctgcattcaatgttgctttctgacctgtagtcccagccactcagaaggctgaggcaggagaatcgcttgaaccaggaggcagagtttgcagtgagccgagatcgtgccactgcactccagcctgggtgacagagtgagactccatctgattcagttcgtcaggcccaggcctttagtttttagtcttgagtgaataaattcttctttttccttactaaaagtcaaattctggtttgcccagaactgttgattatttcttgtgtttcttgtcttaattttctaagcttttgttccaatggagattcattttcaggtatgtaaaagtgaacaggtcgaaggtntgaatntttatctgggggtcc

SEQ ID NO: 2729 - DNA, 286 bp, Homo sapiens
gctcgactcttacctgaatttaacaacattcatgtctatatcagaggtagataacactcctacctaatctggatgtgctattcatattttcaggataagagtctatacctacctgttataatacatgtgcttctgaaaatttttacttaaaaattccttgtagaagtccgccatttcttctgcattcaatgttgctttctgacctgaaaggtaatttcagcttaaacattaagacttaaggagaaaggataaacaaaaaactattagagctaataaatggtcgacg

SEQ ID NO: 2730 - DNA, 2277 bp, Homo sapiens
ctttctgtcttggtaccgctgcgagacgaagacacaacgcgttttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaaaaaaaaaaaaaaaaaaaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattccaagttccaaagctctgccaggggaattaggaacctaagctgctggctaatgccgctccataaatcccgcagatttgaagtgtctgggaggcccttttaaaaataactaatatcagaaagcatttctaatgaacgtaaagactaggcttacattaaaggaaaactgcagtttgactgggttctggttgggtgggccttcggaggttctatcagttaactatactaattaatgtggagattcaaaccataccaatagaaactaaatttttctacataatgtcatgttaactgcagtttccctttatggcacaaggggtcacacaacctacctaaaatgttaattgtatagaaaatgatttctaaacctttaacagttaatatccaataatgtgttatttgtaaaaaaaaa

SEQ ID NO: 2731 - DNA, 1226 bp, Homo sapiens
ttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgccttttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaacttaaaaaaaaaaaaaaaagggcggccgct

SEQ ID NO: 2732 - DNA, 1270 bp, Homo sapiens
  misc_feature (1)...(1270): n = A,T,C or G
gcaagaaaagaggtctgtccttgtatcccttgagcgacctgtacccctggggtaaaattttcttccagaaattccatccgtgaatggcccacaacttgtcagttagaaaaaccctgtacaagccacagttgctaggtgcttcttccagccaaagaggtcgaagggttctgaaacttggtggctggtcgtgagttggttcggtcggaatgacaactccgttcgtggagaaaactccagtggtcgtgtggctttggtggcagccgtgttggtgtgggatatggtggcagtggggatggctataatgatttggtaatgatggaagcaattttggaggtggtgaagctacaatgattttggcaattacaacaatcagtcttcaaattttggacccatgaaagggaggaaaattttggagaggcagaagctctggcccctatggcggtggaggccaatactttgcaaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaaaaaaggaggttgttgtgtggtggngttgtttgngg

SEQ ID NO: 2733 - DNA, 1256 bp, Homo sapiens
  misc_feature (1)...(1256): n = A,T,C or G
tcgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggattctcaaagaccaggtgcccacttaactgtaaaaaagattggtgggtgggctataaagagccctaagcacatcccttaggagattttttgacgagagggaaaattgaggtgatggattcatgatgacgagagcacgcgcaagaagaggcttttgccttggtaccttggacgacaatgactcgttggataagatggtcattcagaaataccatactgtgaatggccacactgtgaggttagaaaagccctgtcaaagcaagagattgctattgcttcatccagccaaagagatcgaagtatttctggaaacttgttgttgttcgnggaaagttgttcggggagaatgacaacttcgctcggagaagaaactccacttgtcgtggtggctttggtggcagccgtggtggtgtttggatatgggtggcagtggggatggctataatggatttgggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcgggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcattgggtatgggcaaaaaactcgaggacgggatttgtgactaattggaaaacaggttattttagtttctgttctgtggaaagtgtaaagccttcccacaaagggttttaatgtagatttttttttttgccccccatgctgttgattgctaaatgtaacagtctgatcgtgacgctgaataaatgttttttttttaaaaaaaaaaaaaaaaaaaaaaaaaaaaaaaaaaaaaaaaaaaaaaaaaaaaaaaagggcggccgct

SEQ ID NO: 2734 - DNA, 901 bp, Homo sapiens
aaataggaaaggcctgtcaaagcaagagatggtgagtgctacatccagccaaagaggtcaaagtacttctggaaactttggtggtggtcgtggaggtggtttcggtaggaatgacaactttggttgtgaaagaaatttcagtggtcatggtggctttggtggccagctgtggtggtggtggatatcgtgcagtggggatggctataatggatttggtaatgatggaagcaattttggaggtggaagctacaatgattttggcaattacaacaattagtcttcaatttttggacccatgaagggaggaaactttggaggcagaagctctggcccctatggtggtgcaggccaatactttaccaaaccacgaaaccaaggtggctatggcggttccagtagcagcagtagctatggcagtggcggaagattttaattaggcaacaaagcttagcatgagaggagagccagcgaagtgacagggaagctacaggttacaacagatttgtgaactacagccaagcacagtggtggcagggcctacctgctacaaagaagacatggtttagacaaatactcatgtgtatgggcaaaaaactcgaaggactgtatttgtgaactagctgtataacaggttgattttagtttctgttctgtggaaagtgtaaagcagtcccaacaaagggttttaatgtagtttttttttttttgcacccatgctgttgattgctaaatgtagtagtgctgatcgtgacgctgaataaatgtatctttttaaaaagataacacagcgttgccaatcctgactgcacattagaatcaccaggggtcttattggtacccaaaaccatcctgcagcaagtgaacacccatctcaactccaataatcctgatgtacaaccgg

SEQ ID NO: 2735 - DNA, 1646 bp, Homo sapiens
  misc_feature (1)...(1646): n = A,T,C or G
agcttgagcagccattatgagcaatggggaacgctcacgaactgtgtggtaatgagagatcaaacaccaagcgctacaggggctntgggtttgtcacatatgccactgtggaggaggtggatgcagctatgaatgcaaggccacacaaggtggatgcnagagttgtggaaccacagagagctgtctccagagaagattctcacagaccaggtgcccacttaactgtgaaacagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatgaaccagggcagtggctatggcgggagtggcagctatgacagctataacaacggaggcggaggcggctttggcggtggtagtggaagcaattttggaggtggtggaagctacaatgattttgggaattacaacaatcagttcttcaaattttggacccatgaagggaggaaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtganctcagccaagcacagtggtggcagggcctagctgctacaaagaagacatnttttagncaantactcatgtgtatgggcaaaaanctcgaggactgtttttgtgactaattgtntnacaggttatttcngtnttcttgncctgnggaaagtgtaaagcattcccancaaaagggtttttantctagntttntcncncngggncccccanntttnnnggtttgttaacttncancaaccttctncccnnncngntgttttaatttctntttccccnnccnngccctngtcttaaggttaggtcntccccctttaagnccccttttnggccntttccccccccnaccanggnttccngtttnnattccccactttggcttttccngttnnccntcnccaaannnnnnnnncnnttcccccncctnnnttcccccncncncnnnccccnncccncccccctcctccctcntcccnccctcncctnccccnccncctcctcccccccncccctccctccnctcnnccccncccnncccccc

SEQ ID NO: 2736 - DNA, 620 bp, Homo sapiens
aatcatactacgagcagtggcaagaaaggggctctgcattgtaaccttgacgaccatgactccgtggataagattgtcactcaggaataccatactgtgaatggccacaactgtgaagttagaaaagccctgtcacagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcaaccgtggtggtggtggatatggtggcagtggggatggctataatggatttggtaatgatggagcagggaagtacagagtgggatggtcaggacctgggccattgcaaccaaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctga

SEQ ID NO: 2737 - DNA, 1193 bp, Homo sapiens
  misc_feature (1)...(1193): n = A,T,C or G
ggataagattgtcattcagaaataccacactgtgaatggccacaactgtgaagttaggaaagccctgtgaaagcaagagatggctagtgcttcagccagccaaagaggtcaaagtggttctggaaactttgatggtggtatggaggtggtttcggtgggaatgacaactttggtcatggaggaaacttcagtggttgtggtggctttggtggcaaccatggtgctggtggatatggtggcagtggggattgctataacggatttggtaataatgaaagcaattttggaggtggtggaagctacagtgattttggcaattacaacaactctcgctcctcaccctttcagtccccatgaaagggcggaaaactttggagggcagaacgccctggcccctatggcggtggaggccaatactttgccaaacctcgaaaccaaaggtggctatggcggttccagcagcagcagtagctatggcagtggcagaagattttaattaggaaacaaagcttagcaggagaggagagccagagaagtgacagggaagctacaggttacaacagattttgtgaactcagccaagcacaagtggtgggccagggcctagctgctacaaagaagacatgttttagacaaatactcatgtgtatgggcaaaaaactcgaggactgtatttgtgactaattgtntaacaggttattttagtttctgttctgtggaaagtgtaangcattccaacanagggttttantgtagatttcccccttggcaccccangctgnggtttgttaatttntcnaaagcctnacncgggnangntggatttacntgtctttntcnccntgtgctngnntaaagttnnntctctcttangcccccttnggtatttcncccaaccagtntcancttnngatttccagggntcctttcaagggcccccccnnagggganantnngnngncanttcccccttntncggggncccntggnagccntnnccangccanctcnntnnnncntncnggnaattcttnntttcccccnncccccctgngntttacnccttgnccccctcnannatnannnccccaggncttntcccccttnnaacctcaaanccccttncncttttccncctcncccccgggcgcncncccccccctcttttnctttggggccccnccacanccccn

SEQ ID NO: 2738 - DNA, 591 bp, Homo sapiens
  misc_feature (1)...(591): n = A,T,C or G
tggatatggtggcattggggatggctatcatgcatttggtaatgatggaagcacttttggaggtggtggacgctacaatgattttgagaattacaacaatcactcttcaaattttgcacccatgaagggaggaaattttgtaggcagaagccctggcccctatggccgtggaggccaatactttgcaaatccaccacaccaacgcgcctatggccattccagcaacaggacgatcccgactcatcggtagcagtattcctgttccaccctctaattccgtaccgttacctccaggcgtaccatcttcccctcttctagccttcttccaacctcgctgaatcctggtctctacttctcctctctacaatcctatccgttcacaattacccccaacttacctacccgaaactctcccccttcatttcttcttctccgtacaccnntatctaacttcactcccctcgccttcgaactaattgccctctatttattagcaaattctcccccgccatctcccttaccgcattcgtcctcccatctaccagaccccctcttcttctttctaccccccccatcccccctacttttccc

SEQ ID NO: 2739 - DNA, 981 bp, Homo sapiens
cgtgatagttccatcatcctggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaacttaaaaaaaaaaaaaaaaaaaaaaaaaaaa

SEQ ID NO: 2740 - DNA, 485 bp, Homo sapiens
agatgggacttggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttttaataaactgtatttaacttaaaaaaaaaa

SEQ ID NO: 2741 - DNA, 379 bp, Homo sapiens
agtttctgttctgtggaaagtgtaaagcattccaacaaagggttttaatgtagattttttttttttgcaccccatgctgttgattgctaaatgtaatagtctgatcgtgacgctggataaatgtctttttttttaaaaaaaaaaaaagatctttgcagaacacctattaattaattaattaattcactcattcagcaacatttttgagctgctgccctgttttcatgatgtgctacatgatagatttgtaaacacctgtctcaataaacttatagttgtgttggaataggtattattctcagttgcatcttcatgaaactcataataaattggtaataattacaatgtaagaaggattctgaggccacagaaagaatga

SEQ ID NO: 2742 - DNA, 982 bp, Homo sapiens
  misc_feature (1)...(982): n = A,T,C or G
ttctggatagtcatacataaaacactatacagcgatgagagttaacagtctactacaacaggcaaaataaaatagataactcacactaccataatgttgggcaaatgaaaccacactcaaaagagtaggattctacttacattaagtataaaacaggcacaactaatctgtagttttacaagtcaagaaaataccggtagtgatggaaaagaacaagcaggggcttctggtaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaagtggtggaagctacaatgactttggcaattacaacagtcttcaaattttggacccatgaagggaggattggaggcagaacctctggcccctatggtggtggagaccaatacttagccaaaccatgaaaccaaggtggctatggctgttccagtagcagcagtagctatggcagtggcagaagcttagcaggataggagagccagagaagtgacagggaagctacaagttacaacagatttgtgaactcagccaagcacagttggtagcagggcctagctgctacaaagaagatatgttttagacaatactcaggtgtatgggtaaaaaaatcaaggaccgtatttgtgactaattgtataacaggttagtttagtttctgttctgtggaaagtgtaaagcagtcttaacaaagagttttaatgtgtttttnttttcctttgcactcatcctgttgattgccaaatgtcatagtctgatcatgatgttgaataaatgtctttnaaaaggatgtttttcactggggtgtcgtgggctcacggcctggtaattcccagcacttttgaggaggccccgggccgggcaga

SEQ ID NO: 2743 - DNA, 408 bp, Homo sapiens
  misc_feature (1)...(408): n = A,T,C or G
gtgaaaaagatatttgttggtggcattaaagaagacactgaagaacatcacctaagagattattttgaacagtatggaaaaattgaagtgattgaaatcatgactgaccgaggcagtggcaagaaaaggggctttgcttttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctgggaaactttggtggtggtcgtgggaggtggtttcggtggngaatgacaacttagncagggagagggaggagcccggaggaagtgnaccaggggangctacnggtttaccaaccgntttt

SEQ ID NO: 2744 - DNA, 343 bp, Homo sapiens
  misc_feature (1)...(343): n = A,T,C or G
cccaccccaaaaaggtccnaagtggttcctggaaacctttggtggtggtccgtggaggtggtttcggtgggaatgacaaccttcggtcgtggaggaaacttcagtggtcgtggtggctttggtggcagccgtggtggtggtggatatggtggcagtggggatggctataatggatttggtaatgatggaagcaattttggaggtggtggaagctacaattatccccacacataaaaaatcaaaacattaaactaacccccttcccccccccccacaacaaccctcttaaaactaattggctttttagaaacaccccacaaaagctcagaaattggctttaaaa

SEQ ID NO: 2745 - DNA, 562 bp, Homo sapiens
gacaactactcagggtagggcaaaaatccgagtattgtattgtgactaatgtataacaggttatttagattctgtctgggggaaagtgtaacgcattccaacaaagggttttaatgtggattttttttttgccaccccatgctgttgattgctaaatgtaacagtctgatcgtgacgctgaataaatgtcttttttttaatgtgctgtgtaaagttagtctactcttaagccatcttggtaaatttccccaacagtgtgaagctagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggtcataaaagtgattgttggcacatcctatgcaatatatctaaattgaataatgctaccagataacattatagatgcgaatgaagctcgtgtacccatcatcatgtgtactccatcaacgcttctaattctcc

SEQ ID NO: 2746 - DNA, 1092 bp, Homo sapiens
  misc_feature (1)...(1092): n = A,T,C or G
gttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggcaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgcttcaaaggaaggacatgttttagacaaattactcatgtgtattggggcaaaaaactccgaggccctgtttttgtggcctaattgttcttaccagggttattttgagtccctgctctgtgaaaagtgtaaagcatnccaacaaagggttttaatgtagattttcccccggggccccccatgtgggggttgttaaattgtcacagcccttccccgtgacgctgattaatttgtcttttttttaatgtgctgtgtaaagttactctccccttaaccccactcttggtaactcccccccaacagtgtgaagttagaattcccacttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcatatatcacattgaatatggtacagataaattatagagggatgaacttgtgtatcattatctgtgtatcataacgattattctctgaaaaagaaaagtcgacgcgc

SEQ ID NO: 2747 - DNA, 462 bp, Homo sapiens
  misc_feature (1)...(462): n = A,T,C or G
tatgaaggccncccccnagtgaaaggaaagtgaagccacattanttggaaccggtgaaataataaaaattttgccccctttaatttaaccctccccttgaccccnattcccctaaaaaataaatggcctcaaagtaaaaagacctccccccaatggtggggggatgggtgggttaattaaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttantcangccatgcagtttacatgagctgttctgcagctcaaattccattttgtgaatgggttttttttttaataaactgtatttaacttaa

SEQ ID NO: 2748 - DNA, 452 bp, Homo sapiens
gctaaaaaaaaaaaaagacatttattcagtatcatgatcagattattaaaacatttagcaatcaacagcatgggtacaaaacaaaacaatctacactgaaaccctgtgttggaatgctttactttccacagaacagaaactattatacaattagtcacaaatacagtcatcaagttctgtgatcgtggtggctttggtggcagccatggtggtggtgatggatatggtggcagtggggattgctataatagatttggtaatgattgaagcaattttggaggtggtaaaagctacaatgattttggcaatgacaacaatcagtcttcaaattttggacccatgaagggaggaaactttggaggcagaagctctgggccctatggtggtagaggccaatactttgccaaaccacgataccaaggtggctaaggcagttccagtagcaatagtgg

SEQ ID NO: 2749 - DNA, 314 bp, Homo sapiens
gccgcgtcgactgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaatcgtttattgattacacatgataatggatacacaagcttcattcccatctataattttatctggtaccattattcaatctaggtcgacgggctgcgaatttagtagtagtag

SEQ ID NO: 2750 - DNA, 371 bp, Homo sapiens
attggagtcaccatagtttgggagaaaggaaggctgataactcaaccttattttattctgactgctaaacagaattggaaactaacatcatcctcaggtaacagataaaggccctctttcccattcataggaagcaattttggaggtggtggaagctacaatgattttgggaattacaacaatcagtcttcaaattttggacccatgaagggagggaaattttggaggcagaagctctggcccctatggcggtgaggccaatactttgcaaaacacgaaaccaaggtgctatgcggttccgcagcagcagtgctatgcagtgcagagatttaataggacaagctagcagggagggacccagagtcaggagc

SEQ ID NO: 2751 - DNA, 811 bp, Homo sapiens
gcagttttgctcttgttgcccagcctggagtgcaatggcgcgatcccggctcacagcaacctccgcctcctgggttctagcgattctcctgcctcagcctcccaagtagccgggattataggcatgcagcaccatgcctggctagttttgtatttttagtaaagacagagtttgtccatcttggtcatgctggtctcaaactcccgacctcagatgatccgcccacagctgcctccgacattgttggaattacaggcatgatccaccgtgcctggccaaacaaaggcatttctgtgctaggtcgttcttgttcctttatctgagtgagctggaggtttgtacaagtttttatccaaatgggccagaggtttttctatctctgcagccacgggcatgtccccaagcacaacaacatatgttagttcccttctgtcgtcttctcgcagccgtgattttttccaggcttctttacatgttatgcagggatgaggcacctgaccagggacgtttccagggacgtcttctcttgcgtatcgtaccctaaggcaagctaacgtaacttctttcacaagtaatgagtattcacttttacttttgtaagacaaaaattatctaaaagctactgcaaaacaatagaactatactaaccacttctaaaccatatacttaaaagttcagaaatgacaatggcatgtttttaactacaattagaaatttaagactaactaaaaggcacagttagaaaacctttcaaacatcaccttcaaataacaaagggttattctcacacaattatatggatttaaactat

SEQ ID NO: 2752 - DNA, 1092 bp, Homo sapiens
  misc_feature (1)...(1092): n = A,T,C or G
gcctnttattgttaanccccctttnggcctggtaaaattnccttngccaccaattnccagnagggggtngaggccttcnttgaccaccttggtccgtgggccaattaattttgggggggaccgtnccatccacccggattgaggncaaccaanagcaaggggattaccaccatggtactgaatccagtgtatggaaaaatatccccaaacagaccaaagcagaacatggaatagatatatgcacatttgtagtattactcacaaacatgttacctggaagcaaatgtacccttaaggatgagtagattcagcaaacagggcacgtacaatcacgggggaatgcattcagccttaaaaataaggaaatcttgaaaagtactacaataaggacaaatcttcaaaacattctgttaagtaaaataagacagtcaaaaaggaaagctgtataattacactcatgtaaaatatttagtcaaactcaaagaaaccaagtgtccgtagtctcagcagtgcaccaagatgtaacagtctctcgtagtctgagataacatccagagttctttgttctacctctaaggagattaaggagcgtgaacacaaaggtgaggttggagtgaaagtttaagaagcaagagaagaaagctctttgccagcagagataggtgtctgaaagtggtgcctctacgaggctgggtccagggtttttatggactgggaagggaaggatatgtgcctagttcacaggctgtcttgaaaaacgtgtggctcagcttggccccgcctttggcccaggaccaatcaggagctgaagggatgattgatagatgctgcttagcttggcccaagacttaccagaagctaaggtgaaagtttgccaaggagcttggcacgggagcaatcaggggctgaagtaattattcatagaggtcagacttacagtccaaataaacgagagtgtcgaccggaatgcaccagatcccacagtgcccatgccaacaaaaagagaaggaacattttcctgggagcccactgactgtacaaagacaaaggtgtttcttttttttttctttttcttgtctntctttctttttt

SEQ ID NO: 2753 - DNA, 563 bp, Homo sapiens
tttttagatgatgaacacggtatttattgaacactcagtatatatgtttttttttatagaagtactctgatttttattgttatacaacatatatatataattgtttccccaaaatatgcacaattacatgtgtcaattttaaaaaatgaatgaagactataatgtaaaacctatagctgtaaaattcctagcacaatacagaagggtgaagcttcatgacaactggtcgtggcaataatttgggggacgtagcatcaacggatgagacaacaaaagcaagggaatacacatggtactgaatcagtgtatgaaaaatatcccaaacagacaaagcagaacatggaatagatatatgcacattgtagtattactcacaaacatgttacctggaagcaaatgtacccttaaggatgagtagattcagcaaacagggcacgtacaatcactgggatagcattcagccttaaaaataaggaaatcttgaaaagtactacaataaggacaaatattcaaaacattctgttaagtaaaataagacagtcaaaaaggaaagctgtataatt

SEQ ID NO: 2754 - DNA, 419 bp, Homo sapiens
agtctctcgtagtctgagataacatccagagttctttgttctacctctaaggagattaaggagtgtaaacacaaaggtgaggttggagtgaaagtttaagaagcaagctaactaacttctttcacaagtaatgagtattcacttttacttttgtaagacaaaaattatctaaaagctactgcaaaacaatagaactatactaaccacttctaaaccatatacttaaaatttcagaaatgacaatggcatgtttttaactacaattagaaatttaagactaactaaaaggcacagttagaaaacctttcaaacatcaccttcaaataacaaagggttattctcacacaattatatggatttaaactatatgttgattgtaaatttaagattatttccctgatgactcaccaagatagaat

SEQ ID NO: 2755 - DNA, 586 bp, Homo sapiens
  misc_feature (1)...(586): n = A,T,C or G
tttttttttttttttcatgttttaaaaaagtgacattgctttattactattggcaggtggggcctgcatgaggtggttagtgtgctcaggggatgggtgggctgtggagatgatgacagaaaggctggaaggaaagggggtgggtttgaaggccagggccaaggggtcctcaggtccgcttctgggaagggacagccttgaggaaggagtcatggcaagccatagctaggccaccaatcagattaagaaattctgagaaatctagctgaccatcactgttggtgtccagtttcttcatcatgcggtcaaggacaccagggtccttctggttctttgtgaaggcagctagttctgtattcatgaagcttaggaactctgtcttggagagagtgtagttataaccatcctttccagcatacttctggaagacagcaatcagggactcgatgcaccgctcagtctctgtagggctggagatttttgccatgttggagctgagccaggcccgggaagctgtggctgggaccggcgctgaaaactctgtgcgcccggcgttcgggtcttggagcctcccccctccgtgcng

SEQ ID NO: 2756 - DNA, 245 bp, Homo sapiens
gactctacactaacgaaagctggaataatgaaaacctcagagtggctctcagcatatatccaaaatattcacaccaggcaatgaatactctatgagaagtgttttattccaaatgatccgacagttggttagtttgcacacaggaaggacagattcagatgtacaggcatgagtacaagtttgctcagggagaacaccacagcacaatggaggttcttgatggtggattgtggttgaaaaatgcc

SEQ ID NO: 2757 - DNA, 2223 bp, Homo sapiens
  misc_feature (1)...(2223): n = A,T,C or G
cgaagatcgtccctgctcttccctccaccctgcagtgagcncctggcagctgggccggacgcagcttcccatgagcagaggatcgacctgggagcctggtgggtgatctccgcccagaccaagcatgagaaccccaagtccagtgggacaggccacagaccagcgactgctgcccatgcctgtcctggggactccagacagtgccgagggaaaggagaaatcattcattcagccattcattngnngncncaggnattntttttttttttttttttttttttttttttggactgagtcctccctttgaggcaggcactgttttatgcactgaaatacaactatttatacaacagacactcttccctccccccatggaggttctgttcaagcggggagacagtcatttgttaaacgaaacataaaatctcagtgacaattagagctctgggggagaatgaaggagcaggaagaggcagaggaagaggagccagggctgccaggtgcagtagcccaggttgcgcactgctcaactttgctgtgggattcacatcacagtcatcagagtcacactgggcagtttcccagtagatggccgcactgtgtctcagggaagggcccattgccgctttgtccaaggccatctcatgggcttcaaagccatgggaggggaggggtcctgccaggatgacacagagtctggggccctcattttcctcccatcagatgatgcccagcctgggaaggcactgagaccgcagcggagtgggccagggggcaatgagaggaggggacgtgggtggggcagggctggggcactggaggagcaggtcaggcagggcccgtcagcccagaggcaccccaggactcaagcctgcagctgaccccgctttcctagccctcactgcagctgtgggaaggggaagcatggagccctccctcaaggtcagtgcagcgcctggcttgagctcaccatggtgactgtcccctgctgccaccattgcagtcactgccctggtgggcagcctggaccccagctccactgcgcatggactgtgtggtcttgggcagtgccaagctcagcctcacgggcctgtggggacggtcacaggaggtccacgtgccaggcccagggttcatgcacagggttaccaccactgcgaggttgcctgccccgtcttgtacccggccgtccatgtcctcatttcaggcagcaggacaaaggcaagtggaactgagaggggagagagaggccagagtcccctgcagccctgtccccagggacccagtgccaagagcaacctcagaggagggacctgggagtggctggttccagtccccacccccactccgatgggaaagtgaccccgggtgacctgccaaggtcacagggcagagctagggcgaggtctaagcacctcatgtctgagcagaggaacccactcaaggcccaccaggacccacacggccagtgttgtcatcactgagacatagagacgggggcccctgagccacacagctggacagtgagaaaactaggctcccagcagtgagctggccgcatgcccagggccttccacagctccacacagcccagcctccaaaccaactcaggatgggcccagggctcaaatgcccccaaggcccaggcagaaccgtgggagtgcaggtgcccaggggtgacgatagggaacggtggggactgcggagaaccggagagggcttccctcctaagggcagtgaacctcaaagttccctaaacctacagagcccaccaagctcacctctccagggggcttcagtccagtctcaagagtggcacctggtgaagggggttcttgggatgtgacagtgacctccgaagcctggacatttgctctgtaaggagggggtctgggcttttaaaatgtcctgctgagaaaagagaagacacagggtggattcgggcacaagggatgtgacggaaggaacagcccctctgcagcggtggcggttcagagggcccaatcagcacacgacccccaccctggcccctgcagaaaggcaggcctggtgcggaagctgaaactcgaagcctagcgcgaaggccccgcagatgtcagtcgtggggtgcgccagaggcaatgggggccccgtgatgagtgcgaccctaactgggttatgttgatgaacgcagggattttcacatcagcctcgtgccaagggtggcgtcaatggggggtcaat

SEQ ID NO: 2758 - DNA, 349 bp, Homo sapiens
  misc_feature (1)...(349): n = A,T,C or G
cgaagatcgtccctgctcttccctccaccctgcagtgagcncctggcagctgggccggacgcagcttcccatgagcagaggatcgacctgggagcctggtgggtgatctccgcccagaccaagcatgagaaccccaagtccagtgggacaggccacagaccagcgactgctgcccatgcctgtcctggggactccagacagtgccgagggaaaggagaaatcattcattcagccattcattcgttgacccaggcaattattcattcattcattcaacagatattgactgagtcctccctttgaggcaggcactgttttatgcactgaaatacaactatttatacaagag

SEQ ID NO: 2759 - DNA, 1681 bp, Homo sapiens
  misc_feature (1)...(1681): n = A,T,C or G
attgaaaaggcgaccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttccctcgtacgaggaggcccctgtcccagctggaggagtctgtcaagggaagaagcccaagcagagggcggcctaggctggggctcaaagggccggagggaatgaaggttcaccacccttgacccttcttccaaagcaggtgctgatcactggttcctgtatgtgaagaaaaagaatccccccagtggacacagctttcctcccaaagcacgtggtctctgcgccaggcagcccgggcgtcagagctcaagcacctgccccgattggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagccaggcgtggtggtgcatgcctgtaatccagctacttgggaggctgaggcaggaaaatggcttgaacccgggaggtggaggttgcagtgagctgagattgcgccactgcactccagcctgggcaacaagagcaaaactccgtctcaaaaaaaaaaaattgccgggcgcggtggcaaatgcctgtaatcccagcactttgggaggccgaggcaggtggatcacaaggtcaggagatagagaccatcattgctaacatggtgaaaccccgtctctactaaaaatacaaaaaaaaatctagacagaccctcgtgccgaaatcgggctccaaagggccnttccac

SEQ ID NO: 2760 - DNA, 1607 bp, Homo sapiens
cgaaggtccagcctttcctgccaaggtggctggctgagcctaactgtgtcagaaggaatgtcaccgaagacctggttcctatcgaggacatccctgacgtccatcctgacctgcagaagcagctgcggcgcacacggcatctcgtcctactttccagtccaggcagctgtgattcctgccctcctggagagcgcagctgtgggtttctggtgggcagaggtggctaccggcctagcgacctctgtgtttctgccccaacaggcagtggggaagacactggccttcgtcatccctgtggtgcaggccctgcttttcgagagtggtctgccacatccgtgccctggttgtggttgcccaccaaggagctgggcccagcaggtattgcctgaacttccaacctccacacagatgccacactctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgcttccagagcgaggaccccgcggacccctgtgccctgctccagcgaaggcaggcccaggctgtgacagcgccaggtatccagcagcacgcccaggtgctggcctcccctgagcagagtcctctgcacacagctctccttccttaatgcccagagataagggtggcttgagctctggttgcacagaaccgcatcgtactgtcacgtgagctggacccaccttgctcctggttgcggagtctctacagtgcgtagatggaggaatcctgttccctggaggttcggggcagccactggtagggtgccagcaacacccccttctcttccagcacctgctgtccccaagatggcccctgcaagaagctgctcttctcagctactctgacccagaaccctgaaaagctgcagcagctgggcctccacacagccccggcttttctccacagggctagcacacaggggcctggaagatacagatggggacggggattcggggaagtatgcctttcctgttggcgtcacgcaacactacgtgccctgcagcctcagctctaagccgctggtcgtcctgcacctggtcctggagatgggctggggacacagtggccagtgtgtgggtttgttttggggatgatgaaaatgttcttaggttgtgtgtggtgatggctgctcacctctataaaccttttactaaaaaccat

SEQ ID NO: 2761 - DNA, 1713 bp, Homo sapiens
gacttcggcacgagggtttacctcctgaccgccgcacggaaaccgcatcctggggctgagaaggagctgaagacgacagaggtttccccagcctccctcccctagctttttccaccgtgggcttctgcgcgagagcctggaaagcgctcacctggcctctctttctttttgatggcaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccaggtgccccagccccgggcaggcagcccccggaacacctccctgggcacccacacacaaggctgtgagtggccgtgggtcaggcgtccctgccacatcggtgccaagtgtggtctcagcactctcaagctcatggttcccacttgggtctcctgaggctggcgttcctctgggccttggtgccatccctctggggagcggttcccaggcctccagcagagcagcccagcccagaggtcacaggcagggaagcggcaggcctaggcctaggcgtaaacacgacttctctctcgcctttcctcatccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggtctgtgtgagggtcccctttctctacagcgggtgtgcagaggacaggtaacagccttgctgacgcaggcgctccttccccctcaggccctgctttcgagagtggtctgccacatccgtgccctggttgtgctgcccaccaaggagctggcccagcaggtatgtggaccctagacctggagcgtggcaccgcccgcctcagcttccctgctgagtgcacagcgatcaagcccctgggggacccaagattagatctggggtcctttttgctgcagtaaggtggacacacagcctacctaccaggccagtgacagacttctcctgcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctggtaggtccccgccccaggggcctgggctttgagctcagggccgcgccacccagtcccgggctccctgtctcctgcagattatcgacgaggctgaccggatgattgacagcatgcatcagtcctggctgccgcgggtggtggcggccgc

SEQ ID NO: 2762 - DNA, 1062 bp, Homo sapiens
gcgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctgcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcg

SEQ ID NO: 2763 - DNA, 531 bp, Homo sapiens
cacggcatctcgtcctactttccagtccaggcagctgtgattcctgccctcctggagagcgcagcctgtgggtttctggtgggcagaggtgggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgc

SEQ ID NO: 2764 - DNA, 665 bp, Homo sapiens
gacctctgtgtttctgccccaacagccggggggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggc

SEQ ID NO: 2765 - DNA, 699 bp, Homo sapiens
  misc_feature (1)...(699): n = A,T,C or G
aagacactgcctttcgtcatcctgntggtgcaggccctgcttcgaagagtggtctgccacatcgtgccctgggttgtgctgccaccaagagctggcccagcaggtgagcaagttttcacatctacacagatgccacacctctgagagtctcnctggtacngggacagaagtctctggtcaaggagcagnagagcctcgtccaganaacgtaggttgtgtcagggtgcgggttnttcagggggtccctgctcagccctgcaggtggcctgaggcaccgtggagcagaggaggggccaccatctttaaccacctgttcccgtgaagaggaggagctcccacgggcccccttcccatgtggggtggagtcggggctgtggggtgaggcagcgtcttgctatccggaagcccttaagaaagcttccttctctcgagctgctctctggtctgtagagctgatgggtaccgctgcttggctgacatcgtggtagccaccccggcccgcctggtggaccacatcgaccagaccccaggattcagcctccagcagctccgcttcctggtaggtccccgccccaggggcctgggctttgagctcagggccgcgccacccagtcccgggctccctgtctcctgcagattatcgacgaggctgaccggatgattgacagcatgcatcagtcctggctgccgcgggtggtg

SEQ ID NO: 2766 - DNA, 498 bp, Homo sapiens
gcggccgccttccagagcgaggaccccgcggacccctgtgccctgctccagcgaaggcaggcccaggctgtgacagccgccagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggt

SEQ ID NO: 2767 - DNA, 492 bp, Homo sapiens
  misc_feature (1)...(492): n = A,T,C or G
gcgnccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcaagctctaaagccgctggtccgtccctggaaccttgggtccttggaaattggggcttctccgaaggggttctcttggctttcnacttaaactttccccgaagaagaaattccccacaagggcttctttccttggcttgggttgcaaaggcttttttnggggggggnttgttgggaaangttggggcttgaangtt

SEQ ID NO: 2768 - DNA, 459 bp, Homo sapiens
taccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcagtaggtggacaccagctacctccaggccagtgacagacttctcctgcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcc

SEQ ID NO: 2769 - DNA, 1576 bp, Homo sapiens
ctctgagaacattcgaaaaacaccaggcaatagatgtcaacaaacactgtcaaagaaaaatggatagaatttaagcacatgaaaagatgctcaacttcattagtgattaggggaatgcaattaaaaccacagtgagatgctcctacaggccttcctaagatggctaaagaccgatcataccaagtgctggctgctaaggatgtggagaaactggaacctattcatatactactagggggaatataaaatggtccacacactttgggaaacagtttggcaatttcttaaaaaggtaaacacctgccatacaatccagccgttccactcctagggtacttacctaggagaagagccagcatgtgtccacacaaagtcttgtaaggtgcgtgttcctcctagggcttatatgtgaggagtccaaaaactggaaacaacccgaatgtccactgacaggtgaatggataaaaaaattacgatctatccctacacggaatatatttggaatatcattcagcaataaaaaggaatgaactggtgatacatgcaaaaagacgaatgaatctttaaaaaaaagttaagtgaaagaagccagacacaaaagaggacactgctcctaattccattataaggaattctagaaaaggcaaattacgtgacagcagaatcaagcgcttgcctgggggctggggccttaagccgggaaaaaaatggcaaaaggatgcaaggggccccctagaagtgaggaaaacccccttaaaaggctgttctgcaaccaggtgggtgaatacttactaggattcaatggaaaagtaccacttaaagtggagtgaattttatggtagggtaaccttattcccttaaataaagctatttttaaagtatagtggataaatatgcatttatatttttaattgactattttatctatcttttttctatttttttttaaaaggttggtgcctggactgttagaaatgcaaaatgcttgttccccagtgccacagagaaatagcactcgagcatccatttaatgttctcagcaaggcagttttgactttttgcataaagggtgaccctcgcaggtggagccatggcaagagcatacctggacacgggagggacaggaggtcttatccctgaggcaggtagtccctactgctgtgtcgttcccttattggctagggttggaccacacagtctaagctaattccgactggctattttaaaaagagcaggagtacgagccagagtggcggggtgagcagtttggtgggaaggacggttaggaagaggtaactaaaggtgactccggtcaaagcaggtgaccgagatgagtcaggatggagcaggtgaccaggggaacagatgtgaactagtgattaggactggcgggaaagttgtttactgaaactagaggcaagggggtgaagagaaccaggaagttaaactttaaaatggagaatcaaagaacaggaagctgaacagactgacatactgattctttgaagagaaacttggggttccatcgtgcctcaatgtgtctaataagtgttatcaggtgtgtgctcagaaaatc

SEQ ID NO: 2770 - DNA, 491 bp, Homo sapiens
tttttttttctcagcaaggcagtttttactttctgcagaaagggtgcccctcgcagatggagcaatggcaagagcacacctgaacaagggaggggaaggggttcttattcctgacacaggtagccctactgctgtgttgttcccctgttggctaaggttggaccacacagtctaagccaattccaattggctattttaaagagggcagggtaagagtcaaagtggcggggtgagtagtttgacgggaaggacggttaggaacaggtaactcaaggtgacttaggtcagagcaggtgaccgggatgagtcaggatggagcaggtgaccagggaacagatgtgaactactgattaggactggcaggaaaattgtttactgaaactagaagcaaggggcgaagagaaccaggaattttaaatggagaatcaaagaagagatctggccgggtgcagtgggtcacgcctgtaatcccagtactttgggaggccgag

SEQ ID NO: 2771 - DNA, 1818 bp, Homo sapiens
  misc_feature (1)...(1818): n = A,T,C or G
aactgattggctctctgagccaagattcggcacgagggtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtagcttctgtgttcccgtaaggatacagcttcctttgggaagccccatctatggctgtagatctctcggtttcaagttgacaccaattccctctccatgatcttcagacttaactactactgggtgcttccccaacccactggttgggtggtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcagaaagcattgttatttaggttaaatatctgtggacaagaaacaagataatcagttactgagtgaagaaagacgggaatgatgtcccatacttcccagctctctaaagtgttatgctgtacaattaaaatacccctgacccatccatctgctaccattcgttgtgggataattcatgtaattctctaaccctggtgggcaagtctttacccttcagtagtcaagattacgttagagacttcgtccacgaatccacaccacctttcccatcagttctcaccggaaatatgctgcccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgacgggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatcaaaaaaaaaaaaaaaaaaaaaaaaaaaaaaagntcatatgcgacgcggggctttcaatt

SEQ ID NO: 2772 - DNA, 614 bp, Homo sapiens
  misc_feature (1)...(614): n = A,T,C or G
agctaagctcctcttcagtaatagaaagacttatgaagtcttttactacctctgggttagccaaacanccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgcttgccaaaaagaaaatcagcttttctaagatcaagccagagttgcttctcttacaaccttacggcgctaatgcattaagtttgaagtcgactgncaaagagggcccagcataggggcagcaccccatcattttgtttgaatttctccccttaggnaatttgnccttccttttgggccttctggtccacaggggcntttctctnccagctggggnaacaaacctncctttngacgggganaaataatngcggtangg

SEQ ID NO: 2773 - DNA, 298 bp, Homo sapiens
  misc_feature (1)...(298): n = A,T,C or G
aggcagggggncagcaaccccccaatcattttttntgaatttnctcccctttaggaaattttgcctttcctttngtcttctgtgcccccaaacccaggccttctctccagctggacacaaacctcctttgacgggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgc

SEQ ID NO: 2774 - DNA, 2137 bp, Homo sapiens
  misc_feature (1)...(2137): n = A,T,C or G
tcctttttttttttatgagttttgggcaacactcattttttacatttattttgacatatttgagcttattccatattaacaattatttatcatgcttttgtaacacatgacagcatttttcctttaccaaactttttgtgtacatattttaatgcctgcataatcttccattacacggatatgccacaaatattatgctagtgtacattttttattttgcaaattatgcactgtcataaatatttcagtgatcatcctcatacatatttctgtcttcattacaagttagacccttaaggtgttaacaatagtaatattattaatggcacctactatgtgccaggcactcttttatgtgattcatacatatcatctcaatccacatgacaacgctttgaggtagatactagtagtaacctcattatacagttgaggaaattgagccacaggttattagcaatgttaagagccccagttaagtgactattctactcccttaatgaaaaccatttctgataggtatgttgtatgtgggcatggtgtgtacacagtgagaagagcagcaggaaacatgaaacccaggacctagttctgagtctgacttcactgaaaatgtgagaccggggccaattcacttgatctcaattgtacaacgacaagtatgagctagaggctgccatgttcctcgtagttctcaagtctcctgattctaaccatcatttctaggttttttcctcagagagagatcaagatctctggttggcttcagcaaatcacctctcgccacgattcaacaatcaaatcattgagcanctaatntttntnccanaaaatgganaatcatggtcaagtcccttatntaccaacagactgatttatagaatgaaagagaaaattaaaatagatcctcttcctgaatcttttgtgggttattaacttaccagagaatctgaagactgggatcctctccatagaatggaaaacctttgtacaaacagaataaatgtgtatacaacattacaagctgtttattgatcctcagaaatgaaacctatatccactatttgtcagtgattttcccaggctgttgagttctgatttaggcaaaagggaaaaaccatgtatgactgtaagggaagtgagaactcagtaaattcttataagcacacaagcagatttcaattaaataacagatattagggtgcggcaatattattaataatcacagccagtaactacagagaacataatatatgtcaggcactattctaagctgtttccatttactcatttaatactcaccataatcctacccaggtaagtactattattatcgctaatttacagatgaggatatcagtaagtttggcacagagaagctaagcagcatgttcaagatcacccagctagtggggtttcaacctgggtagtctagctcaagtctacgctcttaaacactaatctttctttataaagataaaagactaccttgagaaagagggtatctttggactgtgctctgtttatcacatgaggaacacttgctctaaatattggtttaaaatacttggtccccactaaaatgggggacccctcccctgaatatgttccaaaaggccccaatgttcccctaggtccctaacatcccagagaattactgtgtttttaaattctcaggagcttttgcagtgctaataagagtggaaaaagtggaactctgtgacccaaaacaatttagaataggaaagctcattaacaggtggtactcaaaagcttctttgatggtagaatagagaaactagatatcctcttacaatatttaagtttcttaaaataattattacagcaacattaaacagactataaaactcagtcaaaatctccttatctaacaaatcaattctgttcaattatctgtatactttcaattcttgcccacatgcaaatgtacttaaaaatgcctcgtgccgaattgttggccagaggggcaaattttaattgtactacattataagcatttttcttgctgttaaccaaaatatggtttctaccagacacataaaacataccaaacactactaaatgtcccagaagagagacatagtcaagaaaacaatgacatattgaccctcgtgcc

SEQ ID NO: 2775 - DNA, 1957 bp, Homo sapiens
ttttttttattttgttaaatttcctttttttttatgctagtgtacattttttattttgcaaattatgcactgtcattaatatttcagtgatcatcctgatacagatttctgtcttcattacaagttagacccttaaggtgttaacaatagtaatattattaatggcacctactatgtgccaggcactcttttatgtgattcatacatatcatctcaatccacatgacaacgctttgaggtagatactagtagtaacctcattatacagttgaggaaattgagccacaggttattagcaatgttaagagccccagttaagtgactattctactcccttaatgaaaaccatttctgataggtatgttgtatgtgggcatggtgtgtacacagtgataagagcagcatgaaacatgaaacccaggacctagttctgagtctgacttcactgaaaatgtgaaaccggggccaattcacttgatctcaattgtacaacgacaagtatgagctagaggctgccatgttcctcgtagttctcaagtctcctgattctaaccatcatttctaggttttttcctcagagagagatcaagatctctggttggcttcagcaatacttcatctatcattcaacaatcaatcattgagcagctaatatttatgccagaaaatggagaatcatggtcagtccctatatacaacagactgatttatagaatgaaagagaaaattaaaatagatcctcttcctgaatcttttgtgggttattaacttaccagagaatctgaagactgggatcctctccatagaatggaaaacctttgtacaaacagaataaatgtgtatacaacattacaagctgtttattgatcctcagaaatgaaacctatatccactatttgtcagtgattttcccaggctgttgagttctgatttaggcaaaagggaaaaaccatgtatgactgtaagggaagtgagaactcagtaaattcttataagcacacaagcagatttcaattaaataacagatattagggtgcggcaatattattaataatcacagccagtaactacagagaacataatatatgtcaggcactattctaagctgtttccatttactcatttaatactcaccataatcctaccaggtaagtactattattatcgctaatttacagatgaggatatcagtaagtttggcacagagaagctaagcagcatgttcaagatcacccagctagtggggtttcaacctgggtagtctagctcaagtctacgctcttaaacactaatctttctttataaagataaaagactaccttgagaaagagggtatctttggactgtgctctgtttatcacatgaggacacttgctctaaatattgtttaaatacttgttcccactaaaatggggaccctccctgatatgttcaaatgcccaatgttcccctaggtcctaacatccagagaattactgtgtttttaaattctcaggagcttttgcagtgctaataagagtggaaaaagtggaactctgtgacccaaaacaatttagaataggaaagctcattaacaggtggtactcaaaagcttctttgatggtagaatagagaaactagatatcctcttacaatatttaaaagtttcttaaagtaattattacagcaacattaaacagactataaaactcagtcaaaatctccttatctaacaaatcaattctgttcaattatctgtatactttcaattcttgcccacatgcaaatgtacttaaaaatgggttagcactggtagtggagatgtgttgtttttaattgtactacattataagcatttttcttgctgttaaccaaaatatggtttctaccagacacataaaacataccaaacactactaaatgtcccagaagagagacatagtcaagaaaacaatgacatattgaccctcgtgcctgc

SEQ ID NO: 2776 - DNA, 548 bp, Homo sapiens
tttcaattcggggtgcaattattttattacacacacttatctcagcattgtaattttagccattcacaagcacattatgatatgggacagagcccctgtccttgtcctcttttcccaaacttaggacttggtagaaaggatcagagtccacatttaggcattcagatggaaagaaacggttcattctgttgcatgtgctggttgccttactaggtttcatgcattcttccaggtttctctgtggggttacatacaccaagtagaactatgtaaaaaatagaggcggcctcagtggttgcatgcaggctttcggaggtgaataagctgatcctgcacttctagttacccagctgcttggtgtgcgggtggtagcaaacatctctatgatttggcaatgtttccatccaaataatttgaagttgatgatttttaataaatctgctctctttcacaccagaggctcccagaaagaggccggccaagctggaggatgacatcacctggctcagaaactcaaacctcaggatacagttttggtctttctggcc

SEQ ID NO: 2777 - DNA, 536 bp, Homo sapiens
accagatacgggtactgttgtaactctgttctccatgaaaagaaaggaagaaacaacactttcagagatggagcctgttgagccacagtaccaactagtcaatgctgaatcgacttctccctttctacattgcctgagagaagtcattggggaatactctgtacacgaattttcactgttggggaaaacagagagtcaagggattggattgtggattgcattggtggttttcctcagtttcctcatcttctccacaagtttctacatatcgaatgcagagcagcccttcttcaaaggacctcctacggaagctgctaaggaactcagtctgtagctctgcgtggagccatgtgtaaacactgaactgagacctgccacctcctactacctaagggcccattttcatctgatatcatcccccagaaacaaactcatgatgacttccatgttttttttagattagatacatggagaattttcctttcccttagaattaaaatcctgcattctaaaaaaaaaaaaaaaaaaaaaaaaaa

SEQ ID NO: 2778 - DNA, 504 bp, Homo sapiens
tttttgtgacttgtcaagccatgaaaagccttttaatgacaattggcatcacaggtataaataaatatcttcttctttccatctataatatgtgctacaaatatatttttcaaaggtccaacccaggttaggaggcttcaaggaccctttcttagctactgattttagtaattaaaaaaataaacacaataaacacccctggcatctttgtgagcgcccccctgcggagagcatgagggctgtcaggcatcttcctcctgcagccgcagccaatggagcacacggagaactggagtcaggtgatcacgaaggggcttatttcactggcgtggtctacgttgccacatgtgtcgctttggatgaatgcatttttgcaatgtgctgctacacaattatgctgttcaaaaacacagttgattgacaatctaacatagattttatctttagagtttatgctggtataccccaacccaacaacataagaaaaacaactcaaaaaccctc

SEQ ID NO: 2779 - DNA, 421 bp, Homo sapiens
tttttattatttttacctttttaaaattttacattttattgatacataatagatgtacatatttccagggtacctgtggtaatttaatacattcatacaatttgtatgtataattgggatacccaccaccaattacataatggatatttgagtaccaaaatttacaatttgagtacaaaatccttcagacttctactaaatacttcatagttctttgatcccaatgtactcataatggtttaatttttaatgactctattaaataattctaaaactagcaattcaggttttgcagaaataacccattttgtccttttatctcagtgggttatggtggtttgtaaaagtacctaaactcaataacacatataaccggcacaagcagatttcagatcagtcagcatttcccccagcggagcac

SEQ ID NO: 2780 - DNA, 384 bp, Homo sapiens
tttcatattaactctttattaaggtctcatttttgaaagccttgagaccactggctgcattttccagcttttctctagtacctggtgtatgtaagtaccaagggttgtctgcctagacttgtaggcaacatgattgtaaaaaagagggttgtttaccatctggaaatagcatcgcttggattgcaatcatatgccttgaggaagccaccttcttgtagtagaaaagtcgaaagccctattattttcgttatattcaaatttcgctcttaaaaatcatttagcttcgtaataaaaaagcaattaagagaaaaacaaacaaccatgttccttattgttaacaatcctgtatcacgctcttaaaaatgtgttgagggcagatcttat

SEQ ID NO: 2781 - DNA, 908 bp, Homo sapiens
ttttttttttttttttttttttttttttttcacaggtttgtcttttaatcagcatccatgaaaattcattaaaaggtctgatacgaaaagcaccaggctaacaaatcagtcctgaattcaattttacaaaaacaccctctcctcttccatctcatccctaatattcctacgttatctcgaggtgcagagaaatataaaagggatccttgacataaaaacgtattaaaaagccaccatgagtagaatgtacggtaacagcgtctgactcggccggcaggacaggaaacctacagaaccaccatgccagggctttgtgtgagcaggcgggcactccacatgggcacgtgtgtgagcaggcaggcactccacatgggcacgtgtgagcaggcgggcactccacatgggcacgtgtgtgagcaggcgggcactccacatgggcacatgtgtgagcaggcgggcactccacatgggcacgtgtgagcaggcgggcactccacatcggcatgtgtgtgagcaggcgggcactccgcatcgacatgtgtgagcaggcgggcactccacatgggcacatgagcaggcgggcactccacatgggcacgtgtgagcaggcgggcactccacattggcacaaagcgagggctcatgcataagaggtgcagggacacctggacagctatttgaaatttaaaaactgggtttcctggctcacattttgtatcaaaaactagaagtagatcaatgatttcgatatgaaaatgaaacgcattaaagtactagaagaaacatgggaaacattcaaatatatcttttagggggaagacattctagtagacacaagcttagaagcaggaagattgtattcactactactcatgaagtcacgcgcgaatttagtatatatcgccggg

SEQ ID NO: 2782 - DNA, 441 bp, Homo sapiens
  misc_feature (1)...(441): n = A,T,C or G
ttttnaacaaaccgganaactccaacatcggccacttttnaaccangccgagcaactcccacatgggcacttgaancaggcgggcaactcccacatgggcacgtgtgtgaagcaggcggcactccacatcggcacatgtgagcaggtgggcactccacatgggcacatgagcaggtgggcactccacatggacatgtgtgaagcaggcgggcactccgcatcgacatgtgtgagcaggcgggcactccacatgggcacatgagcaggcgggcactccacatgggcacgtgtgagcaggcgggcactccacattggcacaaagcgagggctcatgcataagaggtgcagggacacctggacagctatttgaaatttaaaaactgggtttcctggctcacattttgtatcaaaaactagaagtagatcaatgatttcaatatg

SEQ ID NO: 2783 - DNA, 657 bp, Homo sapiens
  misc_feature (1)...(657): n = A,T,C or G
gcggccgcaagtgctgggggaggctgcttggagcatgggaggcctgcgggtggaagacaccagggtgcagcctggtgcatggtccggggcttggcctccctatggggcgtggggggctgtggtacatgcagaggcggcggctgtcccagcagcctggccaggagataccgtggagaaggcacgtgtttgagttggcatcactgtccccagacgccctccctcgggtagagccgcctgtcctaggagaagctgtactccagatgcagtgggtgacaccctggtcactcagccacaccccggcccctcagcctctgctgtcctgggccgcacatagagccctgtcctgctgtgtctgccgggcacaccccggtcactcagccacactggctcggcccagcgccttcccgaggtctgtgggggtccgggcggaggtggggtcagtgccgtgcgtgtttgatccagtttctgatcatccacttctgccccgagcacctctgtaccaccagccggagcccaaagttggcatctttggacatctccacctccaggcnagcgcccgtggcccggctcacaatggggccactctgggtgaagtcccacagccgctgtgttgccgcgccacatcctcacacttcttcagggtgggcagtgggcccg

SEQ ID NO: 2784 - DNA, 598 bp, Homo sapiens
ttttttttttttttcctcttttagtgcagataagccatttaatttaattttaaaatgactgtggggcacaggaaagaacaagaagaaaccacaaacaaggctcccatcttctttgtccccgagcaggtaactgtgcaacttatcaagattgtcagtttaattaactttggccgccagaggaggccattcttatctacaggacaagcaccgcggctgtaccagcctctgagttccgactcgggtcctgcaggtgtggcttcctggcgcacgcgggctctctgagctcagggaggctccgagcctgcctccaggacgcagcctttgtcactctgtcttactccacctccatctcagacccccgagctaccgggccaggctgccttctgcatccgtggagccccagtgcccgtgagggtgtccaggcctcaccctgtggggccgtgcatgaatccaggcatggaggaagtgtagctgggcttctctaagctgagacaagtaaagatgaagaggcccccaggtacccaattcctataggtgtgaggccagggcaccagacaaaggcgtgaatgcaagtatgggcgtctcctatggaaaagtg

SEQ ID NO: 2785 - DNA, 913 bp, Homo sapiens
cgcatctcggccgggaacctgggaactcggacgcagaaggacgcgcccgagccaggacccgccgcggggtccctctggtgggccgtggccggggagaggacgcgggccctggcggtcgaagacggacgcagcgcccggaaaggcgagccaggtctccggctcctggcgcccccgggggggccctcagcctcttggccttgaacgggctgttcatcttgattcacaaacacaacctggagtaccctgacttctaccggaagctctacggcctcttggacccctctgtctttcacgtcaagtaccgcgccgcgttcttccacctggatgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatcttcagctgaccccagcccacctgtgaataaatgtttttgcaggaaaaaaaaaaaaaaaaaaaaaa

SEQ ID NO: 2786 - DNA, 453 bp, Homo sapiens
tccacactactgtcccagggagtcgggcagcctttgtggggctggcactgcctctttggcttcctgccttactgggcagtgcatctggccatctgccccttggactttggactttacttaagagaaaactcaacaagggcagaaagcccaattcaaaacgtctttctgcctgacgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccagcccacctgtgaataaatgtttttgcaggaaaaaaaaaaaaaaaaaa

SEQ ID NO: 2787 - DNA, 1045 bp, Homo sapiens
  misc_feature (1)...(1045): n = A,T,C or G
aggttaggnnnttgttgttnatcnannnaatgnagtggnagggtgctctcnnntagggntgnaaaaaaatctcttanctttcnagggggtgcaaagaanccctgnattgancnaaganaggaanctaggaagctcnggtgtgagntcancctggnctgggactccacactactgtcccagggagtcgggcancctttgtggggctggncactgcctctttggcttcctgccttactgggcagtgcatctggccatctgccccttggactctggactttacttaagagaaaactcaacaagggcagaaagcccaattcaaaacgtctttctgcctgacagcaggccccaaatagccccagcacagcagtgttctgggtgtccagttcccacatttccccgagcagccctgacgcatgcccaggtccctatgcaccagggatattaaagtgactcaaggaggcaggaagccattatttcaaggctgtgggtttctagcaggaagcacaaatgatgactaaaccctagtttctgtcttttaagagaggagccacttggagagacaagaagtaaacctaatttcaacacaccatgctaaatgccaggatatgagtgagcactgcagaaagcagagactgggggagaagtggtctttacttccttcacctgtggtgggatccctcaaagacatgaggatttaaacacgccaagaaaagttgcaacaattaaatatgatattatacatatactgagtattattcatgtttatgacctagaaattcttcatgggagggctgaaaagggtgatattttaatttctggttaaatgggtgaactgtgtgtgaagcaaatgctctagagaactgacataaatttactcgatagtgatgatctaaacaagttctcaacaaatatgttgagatctgatgttaaaatttggggagggaccaggtagctcacgctgtaatcccagcactttgggaagtcgaggtgggtggatcgcctgaaatcaggagtttgagaccaacctgcccaacatggtgaaaac

SEQ ID NO: 2788 - DNA, 368 bp, Homo sapiens
  misc_feature (1)...(368): n = A,T,C or G
gtccagcatnanntccgtnngggctgtgggaggggacagcaggggcagaggcacactccncagacttacactcagtgtgggcagggggtagggtgggagcgaggtcactgcagctccancctgtgtctgtctgtccgcaggggggccctcagcctacttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtgggccgccttcgccaagcggctgngcccncctggg

SEQ ID NO: 2789 - DNA, 1313 bp, Homo sapiens
  misc_feature (1)...(1313): n = A,T,C or G
tgaaattcaatcatatcngtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccaaaaaaaaaaaaaaaaaaaaaaaaaaaaaaaaaaaaaaaaaaaagggggccgnaagctaanccc

SEQ ID NO: 2790 - DNA, 521 bp, Homo sapiens
cagctctcttgggctgtgtacccttcatcgtatcttccaggttccttaaaacctacccttgggcacagctgggatgtgcactggctcttcacagctagatccagcatgcactgactctccccgtgcagggacagccccagaggaatagaggtggcgttccggccgctccagcgtggcccacagcgtttcaagtgcagcaagcacagacaggacgcagggttactagtattttggattgactgcagattttgaactgtctgcctagatgaactataccatgtccctagggccaagtcccatgtgcattttgtggctactagaccctcttcagaaatcaaacacaaaatagctctggcctgtaaagaaaacaaacttcaccagtaaaattgtttcctgttcctatccaccaatggcatagcacagtgtgtagtctgggtaatacggtttgcataattttttgataatgttctatttaaaaagggcagcgtatttatatattacttatgtaattaaaaaaaaaa

SEQ ID NO: 2791 - DNA, 851 bp, Homo sapiens
  misc_feature (1)...(851): n = A,T,C or G
cnggcncgtccagtacttgctcttcctgcggctctacccggtnctcaccaaggcggccaccagtggattttgtcagcacttgggaacaanctggcccagatgattgagaagaagcggaaaaaagaaaacccctaaaactccggagttccggggccccttggaaaatgccgtttacgggtttctttcacagggcccgctggagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttcttcaaaaaaaaaaaaaaaaaaaaaaaaa

SEQ ID NO: 2792 - DNA, 509 bp, Homo sapiens
gctcagtaaatgcagtaatggatgggtggttggaccagctgaccaacaaacgggtaaacaaatgaactgggtgactgaggctggataactggccacggcctcccgctgaccgtggcctgttggactgttcttttcggcagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcactgccttcaggtggtgctgccccagaaacttaaaatttagtcgaggcagtttcaattgttactgtggaccgaattaggatcacaataaatgataatgcaggttcttcaaaa

SEQ ID NO: 2793 - DNA, 7209 bp, Homo sapiens
  misc_feature (1)...(7209): n = A,T,C or G
tcccaaagtgcgaaaccctcctctctaccaaccatgccaaaattaggtgtggtggcgcatacctgtagtcctacctacacagaaggctgaggtgggaggatcacctgatccgggacatccaggctgcagagtgagccgtgatcataccactgcatgacagagcgagatactgtttcaaaaaacnaagaaacaaagccaaatatttctactagtgcatgacaagggaaaaaaataccgcagggagttgttatgttaaaggttggtgtcaggaattggagcttcctagaaatactctttgaaaaaagtgctttttcaactatttaattttattttacccttnaacaaagcttattatatgaggtcacatgagtggtcaaattcatagagacagaaagtagaatggtggatgccaggggctggtgggagggagaaatggggaatcagtttttcatggggacagagtttgttttgcaagacgaaaagagctccagaaatggcttggtggtgatggctgatgcacaatactgaatgtacttcatgctacagaaatgtacacttaagaatggtaaattttatgtgtattttaccacaattttaagacaaaaccaaacgacgacacaaacaaagcccaaataggttaaataacttcctaatgttcctaaagtaggcaaatttggagactagctaagtccggttttgaccgctgagatgaatgggttatttttaagctggagcggtttgtgttccaccacacagttatacagcacaagcagaaacaggaagaagaacacattccccaggttttttttttttacttcctgtttgccaggcctctaacctgcaggcgtccttgacaaccttttatggttatataagcgatgacaaagcaagggcaaacccttcccaccacctctctgattccaccctttttcttgggggaagcaagtttgttgaccctcactcatgctctcagacagtttcatggggctggattaagtcacatacaaggtggtgaatttcagaagggggaactgaatccttagggggaggggaaaaacgaaggcggaggagcaggcgctgatccaaccccgccctccccagctgcagcccagcaccccggccctttgtgagctcagctcatcacacgctcccttccgcctgccaatcccgccctgttgctgggcctctgtcccttctccattggtgccagctctgaagcaatcttttctggggcgcctgcaaaggacggatctgtgggtggaacgaactgaaaacggatccagtgactcatcccgattcttgcacattctagcacatcgcattctaggtcagcagggtttaggttttaagagcgtgacttgatacctgactcctgagtccaagtgggacatttagactttgggaaccctttcggaaaacagaaaagcagttgttgcaacaacaaaaatcctttgtaggacagggtttcttaatttcagcactattaatatgttgggtctgataattctttgttgtgggggactgtccctcatagaatgttcagtggcatccctggtgtctaccaacagtgctagtattagtagtagcatcccctaacctcccctgagttgtgacaaccaagaatatctccagatattgccaaatgtcccctgaaagagcaaatcactccttgttgagaaccattgttgtagagaaacatcagacacctgcgttttgggaggccattttctcccctgtcacctcagtgactttggagaaaggtttatttctgtttgcttcaataaccatttaagtcagggaatgctgggatgttttcaataatttttttctgctagagacaacattggtttctctttgcagctaacctttggcccattacccaccctaccctcatcccctcttcttcctttttcctcctcctgtcctcctctcccgcccctgcctctgcagttagggctgttttttctctgtaccttttggactctgaaaaaagctatgtcacaaagctggtgactcagcctttaaacaacatgaatcacaaggcttgcagcagagtaacagccaaaagcaaccagggcgtggttgaaagccaggcctggtcacctcagaaagaatctcagctttttaatcccttcaaaactccttcccgaaatgtaggggaaaaacaaaaaacaaaaactttgcagaaatgtgtattggaaatcactggggtatcctgccaatcctggaaaatgacacttttattattcgttttaatttcccagtaacacatgaattcattctctttaaaatgttaaaaattggagatgtcaaagtctgttttgaacaatgcacagatcttggattttcataaatacacagaaacatgggttaccatagaaaatatatagcaggttcattttgctttgatgcatattttaagtctgccgtttaaataatgtaatgttcataacttaaaacaagaatgcagccttttcctaatggcaaaatatttttcagttggtagcctctttttctcttttttttgaagcttttaagggtagaaatcaaaatagcctccctacctccaatacatttgtagaaacagggactatttgtagaagagtccagaaggaacagtggctgggaaattgagggcatgagggagacttttcactgtacactttaaaaagacacatttaaaaaatctcaccatggtccgtatattttaaaacatttaaaaaatatactgaagaaatgacacgtagggatcacaaaataggttgtggtaaaaatttaaaaagctggctggtgatgcttttctcccaacttcttttaccaaaatagaattgccctgtagaattacatttcatatttgacaccctaccctgcactgaaataaggctgggattctattcctgtcttttaaaatctccggtttaaatgggtccgattattgaatggatcctgcttacaataatcgtacccattgaaaccagagaaatttccatgcctccctgttggcatcaagtaggacctttccatacctgnccctcagaatgtacaggaaggtggaagaacagtctagaaggatgtcgttcgctcagccttgcgttccagctaaaataaaactgtgtggggtttccgcctcttttttccaaatttaacctggtcacccagctcctctgcagtgtctcccctggaaagttctcgagcgttccccagctttagggccacggccgccctgagatctgccgagtcattgtccttgtcccgcggccccgggagccccccgcgaccggcctgggaggctcaggnaggttgaagggggctgagcaaaggaagccccgtcattacctcaaatgtgacccaaaaataaagacccgtccatctcgcagggtgggccagggcgggtcaggagggaggggagggtgaccccgactctgcagaaggtgctcgctgcgtgccccacgtccgccgaacgcggggttcggaacccgaggggaccgcgggggctgaggggaggggccgcggagccgcggctaaggaacgcgggccgcccacccgctccgggtgcagcggcctccgcgccgggttttggcgcctcccgcgggcgcccccctcctcacggcgagcgctgccacgtcagacgaagggcgcaggagcgttcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagttgcgggctgctgggctggccggggctttcgtggccgccgggccgctcggtgggacggaagcgtgtggagagaccgccaagggctgtagtctgggtccgcgagcaaggttgccctgaactgggggttggggggagcgcacaaaatggcggctgttcccgagtcttgaatggaagacgcttgtaaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcgggtttgtcgtctggttgcgggggcggcagttatgcggtgccgttgggcagtgcacccgtacctttgggagcgcgcgcctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtagttctgtgcgtccggggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaaaaaaaaagtgggtaacccgattccccantttcggccnttgttggttgntgncganttttcaatttttacttgggccgtnggttnttaaaanngttnganncnttggtganacncnntgnggggtacccaancnttanatnggctttncatngnaattcctnnattttggnaagttngtgtacnttatgggtngntggccttgtacatggtngnangtttcnnttanttttattgntngatagttttgggtttgtantnttngntngngtagattnttttnanaaattctn

SEQ ID NO: 2794 - DNA, 722 bp, Homo sapiens
gaactagtcattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttggtttgggtcgcggttcttgtttgtggatcgctgtgatcgtcacttgacaatgcagatcttcgtgaagactctgactggtaagaccatcaccctcgaggttggagcccgagtgacaccattcgagaatgtcaaggcaaagatccaagacaaggaaggcatccctcctgaccagcagaggttgatctttgccggaaaacagctggaagatgggcgcaccctgtctgactacaacatccagaaagagtccaccctgcacctggtgctccgtctcagaggtgggatgcagatcttcgtgaagaccctgactggtaagaccatcaaccctcgaggtggagcccagtgacaccatcgagaatgtcaaggcaaagatccaagacaaggaaggcatccctcctgaccagcagagggtgatctttgcctgggaaacagcttgggaagatgggcgcaccctgtctgacttacaacatcccagaaagaagtctaccctgcaacttgtggctccgcttagaagtgggatgagatcttcgtg

SEQ ID NO: 2795 - DNA, 2273 bp, Homo sapiens
  misc_feature (1)...(2273): n = A,T,C or G
tggggcggtgaacgcgantgattatataaggacgcgccgggtgtggcacagctagttccgtcgcagccgcgattttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataagggaaggcattcctcctgaccagcagaggttgatctttgccggagaaaacagctgggaagatggtcgtaccctgtctgactacaacatccagaaagagtccaccttgcacctggtcctccgtctcagaggtgggatgcagatcttcgtgaagaccctgactggtaagaccatcaccctcgaggtggagccgagtgacaccattgagaatgtcaaggcaaagatccaagacaaggaaggcatccctcctgaccagcagaggttgatctttgccggaaaacagctggaagatggccgcaccctgtctgactacaacatccagaaagagtccacccttgcacctggtgctccgtctcagaggtgggatgcagatcttcgtgaagaccctgactggtaagaccatcactctcgacgtggagccgagtgacaccattgagaatgtcaaggcaaagatccaagacaaggaaggcatccctcctgaccagcagaggttgatctttgctgggaaacagctgggaagaatggacgcaccctgtctgaactacaacatccagaaaagagtccaccctgcacctggtgctccgtcttagaggtgggatgcagatcttcgtgaagaccctgactggtaagaccatcactctcgaaggtggagccgagtgacaccattgagaatgtcaaggcaaagatccaagacaagggaaggcatccctcctgaccagcagaggttgatcttgctgggaaacagctggaagatggacgcaccctgtctgactacaacatccagaaagagtccaccctgcacctggtgctccgtccttagaggtgggatgcagatcttcgtgaagacccgactggtaagaccatcactctcgaagtggagccgagtgacaccattgagaatgtcaaggcaaagatccaagacaaggaaggcatccctcctgacccagcagagggttgatctttgctgggaaacagctggaaagattggacgcaccctgtctgactacaacatccagaaagagtccacctgcacctggtgctcccgtctcagaggtgggatgcagatcttcgtgaaagaccctgactggtaagaccatcaaccctcgaggtggagccccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaa

SEQ ID NO: 2796 - DNA, 404 bp, Homo sapiens
  misc_feature (1)...(404): n = A,T,C or G
tggggcggtgaacgcgantgattatataaggacgcgccgggtgtggcacagctagttccgtcgcagccgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctcgtctgactacaacatccatgaaagagtccacccttgcaccttggtcctgcccgtcttctaggacggtggggatgtctaaggtttcccctttttaaggtttcaanaaaatttcattg

SEQ ID NO: 2797 - DNA, 891 bp, Homo sapiens
  misc_feature (1)...(891): n = A,T,C or G
gcancgggantttgggtcgcggttcttgtttgtggatcgctgtgatcgtcacttgacaatgcagatcttcgtgaagactctgactgctggaagatgggcgcaccctgtctgactacaacatccagaaagagtctaccctgcacctggtnntccgtctcagaggtgggatgcagatcttcgtgaagacccatgacatggtaagaccgtctcccgtcgaggtggagcccagtgacaccatcgagaatgtcaaggcaaagatccaagctaaggaaggcattcctcctgaccagcagaggttgatctttgccggaaaacagctggaagatggtcgtaccctgtctgactacaacatccagaaagagtccaccttgcacctggtgctccgtctcagagggtgggatgcagatcttcgtgaagaccctcactggcaagaccatcaccctcgaggtcgagcccagtgacaccatcgagaacgtcaaggcaaagatccaagacaaggaaggcatccctcctgaccagcagaggttgatcttttgctgggaaacagctgggaaggtggacgcaccctgtcttgactncaacatccaggaaaggggtccacccntgcacctgggtgcttccgtntttaggagggtggggnttcaagatntttcgtgaaaggcccttgncttggtaaggccatnactttntgaangtggnagcccnagtgccaaccattttnngnattgnaaaggaaangntccaaggcaaggaangnattcctccttnccnagaagnggttnattttttncttgggaaccaccttgaangnttggccggcccttgntttgcttcaanaatccangaaggggtcacccttnaccttggnggtccggtttaangggtgggttn

SEQ ID NO: 2798 - DNA, 340 bp, Homo sapiens
  misc_feature (1)...(340): n = A,T,C or G
gaaggacccaatccaaccccctcngaagtggaagcccgaagctngaatngttaanaantcaagaaaggaagnatcctctgacanagaggttgatctttgctgggaacantggaagatggcgcacctgtctgctacaacatccagaaagagtccaccctgcacctggtntccgtcttagaggtgggatgcagatcttccgtgaagaccctgactggtaagaccatcactctccgaagtggagcccgagtgacaccattgacgaatgtcaaggcaaagatccaagacaacggaaggcatccctccctgaccaagcagaggttgatctttgctngggaaacaa

SEQ ID NO: 2799 - DNA, 2586 bp, Homo sapiens
cgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggctaattctgaatccctgatgacatcagctcccaagggctctgtgctgcaggaagcaaaactgtagggtcctgaggacaccgtgagccagccaggcctggccgctgggcttgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcttgaccacaggggctgtgggtcctgcgtccccttcctcgggtgagcctggcctgtcccgttcagccgttgggccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggaaaaaaaaaaaaaaaaaaaaaaaaaaaaaa

SEQ ID NO: 2800 - DNA, 621 bp, Homo sapiens
ctgcacgagcaccccgtcacggaatcccccatgaactgctctgtgacactgcagctgagcctctacatgaaatctgtcgcagcattggacaaactggcaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttttcctccagcctaaactgacatcatcctatggactgagccggccactctctggccgaagtggccgcagctgtgcccccgagctgcccccaccccctcacagggtccctcagattataggtgcccaggctgaggtgaatgagcctgggggccctgcttccgggcgctcctggaccctggggcaaacctgtgacccttttctactggaatagaaatgagttttatcatctttgaaaaataattcactcttgaagtaataaacgtttaaaaaacaaaaaaaaaaaaaaaaaa

SEQ ID NO: 2801 - DNA, 539 bp, Homo sapiens
  misc_feature (1)...(539): n = A,T,C or G
aggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaaggtcctgaggacaccgtgagccagccaggcctggncgctgggctgnaccggccccccagcccctacaccccgcttctcccggactctcccagcggacagccccccagccccacagcctgagcctcccagctgccatgtgcctgttgcacacctgcacacacggcctgggacacatnacacacatgcgtgcagggttgttgcagacaattcagggatgggagctgctggtgnaagggatttgttagggagagggttgttcaacaagcattgttctgggaactttttttncaagttggcccacaggttgaaccacaggggttgtgggtncttt

SEQ ID NO: 2802 - DNA, 492 bp, Homo sapiens
ggagccggagtcagagccggagccagagccaaaggccaggacagaaacgccgagaggaaccaagatgacccttgttggggcattgagaatatcatgagtgccacggggaaggggagtagggatgtcttttccccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgagaagcaggaatctccctgtatctagctcagacggccaggggcacggccgcccctggcgagggtcctgtctatagcaccattggtttccacgatttcaattggctgagaaggcagagagctagctcctccctttctttctttttccacctgagacttgtttataaaaaacaaaacaataaaaagagtctgatcagaaa

SEQ ID NO: 2803 - DNA, 485 bp, Homo sapiens
  misc_feature (1)...(485): n = A,T,C or G
cgccgacccggtntctggcagaagcggtgactggcctgcaccctaaccaggaggcacactccttgttcctggacatccacccggtcacganantccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctgggcgctgggctggcgtcctgctgctggtccctgttcatcttgccaaatccggagccaaggtccttgagggacaccgttgaggccagccagggctngggcgctgggcttgnaccgggccccccaggcccttacaacccgtttttttcccggatttttnccagngggacaagnccccccagcccc

SEQ ID NO: 2804 - DNA, 445 bp, Homo sapiens
ccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggaaaa

SEQ ID NO: 2805 - DNA, 513 bp, Homo sapiens
  misc_feature (1)...(513): n = A,T,C or G
gaggacaagatgacacataatagaggagcctgggctcaccgtacgangaactgggttaggagagagaaagcctgagcccctcccgggcctggttgccccgggcccgggttttacaaaacagcatctctctctctctccctaggaaccaagatgacccttgttggggcattgagaatatcatgagtgccacggggaaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagccccagggccctgtctgtctgggtccctgcagcaggttgggaagaaggggactgcagggtcctgtatatcaacgcacactggtagcttctgcttcccctnncatccgtcaaaagcactaagttaggccgagcacngatgcn

SEQ ID NO: 2806 - DNA, 557 bp, Homo sapiens
ctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagcccaaaaaaaaaaaaaaaaaaaaaa

SEQ ID NO: 2807 - DNA, 449 bp, Homo sapiens
  misc_feature (1)...(449): n = A,T,C or G
gggggtagttggagggcagctcagagcaaagggagtagtgcccgacaaatgcctaataggagaccctgacggagcacagctacagtgtggggtgnctggtcacgcaattnngaagngaaacacctctcccccaccttcctatggacagcagtccacagccactcttacatctcaccctcctgaccctccccagcccccaactgacatgccccatctccaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagccc

SEQ ID NO: 2808 - DNA, 620 bp, Homo sapiens
  misc_feature (1)...(620): n = A,T,C or G
aagntccttntattggnactccccgngcttttgacaccattatttaaggccnttccggtaattttgtnctcctaaccccaagnttgcttacccttttcctncccttnatcttttccaagactnacttttggtcaggttnccaggtggttnacaggaaagttctgcttcctgcntgcacttgctacccttccctcttgtgctgcagaagaggcctggctcccatacagcagaccaagcttcctgtcccgggccagggcaccagcacatgttccacggccggcagcaactcttccagggctccagcagctctaggggctcccggggccctggccggagccggagtcggagtcagagccggagccagaccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcag

SEQ ID NO: 2809 - DNA, 433 bp, Homo sapiens
  misc_feature (1)...(433): n = A,T,C or G
gcccgggagcccggtctctctgagaagcaggaatctccctgtatctagctcagacggccaggggcacgnccgcccctggcgagggtcctgtctatagcaccattgacccagcgggggaggagctgcagaccttccatgggggcttcccccaacatccctcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagag

SEQ ID NO: 2810 - DNA, 319 bp, Homo sapiens
  misc_feature (1)...(319): n = A,T,C or G
cagccactacacggcctcttttgcctacacaccggcagtgtccttcccgcactcagagggcctctntggagccagttccaggccacccatgggccttggcccgccccctactcatggctggcagattcgtggccccacccatctcgaagcccctcggcccaggaacccaggggaagctgctgccctagcaatcctgacccggacgacagatattacaacgaagcaggaatctccctgtatctagctcagacggccaggggcacggtcgnccctgggagggtcctgtctatagcaacattganccagcgggggaggagct

SEQ ID NO: 2811 - DNA, 266 bp, Homo sapiens
tgccatgtgcctgttgcacacctgcacacacgccctggcacacatacacacatgcgtgcaggcttgtgcagacactcagggatggagctgctgctgaagggacttgtagggagaggctagctgaagcccattggtttccacgatttcaattggctgagaaggcagagagctagctcctccctttctttctttttccacctgagacttgtttataaaaaacaaaacaataaaaagagtctggtccgaaaaaaaaaaaaaaaaaaaaa

SEQ ID NO: 2812 - DNA, 751 bp, Homo sapiens
  misc_feature (1)...(751): n = A,T,C or G
gtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttagggcagtctctgtggggcagagagtgggacttgcgaggtggacagctgtggggatccggggcaagggagtttcagaaggtgtgggctcaggggctgggtagaaacccccttttgttagggacttgttttttaaaaaagaaagcccnagggncaggggcgcagtngcctgatgccngtaatcccagcc

SEQ ID NO: 2813 - DNA, 1455 bp, Homo sapiens
  misc_feature (1)...(1455): n = A,T,C or G
ggcagcctgtgtgtncccagtataacangtacagggaggagagggtgatcctcttcctgaagatggcctccggcacgccttccagcctgaacctcaattcggaggaaccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtggggattctggccttcagagaccaggagggagtgtctgggccgcagtgttggcactgtggtgagagtgtgtgtctttgcacacacagtgcagcgggaacggtggggctggctggtgctgaagacagacacactcctgagccaaggccttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctggtgtcatggatgcaatgcaggccctgggaggactgtgcgtcacccgtcaaccagagcgtgcctccggccagcttccctccaaggaatgagtggatttcataaaggatctctttcattggcacagaattgaatggctttaacatgtttctaatgtgaattaggcatgtgaaggcagtgggtgtcccacccgtgtccctcatgggtgagccctcccagctgtgagccccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgaaaaaaaaaaaaaaaaaaaaaaaaaaaaaaa

SEQ ID NO: 2814 - DNA, 443 bp, Homo sapiens
gtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtatgtacaattcagttcagcgtatgaacttgtatctctaatctgatgtccatttttatattttttgaaactgagcccaatgaaatcctttcttgaatcattttccttttggattataaaaatatgggggaaagtgctatgatgaattttatgccaataattgtatacatgtgtgcacatgcccccatgctgaaaaaaaaaaa

SEQ ID NO: 2815 - DNA, 185 bp, Homo sapiens
cgcctactgcagaatcaaccccaagtccgggggcatcgtcatgcttttccggagtgactttccctcaaccccaactgttcggttcgtctgctcggaaatctataacattgtatactctcaacggcaagaaagtggaagtttccgtcaaacagatcatcgctggaaaagccgtggagcaaggaggt

SEQ ID NO: 2816 - DNA, 1973 bp, Homo sapiens
ggccttggggctttgtgagatagctagggtcgacttgtgtggattctagtagaacggagctgaccctctccccccccccccctcccccccccgctccacccctcccagaacaccactaaagaatgcctgttccacctccacaccccacctccaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttatacgacatcagatcattcacagtggagagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcgggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 2817 - DNA, 650 bp, Homo sapiens
  misc_feature (1)...(650): n = A,T,C or G
agcaacacaagtagactaaggcatcaagttttaccacttaagattaaggtgactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcangccttattcgacatcagancattcacagtggtgagaagccttatgagtgtaangaatgtgggaagtcctttagtt

SEQ ID NO: 2818 - DNA, 434 bp, Homo sapiens
tttttttttttttttatctattataaacgtttaatctctcccagaacacaaaaaagtgaatgtttgcttttatattttctttcagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagt

SEQ ID NO: 2819 - DNA, 1678 bp, Homo sapiens
aaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacccgggagagagaccctatgaatgtagtttgtgtgagagagccttttgtggaaaatcacagctgattatacatcagagaactcattcaactgagaagccctatgaatgcaatggatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacactggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaactaagttacaaatccttgttgatgaaaataatggaagggatgtggagcaataaatgtatcaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgaaatcttttccataagcagaactggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatgtcttttgctttttaaaaa

SEQ ID NO: 2820 - DNA, 503 bp, Homo sapiens
  misc_feature (1)...(503): n = A,T,C or G
tgagacagagccgtgctctgttgcccagactggagtgcagtggcanagtcntcggctcactgcaacctctgcctcccatgcagactcagacacccaccagagaccagagactcgaaggcctgtccatggtcacacagcagcaggaggcagggcgggtatctggacccacacctgcaggctccggaaatcttaggacttgcaacaaggttccaaaggacaacactcaggtttacagacgcagccacacagaggatgggcgcaggggcagggcgggctgaagagcgagaggggtgaggggaaggagggcataaaaggagaccactgaaagcagaagccaagcgagttcccgaacatgcgcgctcccagcagcaccgctcccggcagccaccagcccagacgcccatccacagaggcgcggaaaaacagcatgcagtccacccgcaccgtggaggcctgctcagctacaaaaaggaaagcagcactccacatgccacaccacggat

SEQ ID NO: 2821 - DNA, 928 bp, Homo sapiens
ctgactgagagatttgtgctgggagtggatatgttcgtggagacactgtggaaagtctggaccgacttcggcacgaggttctgtcccgcagtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtaaggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaaaaaaaaaaaaaaaaaaaaagagcgaac

SEQ ID NO: 2822 - DNA, 1347 bp, Homo sapiens
gcttggtacgaggggaacttgcctgtcaagacagttctttttgtaaacctaagaacctgagagcagggagattccagctgctaggagttaaataattcctttggcacttagcgtcctatcaaaacagagaagcaaaagaaaacaatgagagcaacaccaccacctcaaacaggtgccctgtgctgggccgtgtcctgagagtgcataggagagacatcgagacatccacaagataatgcccatttcacttgatcttcttcatgtctgggggaaaccaagacacaggaaggttaatgaatgacctgcctgagggtctcagatagtcatgagcagaatcccattcaagcctcaggagtttggctccggagtccaggccttccacggctgctgcacagcacagcttcctgtcagctcagaactctgacctccctgcaggtgctgggtgggggcagaggggacagcgaccctggtcctgcctgtagagcgtactggaggctgaatcataagtcagtgttggcagctccagactgaggaagcgccggccgggccatcttcacccgctggtattccctgggtgcgcagcagtagcagagggcaggaatgcaggaagtcgctttaccccaggctcttgagaaatacagtcatatttaacccctgaaaccactgcctgaggttctctgtcacctcattttgctgattagggcaatcggggcacagagacaatgagccacttacccgaggacacacagctcccaagtgccagggcatggccccaagggcaggaagtcagcctggtaacaccctctcaggtgctttgagaaaagtctaggggctggtgtgcttgtcaccatgtggctgggctaagagatgaggatctgggcttcctggtcaggggaacgtcatgaggagcctgtgccagtgctgtgtgcttggcgtgtgcgtgtcggcagctctgtggtggttcttcagggcaccctgatgggagtccctcgccttctctccacagcgccttgggtgtctcctcctggagcgaggcattgaacctcaggtgatgtcagccctggttcgtctcggcctcagaggagcccggctatttttcctgaacagccccccttcctccctgggagactttcggggtggccagcgtgcttgcttcccaggcaggctgaggtctacctccccgcaggcgtctggcctcaggcctgcagtggatgattgtgggctgtgtggcctttgcctttaggggtcgtcccttcctccataaaataatcctaacagttgtgttttgcgtctattgtggaataaagatgagtattacacagaaaaaaaaaaaaaaaaaaaagtctg

SEQ ID NO: 2823 - DNA, 2886 bp, Homo sapiens
  misc_feature (1)...(2886): n = A,T,C or G
cagccgatggggtgcgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcgacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgaccttcctgagcttgcagtggaacatgcttcgggtcctgcctgccggcctctttgcccacaccccatgcctggttggcctgtctctgacccataaccagctggagactgtcactgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggaggcatcttcgacaccaactacaacctgttcaacctggccctgcacggtaacccctggcagtgcgactgcacctggcctacctcttcaactggctgcagcagtacaccgatcggctcctgaacatccagacctactgcgctgccctgcctacctcaaaggccaggtggtgcacgccttgaatgagaagcagctggtgtccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcggcagggctccctgggactgcagtacaatgctagtcaggagtgggacctgaggcgagctgcggttctctgcggctcaccatgtctatcgaggctcgggcagcagggccctagtagcagccatacaggagctggggaagggggcctctggggctgaccaggcgacaggtaggggcgaggggagctgagtctccgaagccttgcttttcacatgcaagggacagggttacatccccaaggtgagggggtggagtctggtctgctccactaaccagggtctcctcctcctcttccttcatcgcttctcctggagtgtgcgcctaataaggccatccttatgccttgcaaagcaccctcaaaagctgcaccacagcctggagaataaaatatcctcagccctgatgcctccccattatgtaacacccaaccgctctcactgacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttctttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatccttaaccctgaacattccctttccattgatcccaggtcttcagctaagctcaaccaattgtcaaccagaaaatgtttaaatttacctacagcctggaagcactcacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcaacggccatggccactcatatttggctcagaataaatctcttcaaatattccaaaaaaaaaaaacaaaacnaa

SEQ ID NO: 2824 - DNA, 846 bp, Homo sapiens
aaaaaaaggatgtgacagaagcagagatgaccagaaagcacaggggcagggttctgactggcgtgtgggagaccctgtggccggcacccacctccacacgaggactaagctctgatctttctttcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttctttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttccctgcacaatcaacttggcctcacaatcctttatcttacgtgaacattcttgtcattgatctaggcttcagcaagctaacgattgtaacagaaatgttagattactcagctggagactaccgcgtgttcggtgctgcgtttgactacgatgatcgtatgaatgatggccgtccctaatgcaaacagcgcctgcactggaagtcagcctgggtgtacgcacgacaatgccggatcttagttcaaaaagaaacgtgtgttgggggttctggttcgcggttttgaagagcatttgaccttgggaaggcgccaattgggcgcgaggtgcggacggtcttcgtagggcaagagggcccagc

SEQ ID NO: 2825 - DNA, 645 bp, Homo sapiens
  misc_feature (1)...(645): n = A,T,C or G
tttgaccctgtatatcatgacttatttttaatctgactatggcataatattacaagacggaggcaaaaatatttaacccccaaatatatttccttggccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgaggagcttcccctgcacaataaaacttggcctccacggatcctttatctttaacctggaacattcctttccattggatcccgggtctttcagcttaggctcaaacccaatttgttcaaccaggaaaatgttttaaattttaccctacagcnggggaggcacttccacccccgctggtttcggagttgttcctggcctttttggaacttcaaccatgtatttcttaaatgtatttggntgatgnctcattcctcctaaatgtataanaccaggtgtacctggncactggggaactgttccgggncttctgaggttgtgttaaggggcatgggattnatattgggttaggntaaattttttt

SEQ ID NO: 2826 - DNA, 756 bp, Homo sapiens
cgcctagaagggccgagggagaagattccaccagcattgtccttgcttcaagttttagcatgtctgaactttcagctttcatgttttcaaccatcatttttttaatggcacaacatacatcttgtttttaaacgaagtagcctcaaattaagctcgttacactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacgaaaaaaaaaaaaaaaaaaaaaaaaaaaaaaa

SEQ ID NO: 2827 - DNA, 1172 bp, Homo sapiens
gcacgagccccatcaccacttctattcaatactgtactggaggtcagctaaataaatcagttaaaactaacaagcataagagctgcaaggaaaaaacggtcactatttattcacaattacatgattgggtacagagacaatccaacataagctacagagaatatcagaattaataactgattaggcaaggggtacaaggccaatatgcaaaaatcattgtatttctatataccaacaacaaacagagaaaatgacatttaaagtagatacggctgggcacggtggctcatgcctgaaatcccagcactttgggaggccgaggcaggtggatcacaaaagtcaagagttcaagaccagcctggccaatatggtgaaatcccatgtctactaaaaatacaaaaattagctgggcgtggtggtgggcacctgtagtctcagctactcaggaggccaaggcaggagaatcgcttgaacccgggaggcggaagttgcagtgagccgagactgtgccactgcactccagcctgtgtgacagagtgagactccgtctcaaaataaaaaaaaaaatagataaataaaaaataaagtacatacgacttgcattaacatcaaaacattgactacctaggaataaatacaacgaaagatgtgcgcgacccttcctcggaacccacagcacggcacagaccggcattaaaggcagcctgtgtcctggaggtaggggccattttcaagggattcaaagactcaacgttgttaacatagtaaccccccccaccatgatgtgtggactcctatttgtaatctctggcttgctcagatccatgtcccctgtaaagctttcaatatttatcattccagagcaatgaaactctcttctctatagctcccacgcccctaacgctgagttaatttaaaatcatgtcttttctcccaatgaggagatgcaaataccacggggaagcaaattgagacaaaaatccaggttctccagctgcttccactgagctcctttcactctcctgtgtgcctcagattcaaaaggaagcaaatgtgaggcagggagaatttggataaacaggtaaagaaagaaaaccgtttcttccgtgccatcccccacaaattccaatgtcacaaaagcaataaaacaaactagaaaaaaaaaaaaaaaa

SEQ ID NO: 2828 - DNA, 740 bp, Homo sapiens
  misc_feature (1)...(740): n = A,T,C or G
tcttcaagcccgggggtgcccttatgagggtctcccccatcttccgcnttcttccccaacgccaggaagtcatccngatgcacttcacggcggttccaagtaagttcactgggatagatgacggagggagggaaatgagagcccaggcaggctgagaccccccaagccacaggcaaacgttcaantcccgcgtggaanccatcaaccccaggggcccttcaacggtgcgtcccgtctgccccatccccctgctccccactgaaggggctctctcggttcaccagccctcacactagncagggcccatctgagatagttttgactccgggggacagcagaaggtgagtgggtcacatagtgtcccgccaaattcacgtccatccggaaccttagaatatgacctggtttggaaatagggttggctgggtgtggtggctcacacttgtaaccccagcactttgggaggccagggtgcgcagattgctagagcctgggaattctagacgagtctgggaattctagaccagcctgggcaacatggtgaaacactgtctctactgaaaatacagaaattagctgggtgtggtagcatgcacctgtagtcccagctactcaggaggctgaggttgggaggatcacctgagcctgggagttccaggctactgtgaaccgagattgcaccactgtactccagcctgggcgacaaagtgagaccctgtctcaaaaacaaaaacaaaaac

SEQ ID NO: 2829 - DNA, 541 bp, Homo sapiens
ctggtctcgaactcctgacttcaggtgatccacccgccttggtgtcccaaagtgccaagattgcagatgtgagccactgcacccggcctgcctaatcccatcttaactcatcttaactaacacatctgcaaagaccctctttccaagtaaggtcacgtcctgaggctcggggtggatgtgagtttggaggacgtcattcaatccaatgtggcagccactcccacagtcacgggcgggaccctgtttccttgccgaggtaaagggtgttctgcgtgtctgtcaggggaaccacttcctgtaactccatcgcctgcccggccctcagcattttactccgtcacccccatcacctgggaggcctccggtgactgttcccggaggcctgatccctcctgaagggacagaggctgcagctacctgggaggctgaggcaggaggaccacctgagccagaaggtcaaggctgcactgcaccatgatcgtgcactgcactccagcctgggcgacagagcaagaccttgtctaaaaaaaaaaaaaaaaaa

SEQ ID NO: 2830 - DNA, 4914 bp, Homo sapiens
  misc_feature (1)...(4914): n = A,T,C or G
gagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccacccttccagtccatcaacaagcgcctggcgtcgccagtggcctcctggggccttgactacgccgggaggctctgctcccggcccaggtggtgcacacccagcccccgccaacgggcaagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttgccgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggacccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagaacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtgggcgtcacgcaggcgacggcggcccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcagcccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaaattgaaaaaaaagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagtttgccggagggagggccgctgtgtgcgctcacatctggctccagtggaacttttctcctcctcatccgcagatgtgatagaactgaagtatctaggaattctgcctttgtcatttgtttaattgtgtnctgtcatttttttgnttccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatataaaaaaaaaaaaaaaaaaaaaaaaaaaaaaaaa

SEQ ID NO: 2831 - DNA, 500 bp, Homo sapiens
  misc_feature (1)...(500): n = A,T,C or G
acgggaanctgtgcccaggcccctcccccctggaaccggggtccaacccccaancggcnaagtaaaagtgggaaaccttgaagaacccccagncctataaaggccagcaagccccgaacactgtccagaccccnaattgncgacccccgggaaacagttgccccgcctatcctttaaagaaagacgtttattcctgatgataaaaacagttagcccagactgtttttaaagcccccggcgggaagcagaaggttggancccaagcccttgttcagatttggtgccctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatataa

SEQ ID NO: 2832 - DNA, 424 bp, Homo sapiens
gcaagtaagagttggaaactttgagaacacagactataaagcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattgcaaccaacttaaccagtttcaatagcaaaacacaggaaataaaggcttacttctt

SEQ ID NO: 2833 - DNA, 867 bp, Homo sapiens
cacaattcggcacgagaccgtctgtggaggagaatctgaactgaggaggaagccctgcccagcagcctgggggctcccagggatgtctgctgcatggagactgcagaaacctgtggtggggcagagagttccagtttggccgtgtgttgactgccctcatgcagactctaccagcggccaaagcggtgtctggagacgacagtgtgtgtgcctagggcacacaggcacggagacaccgccagccctttgtgttgtgatcagggctggcgggaggctctgactagggctgtgggaaggggacgtgtgcactgtcctctttctgagcgttgctgtggtgggagtcctgtcacggggagcagtcatggaagaggaccggcccctcctcccaggtacaagcacaggctcctgtgcactccgactcgctgttcccctcatctggcctccccagagcccaggcactgcctgctaaccccagaccttctgtggtccacttaggactcttgcccaccattggtcctgccggccggcccgcccaggctgggctttctcagggggactccagctgcccttctgccccatgaggagacactagctcccttggcctcattcccttactggcaactgagggtctggttcttagagtcccttatgtgtaaacatgtaaagcttgtggctgtgaggtgtgtttggtaagaacagtccacagctttcaccagattctcaggagtgtcagtggccccttcccggtcaataagttgaagagccggggtcagtctggctgccactgagggccaggctgcctccttgtgtgcttgggtggcctgactgcaaggaaaaaaaaaaaaaaaaaaagatctttaagtaagc

SEQ ID NO: 2834 - DNA, 1132 bp, Homo sapiens
gttccagaggtctatggtgtgacgtagcactcccactagaccccccgccccccccccctccccgcgatgctcccaaccccccgcccccccgatccacccacctcagtctcccaaagtcccccgaccaccgacccgaggccacccccgcccgcccgcactacccgcactcacccaccagccgacctcccccgagcagcggaaaatgatccagtcacaggacctaagtgtgaaacaggctacctcatcatggaccccaataggtcagactttgacgggccgtgacaataaccaggtaaatcgtctgaggcaacagcagaccatggctatgacgccactccaagcaggatggtcgggcccggaggactgaacatggcctcagcagtcacctcggcagttgccatgccaggaaagacgccccacagcccactggagagacagaagaatctgtgtgaatcttctttacctggcctgaggatcaattcaggcacagcagaacactggccaggaaactgaacgtgacctgaatgtcttccaggctgagacaggtcctgagtgcaatcccagagggcacacgtggtcccctagaaacaacgaattcacaaggtcaggtgccccagccgggcacgcacgcctcaggttgtgaggttaacagggatccaaggtggcttcccatcgtcgggcctctgtccagtctggatcattgggtttaggccttgacttcagagggcctgcctgggactgagttccaaaccattctgtttatccatgacatgagtttgttagtcccaccttatcaagtgtggacagtctctggaggagttctgcacagagcccaggagccaaggcagtcctctgcctctcctcgtcagcaccgtgaggaagccgaggtgtgggctcagcagacggtccaagtccacagccgccacagtccatggaaaggcagcaagaggacctcttgtgtttggttttttaggaggaggagaaagcttttaggagcaggtctgaaaaataaagatcattattattttttccctttccctgagcctcccagatgccagttttgttttgtttttctgttacctgtgtgtcccatgtagtaatcaaaacttaagaacaaaaaaaaaaaaaaaaa

SEQ ID NO: 2835 - DNA, 470 bp, Homo sapiens
  misc_feature (1)...(470): n = A,T,C or G
gtatttttagtagagacggggtttcgctgtgttggccgggatggtctcaatttcctgaccttgggatccacccacctcagtctcccaaagtgcggggattacagacgtgagccacccgtgcccggccgcactacaggtatttaaccaggagctgaactccttgactccactccttgattttttaggacctaagtgtgaaacacggctacctcatcatggaccccaataggtcagactttgacgggccgtgacaataaccaggtaaatcgtctgaggcaacagcagaccatggctatgacgccactccaagcaggatggtcgggcccggaggactngaacatggcctcagcagtcacctcggcagttgccatgccaggaaagacgccccacagcccactggagagacagaagaatctgtgtgaatcttctttacctggcctgagnatcaattcaggcacagcagaacaant

SEQ ID NO: 2836 - DNA, 436 bp, Homo sapiens
gttccagaggtctatggtgtgacgtaggaatggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacaggacctaagtgtgaaacaggctacctcatcatggaccccgataggtcagactttgacgggccgtgacaataaccaggtaaatcgtctgaggcaacagcagaccatggctatgacgccactccaagcaggatggtcgggcccggaggactgaacatggcctccagcagtcacctcggcagttgcatgccaggaaagacgccccacagcccactggagagacagaagaat

SEQ ID NO: 2837 - DNA, 7881 bp, Homo sapiens
cgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccaggaggcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccagggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttcaaaaaaaaaaaaaaaaaaaaaaaaaaaaaaaaaaaaaaa

SEQ ID NO: 2838 - DNA, 6794 bp, Homo sapiens
agccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctgtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgcaagcaagctaggctatgatcccgtggagctagacccggagacatgtgccggatcgacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaacgccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtgcctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcacagaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcacgtgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccc

SEQ ID NO: 2839 - DNA, 2892 bp, Homo sapiens
ggacccgctcccctggccctgtcttcacccgtgccccgcagacccgctcccctggccctgtcttcacccgcgccccgcagacccgctcccctcgccctgtcttcacccgcgcccccaagacccgctcccctcgccctgtcttcacccgcgccccgcagacccgctcccctcgccctgtcttcacccgcgccccgcagacccgctcccctcgccctgtcttcacccgcgcctgcggacccgctccccttgccgtggcttccccgggcgcgcggggcccctgttgggtccttgggtggaacctcagcgccgacccccgggtctgggcgggccctccacgcgctgggagggcgggatccgcaaggcgcctcacaatcgctgactgcggacgcgggtgtcgccgcgggaagttcagcgccgggtcggagggcgcccgctccgggggttctgacccgggcgcgcccccagcctggtcccggcccggcgctcccgtccaggccccgcgccgctgcggccgacctggggccggggcggcgtccgattcccgcgcccccgctcacctggtggccgccttggtgagcaccgggtagagccgcagaagagcaggtactgggcgagcgcccgccgcggcagcccccgagcccggcttcggcccgcagcctggacgcggccggcgccatcgcctccccagcgccgtgccgccgggggcaccgaccccacctcaggctggccgggcgcggagcccgaggcgccgagagcggagtgggaccgcctgacatttccggccccaccgcggcccgcagcgccgcccggtcccaaccccacggtgcgccgcgcgcgcctaccacacacttttccccggtccctgccggccacctcccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcaggtgaggggcgccctcctgaggctctcgggccggccctccggagggtgccatggggccgtcctcggctggcgccgccgaggcgggagggaggcccgggtcccgcagccgcccgcactcgccgcgcctgactggggtagggcggcgcgccccgaccgccgacggaggggctcggggcgggcggaggcgctacgggcgcggcttctttgcggggaaacgaggcgggccgcgcggcctttccctgctcggctctttctgaggtttttcgggcctcgccttccgcgcagctgcgtttgggacctgccgcgcggcggggcgatgagagcggcgggacccggccaggccctgcggggtggacgcgcggctggggagggtgcgggaaggggcggggccggggaccctgcctgggggcctagcgctgggggaggccgaggcgggcggatcgctggagcccaggatccggatcctgttctagatcagcctgggctacagagagagacctcgtctcctctgttttatttttttgggcagggagtcccgctctgtcgcccaggctggagtgcagtggcgcgatctcggctcactgcaacctctgcttcccgggttcaagcgatcccgctgcctcagcctcccgagtagctggaattacaggcgcccgccaccaggcccggctagtttttgtatttttagtagagaccgggtttcaccatgttggccaggctggtctcgaactctgacctcaggtgatccgcccgcccgcctcggccttccaaagtgctgggattacagacgtgagactccgcgcccggcccttctcttgtaaaaacaagaaaaattagacaggctggtggtgcgcgcccgaggtcccagctattaatactcccgaatccgagccggaggttcacctgagcccggcaggtcaaggctgctgtgagccgggatcgcgccaccgcactccagcctgggcgacggagccagacccagtctcaaaaaaaatagagcaaggataagacgcggctgcttggtggccagagcaaacggtaaacatgaccggaggactggcctgccataagcacaaaacggatgaggcccggcgcggtggctcacacctgtaatcccagcactttgggaggtgaggcaggaggtcacctgaggtcaggagttcgagaccagcctgaccaacatggagaaatcccgtctccactaaaaaaatacaaaattagcggggcgtggtggcgcatgcctgtaatcccagctacgcaggaggctgaggcaggagaatcacttgaacgcggcaggcggaggttgcggtgaaccgagatcgcgccattgcactccaggctgggcaacaaagaatgaaactctgtctcaaaaaaaaaaaaatagaaaaaacgtgtgagaacgtgaagctttttacagacacttagctgaacaaaattcttcccagaggagaaaccaagtggtaaggatccctaactgctgttgtgctcatcgctgtctgtccatatcaggcaagccctagagaggcaggtacccttagggtctacatggtgtgttggaacttggagcttagagacggttactgactgccctgcttcaggacacaggactactcacgtgctccactccactgccctgccccaagctcagtgatggcctccaggcagggggaaggctgctgctgggataagtacaagtgatggcttttaccttacatgctttatgtgggttacctcatctcatccttaaaacagtcctgggaggtgagtgtgccccaggaggcagtgggtgctgtttgcctg

SEQ ID NO: 2840 - DNA, 2269 bp, Homo sapiens
tcgaggatccgcccgcctcggcctcccacggtgctggatttaattttttgtatttttagtagagacaggtttctccatgctggccaggctggtctcaaactcctgacctcaggtgatccacccgccttggcctcccaaacttttggatttacaggcgtgagccactgtgcctggcctgacaaccgtctgtttttatttcaaatcatgtcagtgttacatgcactctcagtagccaccgcgtctggctagttttatgcatttttagtgtcccaagaggcaacagtgtctagccatcatgcatctttttgttcatattctggttataaagttgaacaggttttgaagggcctgccctaattgtgtttttccaatgagtccttttatcttaatgagcctttttccaagctcggggtttttcaggaatatatataccctgtcatatccgaaacacttaacactaggtggatgagggttgcagaagtaggtggcagtcggatcacaaggtcaggagatcgagaccatcctggctaacacggtgaaaccccgtctctactaaaaatacaaaaaattagccaggcgtggtgctgtcgcctgtggtcccagctactcgggaggctgaggcaggagaatggcgtgaacccgggaggcggagcttgcagtgagccgagatcacaccactgcactccagcctaggcgacaggcaagactccgtctcaaaaaaaaagaaaaaaaagaaaaaaagaagcagcagcaggtggcattacaaattaagcacggggttcccttatctttcactcagggatgatggcgccacttcctcagtttcggcactcaagcgcctggaacggagtcagtggacggataagatggatttgcggtttggttttgagcggctgaaggagcctggtgagaagacaggctggctcattaacatgcatcctgtaagcactaggtccttctcccacccaggaagatggctgcaacccttctggtcatagcgtggtccttatctaaagagtgggggacacatgagggaactttgagtgaatcaggtgggagatgtgaaggttcccagctctcctttcctctttaacgtcattgagggccacagagaggccactgtgagaagccggaggtgatgggcatctcttttagccatcagaataaagctttcaaggattatgagggagaaattgagagagatccccatttggaggccgttacagtgtggttcttgtgaataaggctggtagtgttaatgtaggggtggagtaaagacctagatgagagggtttgtttctaaagtgctgagtttcccgaaggtaggaggaaagtttcgtcaatgtgtagaggatggtcttgtgtctgtgttgcatgattctcttgtagaccgagattttagatgaagataagcgcttaggcagtgcagtggattactactttattcaagatgacggaagcagatttaaggtaagcccctgactgcgacaagctaaaacccacttttatgggtgttcatgtagctctgtgactgtcagggagggcatgggaggcttccagtgcacagcagcccatagcccagcagaactcgggcccctggaggccccatcagtcatcacgtaagatgtcctgagagaggtcagttcaggaagactctgaatggtgagaagtagcgtgtctttcagattcttgcccctgtgaaaagtgcgcattctgacttcctgtatgctaccaaggtcaaggctaccctggccctaggctgttcatgggatataggagcaagcaatgtgttttcacttttctctcgctttcttctttctcatcacccctggatgggttggtgactcttaacaggtggctttgccctataaaccgtatttctacattgcgaccagaaaggtgagtgtgtttcatagactcaggtcagacgacctgtgtgtcattctgtggtgggctttgcaactgggaaataggcaaggaaggaaatgtattttaccaatggaaagccttttcattctgatcctgattagggttgtgagcgagaagtttcatcttttctctccaagaagtttcagggcaaaattgcaaaagtggagactgtccccaaagaggatctggacttggtgagtatcaccagactttccagggtaaatgaggccagagtctacattgttcctggcaggtgggatcgaagaggtagaaattcaggtcatctgttgggtgatggggcggtgtggtgaccgtctataaaattccttccaaagagctc

SEQ ID NO: 2841 - DNA, 1604 bp, Homo sapiens
ggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctgaaggaggcagacactcccaagtgtgaagagaaggaaaggaggaagagggagttgcgcagctcggccacaggaaggtcttgccgaggggcatctgagcagaggctgggggacgcgccaagctgccgtgtggtggtgcacggcgttcaggcctgcaggatggagggagtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttcaaaaa

SEQ ID NO: 2842 - DNA, 1356 bp, Homo sapiens
gcaggcaggtctggccagcgcgggagggctggcgcccatcggggctgctccctttcaggtctgcctgaagtgccgcggggtgaaggagaccagcatgcctgtgtactgcacgtgcgcgggagacttcgccctcaccatccacacccaggtgggctctccctcatctgcctcggctcagcctggcctccttggcctcctctctgagtggactggggtctcactgtgcctgtttattcctgcaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccaggaggcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgctcccagagggaggaaaagcccctgggggcttctggctccctgagattgggctctgagacgagacggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctctaggttgtcactgtgtatttgtgcagagcgcctcagatcggggactgggtaccactgggcacg

SEQ ID NO: 2843 - DNA, 917 bp, Homo sapiens
agtggtggagtctgccccagggctgcccccacttcctcctgcgcagggggaggctgacgtggcctgcgttggtctaggtgcgcacagaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggtgagagtggttggggtcttgctgtgtgagccccatcttctttgaggctgggtccacccaggtcttttcttccattttgccttgacccaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtgagcacagtactgtcgttgtgggccagtggtccccagcagagccggcctcggtggtctctgtgacccggcgtgtgccccggtgctgacctgtgccctggtgcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacaggtaagtgggcgggaggacgagg

SEQ ID NO: 2844 - DNA, 737 bp, Homo sapiens
ggtcccctcagattctagggtgtttgcagcagcccgactcagggcctgtggtgtgtgtgcctctccacagcgtacatcgtggccgtgtaccactgcatgaaggacgggctgaggcgcagtgctccagggagcacccccgtgaggaggaggggggccagccagctctcccaggaggccgagggggcggtcggagcccttcccggtgagcagtcttttgtcttttgaggccactgccatgtgccagtgacctaactcctctgtgtgccatgggtggtccccggtgccagtcccccaggtgggaggtccccagtgccagacaggtcccagacccctccctcagcatccttatacttccaggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgagagtgccagcgtgcgtgtgaggagaggacactaacgtacatgtgtaaggcgagaatgttactgtgtgcaaggtgaggctgtaatgcgtgcaccatgaacgtgctagcgtatgtgtgcaagataaggacaccgacatacctgtgcatggtaaggatgttaatgatgcaggatgaggcttcagc

SEQ ID NO: 2845 - DNA, 678 bp, Homo sapiens
aaaaggggttggtgaactgcacacgaggcaagcttggtcaccagcctctactgagtttcgctttctctgcaggtgtgtgatgagattaagagcaagcttgcctccctgaaggacgttcccagccgcatcgagtgtccactcatctaccacctggacgtgggggccatgtaccccaacatcatcctgaccaaccgcctgcaggtgagactttacttcccgtgtcagagtcggagctctctctgcccagccctaagtgctttctcacccctcccagccctctgccatggtggacgaagccacctgtgctgcctgtgacttcaataagcctggagcaaactgccagcggaagatggcctggcagtggaggggcgagttcagtgagtgtcggccgcctgggctgggcactcggtgggaaacgggtgggtgagtgtcggccgcctttctccactcggtggaagccggtgtgtctgtgcctccttttgaacttgcccccattgcctccttcccagtgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcgggtgagtgcctgggcatggtcac

SEQ ID NO: 2846 - DNA, 585 bp, Homo sapiens
tctcacctcctcagacctggcagctgagttagttgctctcttgttaattcctagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggtgagtggggcagggttgggtcgctgctcacatgaatttcctaacagccaggagatgatcattatgggtgaatccacagaagaatagactttcctggatgtagaactctagttagcacactgtgtgttttgcaggctcattggtacaatgtcagataccgaggaaatgcttttccggtagaaatcacccgccgagatgaccttgttgaacgacctgtaagttttgcttgtgttaccttcatcctaaaatttccagttttctggagagaatattcttcagtgctggagagtgaatctgactcaaagatatgtttgctgcttttcccccaaatactttattaaaggaaatatggagttagaatttttcatcagtttctgacagtatcattt

SEQ ID NO: 2847 - DNA, 575 bp, Homo sapiens
ttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcactgaagaagcaggccgaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgttttcata

SEQ ID NO: 2848 - DNA, 514 bp, Homo sapiens
  misc_feature (1)...(514): n = A,T,C or G
gaggttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggcctttcaccctgcaggacctggtctgcctgaagtgccgcggggtgaaggagaccaagcatgcctgtgtaattgnagctgcgcgggaagactttcgnccttaacaatccaaaaccaagttctttaatggnaaaaaattggggaattntttccggaaaatttggcaaagaattaaggggaaatt

SEQ ID NO: 2849 - DNA, 500 bp, Homo sapiens
gctaggctatgatcccgtggagctagacccggagacatgtgccggatgcacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatggtgtgcttcttccctgggattcagattcttcccactcttgtgctgtgaatcctgccgcctttgacttcctgctgcagcgggttgagaagaccttgcgccacgcccttga

SEQ ID NO: 2850 - DNA, 480 bp, Homo sapiens
agagcccccaccatccagcccttgccgcctgtctgcccgattcttccaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccaggtatggcctgcaccagccgcccatcatcatgtgcctgcctcccacacatctggggtgacggtcttgtttccttctccagggagtatccgccatatctacctgtaccaccacgcacaggcccacaaagcgctcttcgggatcttcatcccctcacagcgcagggcatccgtctttgtgctggacactgtgagtcctgggccctccatggcagcacattggctggggcagggtttggggaaggaggacatctcccaggtgcccaggccctccaggtctt

SEQ ID NO: 2851 - DNA, 442 bp, Homo sapiens
tcacgagcacttctgtgtgccaggcgcttcccacaaagcactttgtactgggagccaccctgggggattcacgcaggcgtaccaggggatgccttgactgcgaggaaggcctctggtcaaacggggcagatggacccaggttggaggagccttcgctgtggcatcctacccctctaccaggccgcgatggtgcaaacacagccgcgttgtctcatgtgttacagcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcaggtaagcccagagcccagggctgcgc

SEQ ID NO: 2852 - DNA, 432 bp, Homo sapiens
ggatgtccttgggaatctctggccctggtgtgagaagaaaccacaggaggcagaatttgcagccatttaccacgaggttttctctcctttcacactgaagttcagcttaggttcctggactttgcctgcaagtcagggcctttggtgttgcttttggctggaagccttggtttctcttgcaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatggtgtgcttcttccctgggattcagattcttcccactc

SEQ ID NO: 2853 - DNA, 353 bp, Homo sapiens
ccagcagggctgtgtctccgggacacacgtgttttgtcctgtgccggtctccttactgtgtgtgcggcaggctggtcaggccaggctttgctttcttggcttcacacttgaccctgggctcttgatttttgatggccctgctctctggcgttctctcctcagactctggccacgtattctgtgtcagatgctgtcgccacttactacctgtacatgaagtacgtccacccattcatctttgctctgtgcaccattattcccatggagcccgacgaggtgagcattatctgtcctgtcggcaccctggcctcctcagcccttgccccattccaaatgcactggagctgaatgga

SEQ ID NO: 2854 - DNA, 370 bp, Homo sapiens
ccagctctagagcctttgactctttaacaaccagagggaggtagagcaggctgggggtgggtgttcagggaggcctaatggggagtttagagcttggctttatgcttattttgtcccacaggaccctgtggttttggcatttgacattgagacgaccaaactgcccctcaagtttcctgatgctgagacagaccagattatgatgatttcctacatgatcgatggccaggtgagcaggtggcttctgggaagtaagctcctgggatggggaccttgtctggtccccatactacagcagcatctgccccactgttagtattttgttgagtgaataatgagttagtccaggaatgggagcaaccaagccgtt

SEQ ID NO: 2855 - DNA, 359 bp, Homo sapiens
ccctgcgcagcccgagatcctgagatttggcttcactgggtctttccaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggtaaggcacacagctgtgatactgtctgtctctgaggggtctgcacagcccaggagcccgagatgtgtcctacccctaggaggctgcttgtgagaaa

SEQ ID NO: 2856 - DNA, 330 bp, Homo sapiens
gaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgtaagttttgcttgtgttaccttcatcctaaaatttccagttttctggagagaatattcttcagtgctggagagtgaatctgactcaaagatatgtttgctgcttttcccccaaatactttattaaaggaaatatggagtt

SEQ ID NO: 2857 - DNA, 290 bp, Homo sapiens
cccagggggctggtggtgctggagctggcaggatgctggctgagcatggcgtcttcctgtgcagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggtgccaccctctctgggaagg

SEQ ID NO: 2858 - DNA, 287 bp, Homo sapiens
gggcacaacctgccacgtgcagccacagcgtcaaacctgaggcaggctagtgtgggtgtgtttcccctctgaccccgtcgtctcactgttgtgctagaatcctgccgcctttgacttcctgctgcagcgggttgagaagaccttgcgccacgcccttgaggaagaggagaaagtgcctgtggagcaagtcaccaactttgaagaggtaaccatcagggaggcaggaagagccagtctgtgtttggcgccttccttcacagaccacgtctttcagcagcacgtttatt

SEQ ID NO: 2859 - DNA, 350 bp, Homo sapiens
atgatgtgatctgaatgaactttcaaattcagtgttaagtaagtggagggtacggatagatacaaggggaaataaaggaaagttgagaacaaggtcgatttcactgaagcagcgtcttcaatgcttcctctgcagcatccattcaaaggagaccttccattctctgacaatttctttctctcgatgctgggaatttcttctctggatggatccatctaactatggcggaatcaaaggaaaagtttcatctcgtattcactgtggactggtaagcgagctgcagtgtggcacccgagccagctttgggggtcgcgttcattcctgcagcaagtgctgagtgctcagggccc

SEQ ID NO: 2860 - DNA, 297 bp, Homo sapiens
tcttggattttctgggtgccctctggctctccacgactgtggcgtctccaccacggactctcaacttgctccacaggctcatcgctgagttcaagcgcctggggtcatcagtcatctacgccaacttcaaccgcatcatcctctgtacaaagaagcgccgtgtggaagatgccatcgcttacgtggagtacatcaccagcaggtgcggctggctggtcctggtgacgcagcactgtggctttgagagggatgctaaaatgaccccctgaggtgccagctgtccttctgggtgggctg

SEQ ID NO: 2861 - DNA, 339 bp, Homo sapiens
aacgccatttcttgctttgcagcctctgacttgtgctgattgctaatgaacttggctagggctacctcatcaccaacagggagattgtttcagaagatattgaagattttgagttcacccccaagccagaatatgaaggccccttttgtgtcttcaatgaacccgatgaggtaaggaggtatcacttgggaaactacccggtattgtgggaagaacggacatgtggatctttccaaggcctcaggcattccgtcagatcagaattgcagctccatgagctttgttctcagggtgtgaccgtcttttctgccagagacgggcgagggcgggcaggatagg

SEQ ID NO: 2862 - DNA, 294 bp, Homo sapiens
ccttgccactgctgtgcttgccttttttttttttttcaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggtaaaggcctaccctccaccctcacctgctctgagggatgaaggatgaagcaagaaggg

SEQ ID NO: 2863 - DNA, 274 bp, Homo sapiens
atgagtgaagctgccccctcttcactcttgtttctcaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtgggactctcatagcttttgtgctttagaaaggacgtggattgagatagattaaatttagcccagaaaggaggttgg

SEQ ID NO: 2864 - DNA, 255 bp, Homo sapiens
gtctcgccctatcgcctgcgttcagattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgagctctgaggggctgcaagctttggcctctgtgaggcagtttcagtcggctcatgaagcgggcactcttggctccttgcct

SEQ ID NO: 2865 - DNA, 245 bp, Homo sapiens
tgataccccctggaggagccatgccagccccacccaccagtttgtggtgtcctctcagggctcgctggtactccatggagatggctggcatcgtctgcttcacaggggccaacatcatcacccaggcacgggagctgatcgagcagattgggtgagtgcagaaggggagccgtggggctgggagcaggtcctgggggcaagcatgggcaggaaggaaggagggaaggctggaggcacacactggg

SEQ ID NO: 2866 - DNA, 248 bp, Homo sapiens
tccatgttcatgtgcttctcaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaaggggtaggtgggcccgggccgggagaggcttatgggaggaatggatgagtccacgtttagggcagcttcaggtgtaggct

SEQ ID NO: 2867 - DNA, 247 bp, Homo sapiens
ccccgtctgtgggttccagtgtgtcctgtgatgtgctgtatgtccgtgtggcctttcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtagggaggagctggtgctgcctctgcagtcatctgggcagcct

SEQ ID NO: 2868 - DNA, 244 bp, Homo sapiens
ttaccacttacgcccagtgacagatcatcgtcgtatctcgccaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggtgactccccagccaccctcgactgaactgggggaggctccagcagggtggtatggagg

SEQ ID NO: 2869 - DNA, 249 bp, Homo sapiens
acttgcttgtctgtcctctttccaacccaggccatttgtggaggcccgggcagcagtccacggtctgagcatgcagcaggagataggcttccagaaggacagccagggggagtacaaggcgccccagtgcatccacatggactgcctcaggtaggggccacagagcagcatggctcctcactgctgtccgtgagcgagatctgaaggcctcttgcagactgtgctgtcaccacatctcatgggaggagg

SEQ ID NO: 2870 - DNA, 234 bp, Homo sapiens
acaagggtctctctctgatgggtgttggcctcacacaggtaaagaacccagtgccacgtgtcaaacaccccgactggctgcacaaaaaactgctggagaagaatgatgtctacaagcagaagaagatcagtgagctcttcaccctggagggcaggagacaggtgacggtggggccccgaggctgggctgggcgggatccttgtgacacacaggactccaggcttcttgcgctgc

SEQ ID NO: 2871 - DNA, 221 bp, Homo sapiens
ccagaccgtctgactgctgtgacttgggttcaggctcatctgatccaaaggtggtttgaacacgtccaggagaccaaacccaccatcatggtcacctacaacggggacttttttgactggtgagtctgtgtcttctctatgagtaactgggcagcatttgagagggagggcgttgcgtggtgcaggggcgcttcccatgtcgacttaggaggtggctcctg

SEQ ID NO: 2872 - DNA, 203 bp, Homo sapiens
tgcccatggcactgtggtctggaggctgggctggtgacctctcgcactcttgctctgcctaggatggggcggtcctgcctcagtggctctgctccaactgtcaggcgccctacgactcctctgccatcgagatgacgctggtggaagttctacagaagaagctgatggccttcaccctgcaggacctggtgagtcgtgcatgc

SEQ ID NO: 2873 - DNA, 204 bp, Homo sapiens
aataagacacagtggttagccctgtgctcagcatgaagtgagccccactcttggctgctgccacctgctgttctctgtgcccgtttcctgcacatgcagattctggattgggactactacattgagcggctgggaagcgccatccagaagatcatcaccatccctgcggccctgcagcaggtaagggcggggtcagtggcacgg

SEQ ID NO: 2874 - DNA, 174 bp, Homo sapiens
catcagattttgggtgattttcactgttactgagctgtgtgcctgtcttccttacccagggccatcccacttgccattttccaagcagagcccacggtgaggaagcactttctccggaaatggctcaagagctcttcccttcaagactttgatattcgagcagtgagtgccagt

SEQ ID NO: 2875 - DNA, 4395 bp, Homo sapiens
  misc_feature (1)...(4395): n = A,T,C or G
tcaggtgaatcgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatggcatgtttcctgccaaagagaacccaggcttcccatctgccgagctgactctggacgtccccggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcattgagcttggggtatccctggggtttgaattacttgggaatttctngggctgttttgtttgatctgtctttcccagggaaggccttgcaaagattagaaggattttttcacacagcagggaatagggcaaaaagggttcaaccaggaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccatggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccccccccccccctcccctcgccctcaccaccgacccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgaaaaaaaaaaaaaaaaaaaaatcctgatttcccaggtcttaggccacctttgactgtttctccgtttgtttgtgggcagcgattccagtcccaacggaggcattctcgtgtgtcccggggggttatgtccttcacaaaacacttaatgaaatgaattacttc

SEQ ID NO: 2876 - DNA, 4088 bp, Homo sapiens
gagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccatggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatgtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgattttgtatgtggaccactgctcctgatttcccaggtcttaggccacctttgactgtttctccgtttgtttgtgggcagcgattccagtcccaacggaggcattctcgtgtgtcccggggggttatgtccttcacaaaacacttaatgaaatgaattacttc

SEQ ID NO: 2877 - DNA, 1969 bp, Homo sapiens
acactttagttgggagctgcgcgccgcgctcagttactggagagctggccgcgcgccgccgcctcccgcacgcttgcacgcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcttccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggaaaaaagtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactattatggaagagaatgacctcttctccaaagacaggaagtggatatttttaaccaaatattgtccacaagttaaatggccaatccaaagggaggaaattacctttgtatttttttttaatgtgttttgataggcctttg

SEQ ID NO: 2878 - DNA, 636 bp, Homo sapiens
tcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaaggtactgaaaggctgagccgcagcagcgtggggcacacagttggttgcattttgattaatgacagaaggtcaaatcacagcttcaaagtaccaatttccagaaggcttttctgggagacttggtccttttcgtgaaggtctaattccttgtggatgttgtggaattctagcttaagccagtcccgtcccagacctgggggatgtttgcagtgccttcctttccttttctaattggaattccttgttggttttgggacatgtttttaaggaaccttaatattttatagaaggtaccatataatgctatggattccttgggaaaaaataggccatagccacaaagctaaattatgctgtaatcaaataaagcttcgtggaattgtttagaaaaaaaa

SEQ ID NO: 2879 - DNA, 673 bp, Homo sapiens
gcggccgcctgagtaaggacttctgcgcgcgggagttcgaggccctgcggagctgcttcgccgctgcggtaggtgggcgcgggccccttccccccttcccagcccttcccctccaagagccagcgggccccggctttcctttgctttcccgttggttcaaggtttgagcgcctgccgcgtgctttagacgccggctgacaaaatcaccgagccatcgacgagcccgcgaaacctcggccgtcctgggcttgtccctgcatgtttgtaaagcgggactggcaccaacctcagaaaggatgggagatgtgtgcaaaaaagcgccttgtaaaacgcggccaagaagacggcagaagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctacaaaaaaaaaaaaaaaaaaaaaaaaaaaaaaagtcgtatcgatgt

SEQ ID NO: 2880 - DNA, 508 bp, Homo sapiens
  misc_feature (1)...(508): n = A,T,C or G
cttaaccccnaaaggnaaaccccccccaagccttggccnaacctccgggcccctttaaaaaacccattttaaaccccccccgaaccggccctttggggggattataccggggatattaaagtagcccgccgggattggtttttgtttgtaaaaattcccgaattgaaacctttgttttaaaaaaaggccttcctttcctttccatatgacaagagataggtccaggaatattggaatcaagatttaaatgttaaaattcgattttgttacacagggtgtgttccatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgataaaaaaaaaaaaaaaaaa

SEQ ID NO: 2881 - DNA, 515 bp, Homo sapiens
ggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcagcctggggcttactgtgaaaaaactgcaacatgtgggtcttggcctctctgagatggaatggggcccagagcctttcccccaaagctggcagggctgggacttggggacaccctgcctcaaggtccccgttttaaaacactctcactaagg

SEQ ID NO: 2882 - DNA, 510 bp, Homo sapiens
gttttttttttttttttttttgttttcaccaaagatgtttttgcttcttttattgtgctttctagagaggagccatcaaaactcgatcaggatgttttggccgctcttgaatgtgcagacgtcgacccccatcagttcccggccgtgcacagatggaagagtgctgtcctgtgctactcaccctcggacagacagaggtatgtggggcccggacagcctgtcacccgcagggcagcttttggaaacttctgcagggtccagttccacttcatgcgaacctatcagtggcttttcccaacgctggcaggcccgtcagccaggctgtggatttgggtgttgtggctctctgcacacaggacagagctctggttgggtggaaaagctgaacgggtcagctcctgacaagctgagggctagaagggtggaagcagcagggtttctactcagatcacacaggattctccgggaaacccccatgagcttgactctcccagtgcccgcggtgccagg

SEQ ID NO: 2883 - DNA, 475 bp, Homo sapiens
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcagg

SEQ ID NO: 2884 - DNA, 431 bp, Homo sapiens
cagacagagttggcccagtcccgcggtgaaaggaaggttcaagtctcagctgccagatctcagtggccctcacagctacagtccggggagaaacagcgtggctggaagcaacccccgcaaagccaggcctgggcagtcctgggcgctacagccccgtgcacgggagcccgctccgcaggatggcgcgcctggctgagcttgccgccctgtaggcttggcgctgggctctcgtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaaa

SEQ ID NO: 2885 - DNA, 550 bp, Homo sapiens
gcggccgcctgagtaaggacttctgcgcgcgggagttcgaggccctgcggagctgcttcgccgctgcggtaggtgggcgcgggccccttccccccttcccagcccttcccctccaagagccagcgggccccggctttcctttgctttcccgttggttcaaggtttgagcgcctgccgcgtgctttagacgccggctgacaaaatcaccgagccatcgacgagcccgcgaaacctcggccgtcctgggcttgtccctgcatgtttgtaaagcgggactggcaccaacctcagaaaggatgggagatgtgtgcaaaaaagcgccttgtaaaacgcgtaagctttcgtgttagcactgccgccggggggtgtcatgccaggattgacccaacacaggactcccggaaagtgcccagcaccttccgggtcttcacctccctggcacttgcagcccctgtgcacctgcagtggtggatttccttcagcacgtgtcctgcggggaacccccagccaccctcacaactggcacgatagggcttcttgcccgtggggc

SEQ ID NO: 2886 - DNA, 538 bp, Homo sapiens
  misc_feature (1)...(538): n = A,T,C or G
acactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgattttgcagttcagcccggctgaagctgaccgaatgaagactatgggcttgtgcttcccgccaagcatgttgccactgttcaaaatgaagaggaagcccagaaaagggaaaaacttaccagaacggagatgtgtttggcgatgagtataggttcaaaccagtggaagagttcaattcctgaaaattggggnaaagaa

SEQ ID NO: 2887 - DNA, 705 bp, Homo sapiens
  misc_feature (1)...(705): n = A,T,C or G
ctgctttccctctatgagagcttgagaccaaatgtggcatctcgtgggggctcagaggagggggcagcagtgagttctgtgatagtgtcatgaggcccttgtcccgtggaaagtggacccagagaacctgcccatggngcccaaggctccaaccagtcgagcccccaccatatgccagcacccaagttctctgtaaaaggtatttggtagaacacaacgtgtggtgtggtagcttgcttttgaggcgtatctaacttggaagcaagccattcagacaaaacactttatcttgcaggccaagaagacgctggagggaggctgttaggagggactctgagcttcacacctgtctgctgccatgggttgcagagccctaagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggacctgccacggcggcctctagggggctgggaatagccgctcatgtcggctaacggagcggtgtggggccgcgtgcgaagccgcctccgcgccttccccgagcggctggccgcctgcggggccgaggccgcggcgtacggcaggtg

SEQ ID NO: 2888 - DNA, 443 bp, Homo sapiens
  misc_feature (1)...(443): n = A,T,C or G
gcgnccgcctgagtaaggacttctgcgcgcgggagttcgaggccctgcggactggcttcgccgctgcggccaagaagacgctggagggaggctgttaggagggactctgagcttcacacctgtctgctgccatgggtgcagancctagtcctgatggcccctggtggcacatatcgaatgcctaggnagaaaggaagtggggaatggcgaagatgtgacattcctcgggtgttagatcctgttttttcttaacaaagttgaggcgttgggtaagagcaggaatttggttttccaagcattgttgtccgtaaacctgagttagaattaagatgtaaccggaagccaccgattaaagactccgggtcaaaattcctaaaancttcggtggccggaaatttctttgggcctccgaggggccaaaatttcccnaataagttgagttc

SEQ ID NO: 2889 - DNA, 401 bp, Homo sapiens
ggccgaaggccgcggcgtacggcaggtgcgtgacagcctccacggccccggcggccgcctgagtaaggacttctgcgcgcgggagttcgaggccctgcggagtgctctccccccgccgccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggt

SEQ ID NO: 2890 - DNA, 350 bp, Homo sapiens
ggagaggaggacaccttttctgaccttatctggagcaacccccggtatctgataggctcaggagacaaccccactatcctgcactcaccaagatgaactatttgccgccctgtcttttcctgggttggggggtggcatctgatggtggcagagtgcctgttggtccacacagcagcagaaattggctctgccatcctctgaatcacagcaggcactggcgggcaagagaccaaaggccccccgtggggaggaagcccatctgccacctgtctcggatttgactgttgagtttgataaactgaatttgcaaaatataggacgtagcgtttccaagacaccagatgaaagta

SEQ ID NO: 2891 - DNA, 363 bp, Homo sapiens
  misc_feature (1)...(363): n = A,T,C or G
gcgaccgcctgagtaaggacttctgcgcgcgggagttcgaggccctgcggactcgctntcgccgctgcggtaggccaagaagacgctggagggaggctgttaggagggactctgagcttcacacctgtctgctgccatgggtgcagagccctagtcctgatggcccctggtggcacatatcgaatgcctaggnagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactccggtcaaatc

SEQ ID NO: 2892 - DNA, 344 bp, Homo sapiens
gcgaccgcctgagtaaggacttctgcgcgcgggagttcgaggccctgcggcctgcttcgccgctgcgccaagaagacgctggagggaggctgttaggagggactctgagcttcacacctgtctgctgccatgggtgcagagccctagtcctgatggcccctggtggcacatatcgaatgcctagggagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagac

SEQ ID NO: 2893 - DNA, 435 bp, Homo sapiens
acactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagactatgaggacaggggcggtgggcggtaggattgtcattttttgtactccagattacgccttagttgtacactgctgtgtcctttcaactacaacgtttattattcttgcgtcttcagatttacctcttttatgttttcgtccctatctttctgtcttcaatgcctgctttgtcatactacttgtcatgtgttgctgtgccttttcaagttcttagttcttttgttttacttttgtgttttc

SEQ ID NO: 2894 - DNA, 362 bp, Homo sapiens
  misc_feature (1)...(362): n = A,T,C or G
gcgnccgcctgagtaaggacttctgcgcgcgggagttcgaggccctgcggactgcttcgccgctgcggccaagaagacgctggaagggaggctgttaggagggactctgagcttcacacctgtctgctgccatgggtgcagagccctagtcctgatggcccctggtggcacatatcgaatgcctaggnagaaaggaagtgggaatggcgaagatgtgacattcctcggtgttagatcctgttttttcttaacaagttgaggcgtgggtaaaagaaggaattggttttccagcattgtgtccgtaaacctgaagttaagaataaagattgtaaccggaaagccacgaataaaagactcggtca

SEQ ID NO: 2895 - DNA, 317 bp, Homo sapiens
  misc_feature (1)...(317): n = A,T,C or G
taagttggactaaatgctcttccttcagaggattatccggggcatctactcaatgaaaaaccatgataattctttgtatataaaataaacatttgaaaaaaccaaaaaaaaaaaaaaaaaactcgcggcacgaggattgcctagggcagaaaggaagtgggaatggcgaagatgtgacattcctcggtgttagatcctgttttttcttaacaagttgaggcgtgggtagagcaggaattggttttccagcattgtgtccgtaancctgagttagaataagatgtaacggaagccacgataaagactcggtcaaatcc

SEQ ID NO: 2896 - DNA, 340 bp, Homo sapiens
acactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaagacgaggaggacaggggcggtgggcgggaccctcaaaggattttgaagccagctgaagggaacccaactgatcaggctggcttttctgaagacagagattttggttacagtgtgggcctgaatcctgcagaggaggaagctgtgacatc

SEQ ID NO: 2897 - DNA, 210 bp, Homo sapiens
  misc_feature (1)...(210): n = A,T,C or G
atcgtcaaagccggattgaaatgtggacccattacatcaactacaaggttcatttttgagaaaaaattggctcaggctttactggagcaagaaagaagacagccttcctccttgctccagtaaagcctgagcaaggaggaaggctgtcttctttctactaccatgaggcnggtgtcacagctctcagccaggacccacnnnggattttga

SEQ ID NO: 2898 - DNA, 6709 bp, Homo sapiens
cgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggccaagacgagaaaggagccgaaagcgcaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccggcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgaactcctgacctcaagtgatctgcccatctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagaaaaaaaaaaaaaaaaaaaaaaaacccactgaacgccgtgtaaagaacgggagcgggggcttcgtctcc

SEQ ID NO: 2899 - DNA, 842 bp, Homo sapiens
gcggtttcccctggagtcagccaggttgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttataaaaa

SEQ ID NO: 2900 - DNA, 1012 bp, Homo sapiens
  misc_feature (1)...(1012): n = A,T,C or G
ttgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccncacgccgtgtgtcacgggctagggcggcgtgttcatccncacaccgtgtgtcacaacaggctanggcacttcacgatgtcactacttgtttttctgacgttccanaaacaacgtaacttggnttcatgtgttttccgtgtatatgtagattgatgctcgggtctacggactcacacccgtccactctctgcatatgatcaggagtgttctgaangatggaatgactctctcggtggtccacagggccctgcaccagacacagtcgtctggctggctangactgcctcactctcttgtgcgggtccacaccgagtctagttcctgggtcttaaaacaaaacagaatgtgacgtgagatctagagggacgacagcaatctgaagaccgtctgggcctcctcgagagcctctgatgtagaggactgagtgatganctgngtgtgagtgtctactactgaccgaggtcagtgaatctgcataatgactaggtctacagatccgnggaatggtagaggctgaaatcntgctntgagtactgtttataaaattctacaangaagtctagttgtgtgccttgaaaggtcacggctgacaggacttaaacccgtgatttacaatgagtgcgtgattctaatttggatactttttcgaaataattcaaanaactggccatctgctcggcgatctattaggattaatgactggagtttctttaattacgtccatccaaccacggcgaagtagctggcaggggtagcaatcgtgcacgctctagtgaacgccgtgtaaagaacgggagcgggggcttcgtctcc

SEQ ID NO: 2901 - DNA, 687 bp, Homo sapiens
  misc_feature (1)...(687): n = A,T,C or G
tcagacgccaccccaccctttccaagacctccggttgttttgatccaccncaaggcccaagtgggccctatgcttctcagggtgtgctggtttccatgcacctaagngaagtctcagggaactagtgctgaggcaagtgtagaaaagaagctttgcagtctctcagactcagtcttcctatgcaaagaaacgcaactgtgctctacagattctcccctcgcccctggagaaggaggagcaggtccgacttcaggctcggaagtggctggaagagcagctcaaacagtacagggtgaagcgccagcaggagagggtgagtctccctctcccgaacaagctcatggaaagcttcctgtgccagagacaactgttggtcccacataacccggggacctgccattggcttctctgagctgccatgggctcaggggcaacaagcacattttatttctaaatctgccaattgaaaagcaaagaaagcaaacacgggtgacctcagaggtactgtgggttcagttctggaccaccacaaaaatgtaaacattgcaataaagcaagtcctacaatgtttttggtttcctagtgcataaagaagttatgtgtatacgctactgtagtttactaagtgtgcagtagcactgtgtctaaataaaactgatgtacccacattaaaaaaaaaaaaaaaaa

SEQ ID NO: 2902 - DNA, 668 bp, Homo sapiens
  misc_feature (1)...(668): n = A,T,C or G
anatcgccgagtggtttcattgnttccatnatagtagatgatcacgntcttcggattacaccgtccaatctcncaattgatcagcagtgtccggatagatgtgaaaggactctcccggtggntccagcaggccctccaaccagaacacagtccgtgcttgtntgcgctaaggagctggccctcaactctccttggtgcaggnttcccacanccgagttctagttcccgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggt

SEQ ID NO: 2903 - DNA, 628 bp, Homo sapiens
gcgacttctctcttgcttatgggagtcctcaagtgagggatgttcaccatgattttttttctcttaggcagctaattctgaaataccgaaggaaaagtagtctatgtctcaccccggtttcctgtacttctgcagtcatcgagaagtcctggatcttttgtggtacaccagcatcatgtggcaagcagaggcgacttccggaagagacaggcaggcaccgtgaggaaggtggctgtgctctcccaggtgtctcagagacagatgccttatttaaaatcagcacgacatgtgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagata

SEQ ID NO: 2904 - DNA, 686 bp, Homo sapiens
  misc_feature (1)...(686): n = A,T,C or G
gccccccttttttttttacngggggccanagggggggcnttnttttnaaaaacccccnacccncccgtntnttttncccccnncaagagggcngagggngnccctccncccggattttccnccccnaccntttnttttttntttnagagggnccccccaaaaacccaaccgtaaaantggggttntncaatnttnttttttccccntgggaaaaatntnaagaattgattccccggggncntnangggactnanaaaccggtnccnactctcttccnaaatggatcaggcagttgtntctganaaggatgtggaatggactctccncggggtggtccagcagggnccttcccaccagaacacaagtccgtgctgtgctgcgctaaggagctggccctcaactcnccttggtgcagggttcccaccaaccgagttctagttccctgaggtcnttaaaaaccnaaacagnatngttgtacgtgaagatccaaggagggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgtttaga

SEQ ID NO: 2905 - DNA, 427 bp, Homo sapiens
tcccagaccctccgtcgtctctcgatgccaccacaagcacagtgggccctgatgcctctccaggctctacagattctcccctgcccctggagaaggaggagcaggtccgacttcaggctcggaagtggctggaagagcagctcaaacagtacagggtgaagcgccagcaggagagggtgagtctccctctcccgaacaagctcatggaaagcttcctgtgccagagacaactgttggtcccacataagccggggacctgccattggcttctctgagctgccatgggctcaggggcaacaagcacattttatttctaaatctgccaattgaaaagcaaagaaagcaaacacgggtgacctcagaggtactgtgggttcagttctggaccaccacaaaaatgtaaacattgcaataaagcaagtcctac

SEQ ID NO: 2906 - DNA, 271 bp, Homo sapiens
  misc_feature (1)...(271): n = A,T,C or G
tggntttnagnaggggntcctgggnaaaaaatttnccagntgccttttttggaagnttttacctttgttttttttaatttaaaaaatnnttccnntncaaccaannaagcagcagntncctncaaagnttgctggnctgttctnntgggaaaagcgggtcaccgctgctctgcacaaagtgtanactttaaaaagcacgttgattttttacaaatgtaagtgtgcttgggaattccttaaattttgtgcaataaactattttttggtaaag

SEQ ID NO: 2907 - DNA, 2543 bp, Homo sapiens
ctaaaggtcggcgaggcttctgaagacgcaattcctgcgacgcccgcggaggggccctggggggcggcgcccgcgtctggcctgtgttggctgtaggcaacgaaaggagccctcccggcctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaaagggaagtgaaaagagatctgttttcagtttcagagtcaagtggtgagatcaaagacttttcaccaaaaaatgtcatttatgatgactcatcccagtatttgaatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtaatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaatgcagttaattaccactcattccttactgaacaccagtgaatttacactgcaaagaaaaactatgaatgtatgtaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaaaaaaaaaaaaaaaaa

SEQ ID NO: 2908 - DNA, 520 bp, Homo sapiens
catgtgtataatcctttattttgaataaaattgtaaattatctcaggacagataatttatgtttttctccttttctccagttatacaacaaaacacaagagctaggctcttcattatataattactcagaattctgaaaactctcactgttactacttagacacattgcctaacctccacagtgagactcattttattccttgatgagggagtttgggggcatgcgtgctggtcatgcaaatatctgtccgtcatttcaggggtcagtgacattaagagatgtggccatagacttctcccaggaggagtggaaatggcttcagcctgctcaaagagatttgtacagatgtgtaatgttggagaactatggccatctggtctcactgggtaagtattattcttcatctccatctgacatttcctttgtggcccctcttaggattcaatgactgatcttgaatttatttcattttctgcaagcaggtctttccatttctaagccagatgtggtttccttatt

SEQ ID NO: 2909 - DNA, 604 bp, Homo sapiens
ttttttttttttttttctgttgctaaagaagggagaaaatggccttattttattcaatacaggaaaaagaaacattcacttttttttttggtatctttcagtttcagagtcaaagtggtgagatcaaaggacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccacatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccct

SEQ ID NO: 2910 - DNA, 520 bp, Homo sapiens
aactgaagtggtgaaaaactacagaggagaggactactgtaattcccagccttgttcctttatagtttcagagtcaagtggtgagatcaaagacttttcaccaaaaaatgtcatttatgggactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacaaaa

SEQ ID NO: 2911 - DNA, 415 bp, Homo sapiens
  misc_feature (1)...(415): n = A,T,C or G
tgactcggtccggagccctggaacgctacgcccacctggcggaaagcaccacggaaacgcatccttctgtggccactgttaggtctgccattttacacttttctgatctcctccttcccttctgtgagcntatgtctcaggggtcagtgacattcagagatgtggccatagacttctcccaggaggagtggaaatggcttcagcttgctcaaagagatttgtacagatgtgtaatgttggagaactatggccatctggtctcactgggtctttccatttctaagccagatgtggtttccttattggagcaagggaaagaaccctgggctgggggaaaagggaagtgaaaagagatctggttttcaggtaactggaagtgggtgaaaaactacagaggagaggactactgtaattc

SEQ ID NO: 2912 - DNA, 412 bp, Homo sapiens
  misc_feature (1)...(412): n = A,T,C or G
aacaanaccagaggtcancaagccaacaagcccagggcccaggtatccatttacatagtttatggctccttacctctataactgaagagtttaatatacagccataaaggttaaacatttactatctagccctttacagaaaaacttggccaacccctgactacatcaaatctttgccctctagtttttgttgagtgcagccaacattgagaacgtttactttggagcaatctccaattaaccaaagtgatacaaacacagtgatttgggaatgccttcaattacaatgcaatacttaaattttaatactcttgtaggagaaaaagcaactgtataaatgaatgtagagtgaatttctgcaatatttcaaacctatatcagagaattacactgtgggaaaactacnattgta

SEQ ID NO: 2913 - DNA, 391 bp, Homo sapiens
gtcactcattccttattaaacatcagagaattcatgctggagaaaagctctatgaatgtgatgaatgtggtaaagttttcacttggcatgcatcccttattcaacatacgaagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacat

SEQ ID NO: 2914 - DNA, 1644 bp, Homo sapiens
cagagacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtaccaggattgccttctgtgtgactgtttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtacaaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctaggactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttcaaaaaaaaaaaaaaaaaaaaaaaaaaaaa

SEQ ID NO: 2915 - DNA, 615 bp, Homo sapiens
gccaagaattcggcacgagatcttttttttttttttttttttgagacggagtttcgctcttgttgctcttgttaatttaagatgtgtatctcaaatctctgcccttgtgactggcatatgttaattagctgggccatggtgcggggcgcctgtaatccccggctactagggaggttgaggccggagaattgcttgaaccccggaggcagaggttgccagtgagcccaggtcgagcccattggcactcccagcatgggcaacaagagcaaaactctatctcaaaaaaaaaaaaaaaaaaattctcagattttcttgacaattgaatataatctataaacagaactgtttttattcttactcatcctttattcttctagtaagaattgcctagtaaggttttgaagtttttctcatatagttcacatatatttctagctaaaattattttcttcctattgtgaagacttttttaaaaataaaagtatgtgctaacttgttgaggacggcaatcaatctattagcttatatatttccttttcagtcactttactacaaattattgatagtaattgaatctcttctcattttggggacttcactagattaattaatgag

SEQ ID NO: 2916 - DNA, 400 bp, Homo sapiens
ggcctcatcaatacctcggggcattattcccttccctatggccaggatgggccttttcctataatatataatttccacaaatccaaaactcccctacaaagttggtaagatttatgccccattagggaggttgagatgggagactaaacatgatttgaaagtaggaacagagagaatggagagaagatttaaacatgattatcagtatcctcctctgagacccatttcaattacatacaggaatacagtacacacaaacacacctctaaaagaaaagggagcccaggggcggtgctcatgcctgtaatcccagcactttgggagactgaagccaggagtttgagaccagcctggcaacgcagagaccttgcctatacaaaacaacaacaacaacaacaaa

SEQ ID NO: 2917 - DNA, 1562 bp, Homo sapiens
ccacgagctgcccacgtcctctccaggaggggacaccgggttcacgagctgcccacgccctctccaggaggggacaccgggttcacgagctgcccacgtcctctccaggaggggacaccgggttcatgagctgcccacgccctttccaggaagggaccccgggttcacgagctgcccacgtcctctccaggaagggaccccgggttcacgagctgcccacgtcctctccaggaagggaccccgggttcacgagctgcccacgtcctctccaggaagggacccgggtcacgaactgcccacgtcctctccaggaagggaccccgggttcacgagctgcccacgtcctctccaggaggggacaccgggttcacgagctgcccacgccctctccaggaagggaccccgggttcatgagctgcccacgtcctctccaggaagggacccgggtcacgaactgcccacgccctctccaggaggggacccgggtcacgagctgcccacgtcgtctccaggaagggacccgggtcacgagctgcccacgtcctctccaggaagggacccgggtcacgaactgcccacgcgctctccaggaggggacaccgggttcacgagctgcccacgccctctccaggaagggaccccgggttcacgagctgcccacgtcctctccaggaggggacaccgggttcacgagctgcccacgtcctctccaggaggggacaccgggttcacgagctgcccacgccctctccaggaggggacaccgggttcacgagctgcccacgtcctctccaggaagggacccgggtcacgagctgcccacgtcctctccaggaggggacaccgggttcacgagctgcccacgcactttccaggaagggaccccgggttcaggtctcctgccggcccacatcgtgcctttgtgtaaatcagaagaaagatgaggaacaggccctcctctctctccaggcaggctttggtggaggggctggatctcctgccgcaccttccctggcaggcaccctgtcgttgagccccagaactgcaggcggccggcagagaaggggtccatgatggcgcctcggtgcggccttggacctgcccccatggacctggagacagggtttctcctcattggccaggctggtctcgaactcctgacctcagacgatccacctgcctcagcctcccgaagtgttgggattacaggcacgagccactgtgcccggccatcattcctttttactgctgactaatagtctgctgtgtgaatccaccgctagaaacccactcatcagttgatggtcatgtgggttgcttctcgtattcgcttattatgaacagtgctggaataaacgttcctgtgcactcttgggcatacgcctaggagtggaactgctgggtcaaatggtgactttacgtttaacgttctgaggagccgccaggcgttttaacacagtgactgcaccatttcacattcctgccaacaatgtgtgagaattccaatttctctacatccccaacattttcctttaaaaaaaaaaaaaaaaaagcctcccgcc

SEQ ID NO: 2918 - DNA, 428 bp, Homo sapiens
  misc_feature (1)...(428): n = A,T,C or G
gaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtgggcatttnaggnactcacactgnaggaggaaggcctctgaagtntnagatatgtggggnaagtattttggggnatccccccatgtctttaataatccccat

SEQ ID NO: 2919 - DNA, 533 bp, Homo sapiens
  misc_feature (1)...(533): n = A,T,C or G
ggaaaggaaaggaaaggaaaggaaaggaaaggaaaggaaaggaaaggaaaggaaaggaaaggaaaggaaaggaaaggaaagggaaggaagaaaggaaggaaggaaaatagaaatagaaatgcaagtaaagaatttcagtttgaaaattgccttttgtctactgaacatgagactgcttggaaactgggcaacgtggatttttataagttgtacaaagcacttagcaattttcaaacctctccatcctgcagagccagctcaatcacttctccagaaagacttactgagtcctctgcactgaacaggtgtcctatgctccagggagagccctgggctgggctcctagtgcagccgttatgacccgggaatgcaccatctttcacatcactgcctgggccttctaggaatcttcagcttcttaaatcaaggaaattgtgtccttgttcatgtctggaatttccccaagttgaacacagtgaagtggggtgcctttgacaaatctttgtttgggtaatngaggccaaaaaaggggg

SEQ ID NO: 2920 - DNA, 493 bp, Homo sapiens
  misc_feature (1)...(493): n = A,T,C or G
ttttttttttttttttttttttttttttttttttttttagtgggtgttgaaggcatgctgcctgtgttagaggagtgaggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttattaaatgcagtcaatgtgagaaatccttcagtggggaaattacgccttctttgttacaccagnggaatgccacacaaggggaggaaaccatatggattgcagttgagtgtggggnaaaagcctttcnttagggggtttcttccaactccnttgttacatccaaaggactccnttccagggnggaggaaccctttg

SEQ ID NO: 2921 - DNA, 501 bp, Homo sapiens
  misc_feature (1)...(501): n = A,T,C or G
gaattcaaagcaaaattagcaaagggaaaaagcaccttgggtgaagtcgggggaggccaggctggagcttccagagtcctcttccagggggttcctacaggatgcacttaatgtctttagcaatgagttgtgacaacatgtaggagatgttgtctagcagggaagctcattagaaattcagtgcccatggtgttttgctaggggccagtcatgtgggcacctctgcctggcaggtaccaaaattctaggctctgggaaggaaagcaggtgctgagcaagaaccatattgtttgtacaaataatttcggcccagtgaactactctcatcagttaggggatggtngggaccctcctgaaatctggggttcccagatgccagccagaattcctaaggagagcagcttcaggcctntgcgttnaactctgttctactcacgggtgatcttcatgnccatnccacccagggttttcgaggggcaagnacttccccanttcgtnggg

SEQ ID NO: 2922 - DNA, 2954 bp, Homo sapiens
gctgagagacgacctggaagttctgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaagatgtcgtatgttagagagatttattgaaagtaaagatggaactcaatgtggagaaacatctagccagattcaagatagtattgtgaccaagaacactcttcctggagtaggtccttgtgaaagcagtatgagaggagaaaaagtcatgggtcattcatcccttaattgttacatcagagttggtgctgggcacaaaccacatgagtatcatgaatgtggagagaagccagatacgcataaacaacgtgggaaagccttcagttaccacaactcatttcaaacacatgagaggcttcacactggaaagaaaccatatgattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgaaagaacgcacactggagagaaaccatatgaatgtaagcagtgttctaaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagcagtgtgggaaagcattatctcatcgctcaagctttcgaagtcatatgataatgcacactggagatggacctcataaatgcaaggtatgtgggaaagcctttgtttatcccagtgtatttcaaagacatgaaaggactcacactgcagagaaaccctataaatgtaaacaatgtggcaaagcctaccgtatttccagttcccttcgaaggcatgaaacaactcatactggagagaaaccctataaatgcacacttgggaaagcctttattgatttctgttcctttcaaaatcacaaaacaactcacactggagagaagccatatgagtgtaaggaatgtgggaaagcattcagtcgtttcagatacctttctcgacataaaaggactcacacaggagagaaaccttatgagtgtaaaacatgtaggaaagccttcggtcattatgataacttaaaggtacatgaaagaattcactctggagagaagccgtatgaatgtaaggaatgtgggaaagcattctcttggctcacttgctttctacgacatgaaagaattcacatgagagagaaatcctatgaatgtccacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccatatgaatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaagccttaagtagtttcagtttctttccagtacagtcatcccttgatacctgctgggtattggttccagcactccgtgagccatgtccagtcccttttataaaatgacatatttgtatgtaacttacccacatcctcttgtatagtctcaattatgtctagattacttaaaatacctcatgcattataaaagctatgcaaatagttgttctattgtattgtttagggaatcatgataaggaaaagagtctatgtattttcagtatagatgcagtaattgtcagcctatcaacatagtgtagtcagccagaacattaaagtttctttgtttcaactcccaaaaaaaaaaattgtttaatgtgttaacacttaccaaaaccctgggtcttctctcttgataacccaagtatagtgattataacaatgatgatgattctgtggtgcccagtgttttgatgtgttgagatgactagatgtatggcattgtgggtaagtagtgagacatcaggttaacttgaatcttgacaggccatcaggactatcatctatgttgaaagaacccacttgtgattatagatgtggactcatttgaggaggctatgtaatactaatgttaggatctgtttggcttgagggctgaagatctgtaaccattgaatgttccatcttctttgcagatgcttagttataggaagctagttcttcttttcctttgcttcattaa

SEQ ID NO: 2923 - DNA, 2376 bp, Homo sapiens
gaattccgagagagagacgccctggaaggtctgtatcagcgtctgtcgcgctgggacccacactggcttttaaggaggacacccggacacctggaagctgggaaatggactcagtggcctttgaagatgtggctgtgaacttcacacaagaggagtgggctttgctgggtccatcacagaagagtctctacagaaatgtcatgcaggaaaccattaggaacctggactgtatagaaatgaaatgggaggaccagaacattggagatcagtgccaaaatgccaagagaaatctaagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaaccctataaatgtacacaatgtgggaaagccttcagctgttactattacactcgactacatgaaaggactcacacgggagaacaaccctatgcatgtaagcaatgtgggaaaacgttttatcatcacacaagctttcgaagacacatgataaggcacactggagacggaccacataaatgtaagatatgtgggaaaggctttgattgtcctagttcagttcgaaatcatgaaactactcacactggagagaaaccctatgaatgtaagcagtgtgggaaagtgttatctcatagctcgagctttcgaagtcacatgataacacacacaggagatggaccccagaaatgcaagatatgtgggaaagcctttggttgtcccagtttatttcaaagacatgaaaggactcacactggagagaaaccctatcaatgtaaacaatgtggtaaagccttcagtcttgccggttcccttcgaagacatgaagcaactcacactggagtgaaaccctataaatgtcagtgtgggaaagcctttagtgatctctcttcctttcaaaatcatgagacaactcacactggagagaagccatatgagtgtaaggaatgtgggaaagcattcagttgtttcaaatacctttctcaacataaaaggacccacacagtagaaaaaccttatgagtgtaaaacatgtagaaaagccttcagtcatttcagtaactaaaaggtccatgaaaggattcactctggagagaagccatatgaatgtaaggaatgtggaaaagcattctcttggctcacttgccttctacgacatgaaagaattcacactgaagagaaaccctatgaatgtctacaatgtggtaaagccttcactcgttcccgtttccttcgaggacatgaaaaaactcacactggagagaagctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcctccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgcaggcccacctacgtggtatatgtcacccagaacattaaaatttgttttaacattaaaaa

SEQ ID NO: 2924 - DNA, 724 bp, Homo sapiens
  misc_feature (1)...(724): n = A,T,C or G
gtatgcccctgtggtcccagctaacttgggaggctgaggtgggaagatntcttgagccaaaggggtgggggttgcagtgagccaagatgcactgcaccccagcctgggcgacggagccagaccctgtctcaaaaaaaaaaaaaaagtacatgaaaggattcactctggagagaagtcatatgaatgtaagaaatgtagaaaagcattgagttctctcaggtccttgcatagacataaaaggactcactggagagatactctataaatgtgtgaaatgtagggaagtattctttaatgttatttcatttcagatagaaataattctcattggagataaaccctatgaatgtaaacacatagtaaagccttaattttaagcctcagtttctttcaaatacagttatcccctaatatttgcaggagcgtggttctaccaccccctgggcatacataaatcgacacatgccaagtccttttttaaaaatgacatatttggtacaaaattacccggatgtgatggcacatgcctgtaatcccagctactcaggaggctgaggcaggataatcacttgaatccgggaggcggaggttgcggtgagccgagatcgcgccactgcactccagcctgggcagcaagagcaaaacaacctctgtcacacacacaaaaaaaaaaaaaaagggcggccgctctagaggancncnagattagagtacgcgtgccccg

SEQ ID NO: 2925 - DNA, 830 bp, Homo sapiens
  misc_feature (1)...(830): n = A,T,C or G
ggaaggcatcagttggttcaaacccttttcaccataaaggggccccccagtggaaaaccctatgagtttaaacatgagaaaagccttcagccattcagtaacttaaaaggcatggaaggaatcccttgggaagaaagccaaagtaagtgagggatgtggaaagccttttctttgcttcctcgcctttttcgcacatgaaggaattcacactggagagaacccttatgaatgtntccaatgtggtaaagccttcactcgttcccgtttccttcgaggacatgaaaaaactcacactggagagaagctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcctccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgcaggcccacctacgtggtatatgtcacccagaacattaaaatttgttttaacattca

SEQ ID NO: 2926 - DNA, 140 bp, Homo sapiens
  misc_feature (1)...(140): n = A,T,C or G
atgtcgtagaanncaagtgagccaagagaatgcttttccacattcccttccttacattcatatggattcactctgggagagaagccatatgaatgtaaggaatgtggaaaagcattctcttggctcacttccccggaatt

SEQ ID NO: 2927 - DNA, 640 bp, Homo sapiens
  misc_feature (1)...(640): n = A,T,C or G
cctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatggtatgccatgaatgtggcaaagccttcaggagcaagtcataccttattatacatacaaggactcatacaggagaaaaactccatgaatgcaacaattgtgggaaagccttcagttttaaatcacagctcattntacatcagaggnttcatacaggagggaacccctattgaatgcccatnaatgtngggaagcctttcagtcggggaataccag

SEQ ID NO: 2928 - DNA, 860 bp, Homo sapiens
  misc_feature (1)...(860): n = A,T,C or G
gagcgacttatccactatggcttccagcactgtcccggtgagcgctgctggctcggctaatgaaactcccgaaataccggacaacgtgggagattggcttcggggcgtctaccgctttgccactgataggaatgacttccggagaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgtttaaaaaaacatttggaaataaaataccgcacacaaaggaaaaaaaacaaaaaaaaaaaactcgagggggggcccggncccaattcngcccnaaagtngggcgnattacaattnactggccgcngtttacaacggcgggncttggggaaacccttggggntacccaaccntaaacngctttggaggaaancccccttttcngcaannttgggggaaaanccnnaagangggccnnaccnggnnngccgtttccaaaaangtggnncgntnnatttgnggaattttt

SEQ ID NO: 2929 - DNA, 1036 bp, Homo sapiens
  misc_feature (1)...(1036): n = A,T,C or G
tgcttccagcactgtcccggtgagcgctgctggctcggctaatgaaactcccgaaataccggacaacgtgggagattggcttcggggcgtctaccgctttgccactgataggaatgacttccggagacattgatactaaatttgggactctttgctgcgggagtttggctggccaggaacttgagtgacattgacctcatggcacctcagccaggggtgtagccaagtagacaaatggaatcctgtgctgaacccgaatcttccaaaaaacaggtcagcagaggctatgcatgttgtgatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacataggttcccaagcttctgcagggggtgatttttgctctttgtcctgaggaaataacagtgctgttttaaaaaagcattttgaaataaataccggacacaaaggcaaaaaatatataaaaaaaaaaactttgcagggggggggcccggttaccccaatttcggcccntataggtggngttcggtattttcaaatttccactttggnccgtncgntttttnacaancgtncgtggacnttggggntnaaaccccntgggggttancccaancttttaattcggcntttgaaagncacaattcccccnttttnggccaagtttnggggnaanttnggggaggggggnccntgnanccggattggcccctttcccaaaaatgtttntangtttttatcctgntggccccgnanntnggcccnttgtggtanggncttntnttatnatttnctnggccctntngntntncaaacngtntggtnctttngtgannccntttggggtttccccttnttttttntcntttnatgnncgnccctnttttatnnnntnnttngatttgncatagggnccatcncgtn

SEQ ID NO: 2930 - DNA, 523 bp, Homo sapiens
gcactgtcccggtgagcgctgctggctcggctaatgaaactcccgaaataccggacaacgtgggagattggcttcggggcgtctaccgctttgccactgataggaatgacttccggagaactttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctggtaaagttctgtacatagttcccaagcttctgcagggggtgatttttgctcttgtcctgagaaataacagtgctgttttaaaaaca

SEQ ID NO: 2931 - DNA, 320 bp, Homo sapiens
agagagcttcttttggttttctgggggttttccaaatttctcattggcattagccactgtttgtgtcttaaccagagccagggttttggcctctgccttcaactttgaggttaatggtcccgaagaaaaatgggccagcatgtccttctgcctagtttccttttgttccttgagtccacgcagaattccattctctggtcagcagacaggcttaagctaaggtattgcctctattctgtaaagctctgtacatagttcccaagcttctgcagggggtgatttttgctcttatcctgagaaataacagtgctgttttaaaa

SEQ ID NO: 2932 - DNA, 438 bp, Homo sapiens
attcatgaaaagacacaccctggagagaaaccctataaggaatatggaaaagcattcaacaatttctcttcctttcaaatacatgcaacaatgcacagaggacagaatgcctatgaatgtaaagagtgtgacaaagcattcatttctgcctggttcctttcgtagtacatgcaagggctcaccctggagtgaaacccctatgattgcaaggaatgcggcaaagccttcaattcttctgcttccttgcagtgtacacaaaaggatgcacactggagagaaaccctatgagtgtaagcagtgtgggaaagccttcagttctgcctcgtgcctttcgtagacatgaaagggctcacactggagtgaaaccgtatgaatgcaaggaatgtggcaaagccttcacttcttctggttcctttcagtgtcataaaaggattcacc

SEQ ID NO: 2933 - DNA, 6271 bp, Homo sapiens
  misc_feature (1)...(6271): n = A,T,C or G
ccattttttatattaatccctatatagggaaattttgtccccctttatggtaccttcccgatattcccggttcaaaaaataatataaaattgccgcccgcgcgaactttnttttttttttcccccctgtagagacagtgtcttgctatgtttccataggcttatctctaattctgggctcaagtgatcttcccatctcagcctcccaaagtgctggctgggattacaggcatgagccactgcacccagttctaaagttttttttttttttttttttttttttttttttaaagagatgggggtcttactatgttggctaagctggtctcaaactccttgcctcaggtaatccttctgcctcagcctcccaaagtgctgagattacaggcatgagccaccatgcccgacttccctttgtgtaaaatgagataatatgtatgtcacagaattgttttaaggatgataaaggactaagtgagataatgtaggtgaagtttagtatgatgcctggctcatagttaagtgctgaattatgatagtaatcaatatctactcctaacctctttcttcacagattttaagcttctgtctttctagggggttaagagtcataaaccaaaattacactttcctctgctaggtttcctccctttcctcttcttgacagtctgatgggaaacaaaggcacacataagagcctagttccaagtagtcaagagcctgagaggaagggatatggagagtaatccttcatatctccaggagtgcctgtgaagaagctgaggaatgggactgggaaagcacacaaaataaggaaaacctttcctggggttgggaaagagaagaaagtgcacagctggctacataccataagaattttgtgtcaaaatgtttaaaagcctccaaagattgaatggaattgtctgggactggggaaaaggggctgggacctgggagagagagggaatagggagaagacggtaccctctaaaggcactagctgccattaaatgctccctgagtgccacagggagcaggagttacgttctctgggcattagccttggggaaaagcctgctatgccagtaatcagggttatcaaaggcagagtctgtagcctctaagctacgtagagtttttaggcgggcataatggacatggggggcctgatgtccaggcccctgaaaagctctcatctcttcatacccttgctcagatgctgggcaggcccccatggctgcataatcacccccaggaccacctccatctcgttgccgattcatatattcatagtcttcatctggagttgtgcctgcagtgggcatgatgggtacagggtggagtgggcaactctgtgtgctgcccagagaggcactgaggtctgaccccacatccatgtactcataacccagctcctcaagggaacttggcctagggggatgaggtggactgtgccttctcctccggttcatgtattcatactcctcatcttcatcttcttcttcagtacccaggacagaactgagacccactgaagaaagggtgccttcccgggaggagggagtacctttgaggtgtgtatctggcatgacataaccgttgacatcctcttcctctaacccgggtggggagagtggggtaacaggagtcagcagactgtggcgctgggaatggtaggcgctatctccgcgtggccgtgggctccggctcctgctccggcttctacacattgacactttctcctggagctcagcctcagagcctgttacatgcccctctgatgactctgatgccaggcatccccgtggcattgggtgtagagagactggacgggggcaccgttcactgctcccagaaactgcagactcctggcaagactccccaagattaccctggttcatgggcatgtatccagatgatggacttaaaaggctctggctcccacgtggccgattaagtgttccaactggtaggctgagggcggagcccagtgtggtggttgccaggttgtcctcctctgcttccaagtctaggtctaggtctagttctggctccagctctacttcctctagcttcttgtttgtcagaccatggggctctggcccaggggctattccaggcccactctctctctttatgaccagataccgtggtgggtctcgggccatcctggtgaactcattggctagttctttaaaggttgggcgaatgttctcatcaatcatccaacacttgaccatcaccatgtagacatcaattgtgcagatctggggctgtgccaaccgctcccccttctctagcaggtctggtacttcagccaatcgtagccctgcatagggctctgccccgaaggtcatcaactcccaaactgtcacaccatagctccagacatcactctggtgtgtgtatttcccaaagtggatactctcaagggccatccacttaattggagtcttggcctcactgtatagcagctgcttatcatcaggaggcagcaggtcagccacaccaaaatctgccacctgaacctgactgggtgacttgagtagcacgtttcgggcagccaggtttctatgcaccataccatgttcctcaaggtagtacattcccttggcaatttgtactccccagttgagcagcagctgtggccccagtgccccccggtgttgtctcacatgatccagcagagaacccagaggcaaatattgagtgacaagctgcagagatgaccctgggcatagtcccagcagccttacaatgtgggcatggtccaggctgccaatggccagcatatgatctgtcacagcttgaaaactctgccgtccactcttgtcctcaatgactttaatgcagactggaatcttgattgattcaccctcagggatccacactcctttgtgcacagttccaaagacacccgagccaagcactttaagcttccttagctctgtctctttgaagattctggccaagactttgttagccttctcactggggtccagaggctctatgctctcaccccgttccaagtatcgcctcatagcccttttattctgaatccggcgcccacgccagtagagaaaagtgccgcccagcatcatgaaaatcactaccaatcctgctatcactgtcaaagccattgtcagatgggttttgccgatcagcaccagtgtttgtcctaaacagtcttgaagctctggtcctttacacccctgggtgcagttctcatggcagggccgacattcattctgaacatctgggtacttgtagattgggcccttggcacctaggactccatgggggcagctgctcacacagtggggcccatctcgaaaatgggcacattgagcacaagtatcagagcccgagccattgcatgtggcagtgccccccatgggttggcattccgggtggcaggagaagcattcggcctcatgggcaaattctcgaggctccccattcagaaagttgcagtgggtcacacagacacctcctcggctataatttcgacaggacaagcactgaccagggcctgggccccagcatcccccagaggagcacagtgggtcacacactttgccctctgccacgcagtctctgcgcggccgattatgcttgatgtctagtcgctcttccgtaggcccccgaagcaccttggtccagttcaaagagtggtggtagcagagctgcctattggcacttatatagatacgcccagcactaatttccttcagggatcggaagcccagagatgtgacattcaagttcttcatgatcaacaatgagaagccccggttgtagaggcttctgcctccaatggttgtcaaattggaaaaaacactgaagttgtgcatgtggggcggccaggactggatgttcaggtaacctgtgatctcccgtactgtccggaagacattgagcttctctgggtccagggcagggatcttgtgccaggggtctccattgaggccggtgatcagaaagtccaggttgcccaggatcttggtgcagttcacaaatccatcaatgttgctcgagtccacagtctggaagcggctcccagagcctgttccctcacaggctttgggacatagtcccccacaaggctcacacatcttgagcccatttttatctacttccatcttgtcaggaggacaggccctgacacaggatgtttgatccaccacaaagttatggggacagctggctacacaaactcctccatactgatacttggtgtggggattgggttccagctggaaagttagcttgttgtagacaagaggctgtggacagcgaggtacacaggctccactgtcattgaagtgccggcaggcaaagcagtctgtgtcctgagggcctgagcagcccccggcacactcatcatggcagcactggttggggttgggcccaaagcagtgaccattacactgaggagcacagatggtcttggtcaatgtctggcagtcttctgatccaggaccccagcatcgccccttgcaaacctcatgacaggggggacagcttctgccattgtccttcaccactatctcagcatctcggtccctcacgatgtccctccagtcaattgtgtccatgtgacaaagcttatcgttcttctcaatataaacaccccctgacagaatctcggtgagctgagtcaagcggagctggcgcagagcgtggctggagttggtgttatagttcaacatgacgaagatggcaaacttcccatcgtagacctgggtccctcgcaccacgcggaggttgggcaatggtagagtagagaattcattcatggccacgaggacatagcctgtcacttctcgaatccactgcaggaaggagaggtcggcattgtgtcccgtgagcacaatctcaaggttccccatcaccacctcacacctctcgtagagcttgtacagtgtctggtattggttctcagcatcgccggtcacactcaggccattcagagtcccaggacacactgcctgagagttgcccacctcggagccccgggccaggctgaaaagcaagcccagcacctgcagagcgtcgttcgccctcatgactccgcagagggtgaagggagcccagccaagtccggcccgggggcccctaggctaggacatcgaggcaagagccacctgaaccgctggcgaattggtggctgctgcggcgacggcagcggaggttgcaaattgcaatcggagccggagccggagtccggggagggatggcaggggaggggtgtgtgtgtgtgagagagagagagagagggagggaggaacgcagagggaagggggtgagtcacacgggccgcgccccctcccgcgcgaggctggagtggggattgcggagcctcggaccgcctgcccctgagcgtgccacgccccgcggtcccgcaacttggcggagcagatcgaggatggggctcaccctaatttttctgcaggagataggccaaggggaggtcgagattccgaaagcccccagatccagggaagggtaatgaatgagggagtggaaagctctccaaagccctgccccctgaaagttggcctcgcccattaaccaaatcactcaactcccctagccggttggttcacttggtggattttctctcagaatgtgaatatttctctctgtgtgtttttgagggggagggtgttttttgcctcacgtccaggccacctcagtttctcccagactcgaaaccccataattcatccacccagcccaggaacccgagccacagagaccgcgtgaaattgcactgtctctggccgcttcctcctccagacccggcgccggccgggcctctcccggggatttggatggggggcgggggtggtttccagcctgggaacagaccccggagcccgcctttccacttctaccccgggaggggctcccgcacctgtcgccgtcccctctgctgccccccacggccgcctgggagaacagctgcctccccttccacactggagtctggccgcaccgtccgggcggccgcagttcccgccgctcttctggggacccagatgggcacacaccaaggcgcttacaccctcccaggtgccttccaagtccaggctctcgcaggaaaggggatggggcagtgaagtgggacgcggagaggacactagagactgcgtccacgaatggcgtggacctctggaacctcccccaccagctgcccggacctggccagaggcggtcgggctcctgcgggttgctgcccaaagccctgctagtcccgggacggatcc

SEQ ID NO: 2934 - DNA, 508 bp, Homo sapiens
ttttttttttttttttttttttttttttttgtttgctgtctaaagacttttattgtatgccacctgaacagttccattgcagggccccacccccacccatccttgactggctccccttactgtacccattcagaaagttgcagtgggtcacacagacacctcctcggctataatttcgacaggacaagcactgaccagggcctgggccccagcatcccccagaggagcacagtgggtcacacactttgccctctgccacgcggtcgctgcgcggccgtttgggctggaggccgaggactcccagcaagccctctcttcattattcttcctcgttactgcttccagcctaacagcccccttctccttggttccatccctcaaccctactcccacgtctagggcagaatagtcctttcagccctctcctccctgactccctattctcaccacctagcagaccctttccctcaccgcagtctctgcgcggccgattatgcttgatgtctag

SEQ ID NO: 2935 - DNA, 775 bp, Homo sapiens
ttttttttttttttttttttttttttttttttttttttcctttgtaacaggctagaattttatgactttgattcctagtcagctccacataggaaagttttggccaatgaaatgaactgtgaggggtgcgtgggctggggtctaaggagggaaggcaggatctctaacccattgaggccggtgatcagaaagtccaggttgcccaggatcttggtgcagttcacaaatccatcaatgttgctcgagtccacagtctggaagcggctcccagagcctgttccctcacaggctgcaaatgtaagagaggttcagtgggggtggtctgcgcaggctcagaggaaaggctgtctctttacaacttcttaccatctcctacccacctttgggacatagtcccccacaaggctcacacatcttgagcccatttttatctacttccatcttgtcaggaggacaggccctgacacaggatgtttgatccaccacaaagttatctagggaagaggaggaggacaccattagagatgagggaggaacatcaccagctaccaatggaacccttgctctgggcctaggctccctccagctctgcactggatttgtccccatctgccaccctagatcccttaagtgctgccctctagattcaaaagtctcttcactatttgttgctacaaggagcagaagtaagggtgatagctgaagtcatgggaggactggacgtaagggtcactcactggagaggttagatgatcataaccattcaccaatctcg

SEQ ID NO: 2936 - DNA, 455 bp, Homo sapiens
gctcgacggaaagtgggcatggtggctcatgcctgtaatctcagcactttgggaggctgaggcagaaggattacctgaggcaaggagtttgagaccagcttagccaacatagtaagacttccctttgtgtaaaatgagataatatgtatgtcacagaattgttttaaggatgataaaggactaagtgagataatgtaggtgaagtttagtatgatgcctggctcatagttaagtgctgaattatgatagtaatcaatatctactcctaacctctttcttcacagattttaagcttctgtctttctagggggttaagagtcataaaccaaaattacactttcctctgctaggtttcctccctttcctcttcttgacagtctgatgtcgacaaacaaggcacacattacagcctaattccaatttttcaagacctgagaagagggaatgggggagta

SEQ ID NO: 2937 - DNA, 728 bp, Homo sapiens
  misc_feature (1)...(728): n = A,T,C or G
tttgttttaattttttattttattttatttttttgtatttttagtagagacagggtttcgccatgttggccaggctggtctcaaactcctgatctcaagtgatctgccctccttggcctcccaaaatgctgggattacaggtgtaagccatcaggcctggcctccggtacactgtactttgaaattagaaaaacggttaacagatccagctctgactccagccccacaaggacacagggttcctttccctggagcagatgcccctagctccccctactgggggccctctattgcttagggagcaatggacctttagacagcggccaaggtgacaggcaccttggaagaggcacttagagtgagcagtcttgggtcatcatcaaggaggtaccagtcttgggccggctgaggggtgaggccagaaggaaccatcgggaactgaccggtgagctgagtcaagcggagtggtcgcagagcgtggctggagttggtgttatagttcaacatgacgaagatggcaaacttcccatcgtagacctgggtccctcgcaccacgcggaggttgggcaatggtagagtagagaattcattcatggccacgaggacatagcctgtcacttctcgaatccactggcaagaaggagaaggtcggcatggtgtcacgtgagcacaatctcaangttccccatcaccacctcacacctctcgtagagcttgtacagtgtctg

SEQ ID NO: 2938 - DNA, 348 bp, Homo sapiens
aatggccagcatatgctaagagacacaaaaggtattatctaggaaaccaacaggttcacatacactcagcatgtgcacagccagcccaggcccccccacccccaacattctggctaacatagtagctgctgagaagcacaggaccctgcttctacatgattgtatctaatattgtcctctcgtctagcggcatacagaatttccttcacttacatctgtcacagcttgaaaactctgccgtccactcttgtcctcaatgactttaatgcagactggaatcttgattgattcaccctcagggatccacactccctgggaagtttggggcaggagttggcataaggtcat

SEQ ID NO: 2939 - DNA, 310 bp, Homo sapiens
ttttttttttttttttttttttttttttttttttttttaacaggctagaattttatgactttgattcctagtcagctccacataggaaagttttggccaatgaaatgaactgtgaggggtgcgtgggctggggtctaaggagggaaggcaggatctctaacccattgaggccggtgatcagaaagtccaggttgcccaggatcttggtgcagttcacaaatccatcaatgttgctcgagtccacagtctggaagcggctcccagagcctgttccctcacaggctttgggacatagtcccccacaaggctc

SEQ ID NO: 2940 - DNA, 478 bp, Homo sapiens
tttttttttttttaaagagatgggggtcttactatgttggctaagctggtctcaaactccttgcctcaggtaatccttctgcctcagcctcccaaagtgctgagattacaggcatgagcaccatgcccgacttccctttgtgtaaaatgagataatatgtatgtcacagaattgttttaaggatgataaaggactaagtgagataatgtaggtgaagtttagtatgatgcctggctcatagttaagtgctgaattatgatagtaatcaatatctactcctaacccctttcttcacagattttaagcttccggctttctaggggggtaagagtcataaacccaaattacactttcccccgcgctagggcttccccccccttcccccctctttgacaagtctcgaggggaaacaaagggacacataagagcacagttcacagtagtaaagagcctggggaggaaggggaaaggagagtaa

SEQ ID NO: 2941 - DNA, 1736 bp, Homo sapiens
aggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaaggaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctggcagaaatgagggcaacagtgcaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaaaa

SEQ ID NO: 2942 - DNA, 1440 bp, Homo sapiens
ttttaaactcttagcaaaacgttttatataactgatattttgagatggtttctctcctttgtgtggactctctggtggatgcagaggctcgtactctgactgaaggcctttccgcactcatcacatttgaaaggtttctctcctgtgtggactctctggtggatgcacaggctcgaactctgactgaaggccttcccacatccacaacatctatagggtttctctccagtgtggactctctggtggatgcagaggctcgacctctgactgaacgccttcccacactcataacatttatagggtttctctcctgtgtggactctttgatgcatgcagaggctggaggtgtgcctgaaggccttcccacactcttcacatttaaagggcttctctccggtgtggactctctgatgcatgcaaaggtttgaactattactaaagccccttccacactcactacagacatacggttcctcacctgtatgaactctcatatgaatttgaagatgggagctccaattgaaggctttgccacactcgtaacatttatagggcttctccactgtgtggattttcttatgtctattaagttttgttgtagtgctaaaatccttaccacaatcatcacatttatagaccttctctcctgtatggtctctccaatgaatatgaagttctgatatatgaaagaaacccttatcacacttgtcacatttatggggcttctcagctgtgtgaattttctgatgcataaaaagatctgctctctcagagaaaaattccctacacatggggcacttgtagatcatttttcctatttggtatcgtgatttcaaggagaaaatttccttatgattactacagttacaagactgttatttcatagagtctcttatttggccattttgggcagtctatctcaggcttgctctattaggtaagtttaaggtcagcctaagcttttccctgcctgtctttctacggaaggtttcttcctgcatagtgttcctcactcagtattattatcgattataaagtgacattgacttccacgtgaattctgtaactcattaacacagaactttgttttagatcctgagttgtcaacattccaaggggctctcaaagtgcaaacctttgcgtttttgagcccctggaatcttcctcttgtagagtaatcttgtatgtctcacttctagaaaaaggactgtacagtatatcccctgtatcgaaggatgagatactgctggctggtctcgagcccctgcagttgccccttgaagagtcagtttggcattctgctcctgcacatcagacaggaaagcctttccagcaagcaggctcctcggggtccaggtatggcaagccctgctttggggaattcctacatgggtatcatgccgtctccttttttggtcttgaagaagctctcttatcttc

SEQ ID NO: 2943 - DNA, 426 bp, Homo sapiens
  misc_feature (1)...(426): n = A,T,C or G
tgaaatncaataaaagcggtgttttggcgttctcctgcatttgtagtgcgggtacaaaatgctatttgttcgtcatactgttgtcagcagatgagccgcccactacagacgctactgcccagggacctgcccaggccccacccaagggcttcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggntaggggnaancanncnanngnnctctnaaagtgcaaacctttgcgtttttgagcccctggaatcttcctcttgtagagtaatcttgtatgtctcacttntagaaaaangactgtacagtatatcn

SEQ ID NO: 2944 - DNA, 275 bp, Homo sapiens
atccacaacatctatagggtttctctccagtgtggactctctggtggatgcagaggctcgaactctgactgaacgccttcccacactcataacatttatagggtttctctcctgtgtggactctttgatgcatgcagaggctggaggtgtgcctgaaggcctttccgcactcatcacatttgaaaggtttctctcctagggttttctcatctttaacaataagggagcagatgtgtgatcctgttccatattgttagtggctctcaagaatgtac

SEQ ID NO: 2945 - DNA, 23065 bp, Homo sapiens
gaggctgtggctgcagccctttccctctacgttgtccccatagaggctagacattttaaggtcagtggagcactaccaaatcaaaagagcctcttaaattgtcttctactaaaaaattttaatagtagcatattaatatttttaaatgttttagtatcatctcatttcaaaaactatatctattgttcttatatataagaaaaacaatgattttattttaagttgtttattttaagataatttacaaatatcttgctgtcttcagtaattcaaataatggaggaacggtttcttcggacaaaggcagcagtaagctaaaaacaaaatcaactggctgaattttccttctttacctgaaaaacaaagtacagaacaagtaagaaatcaaacagcattttttgggaaaataatgtcaagagataataatacatatttaagtggggtacagagaactgaatttacacaataaagtgttaccctataccagtgattctaaaattttggtctggggaacctttcatggggttcatgaggtcaaaactattttcatgataatgttattttgcctgttatattctcattctcgagtatacagtagagttttccagaggccacatgatccatgacatcacaacaaaatgaatagagacagatgaaaatctagctggcttctgctacatgaatcagacattaaggggtccagagaccataaagtgtgacaaccaccactcttcacaacctatatataatatctcaaaataatgttaattctctatcctcaaagtttatttccttatatctacattttctatgatcaacacactcactacaaaaaagtccactagcgttgcccaggtgctcccgtgagttggctgctactgtgaagtggcccatccatctaaatctctcagaggacaattataggattactaaattagcttaacttatatctgaataggtttcttttctgaacagacatgggaagaatgtgtgaactttacctcttgtctgaggatggaacttgattttcattaatccctggttattatattagaagaaaaagacaaacacaaaacaagcaggtcaagaagcaatccatgctagttaatcacatatgctttccaatgaaaaaaagtcaattgttaaacttgataccttgagtacatcatgcaaaaatacttaccacaagattcctttgaaacagactcaatgactgttataaaaagtcatagatttcaatccaggttagaagcaataaaaacatgctcatgcaagtaggcaagactatgaatatgtaatttaaattacaatttttctataaattaacacaatatatttagaggtttttttttttttttggagatggagtctcgttctgttgcccaggctggagtgcagtggcgtgatctcagctcactgcaacctcctcctgggttcaagtcattctcctgcctcagcctcccgagtagctgggattacaggtgcccgccaccatgcccagctaatttttgtacttttttagtagagacggggttttgccatgttggccaggctggtctggaactcctgacctcaggtgatccacccgcctcggcctcccaaagtgctgggattacaggcatgagccactgcgcctggccatatttagtttttaggctggcaactaatacttggacctcgaatactatggtttactcatgttcttaattatattactaaatagccaaatatgtttattttgttttttgttctttttcttttccaagtatgtttaaatattcaagtcttgattcagaataactgataggttacagagcatgcaaacccattcacaagcaatccaaccttggcactgcatagctaagtttttgtataaggatttagactaccttcctaggaagcaaaaacttaatactcaatttccaattatgtggattcctttttctaaattcttggttttgtgcagtggcacgatcatagctcactgcagcctaaaactcctgggctcaagcaatcctcctgcctcaatttcctgagtagctaggacaacaggcacatgccaccaggcctggctaattttttcatttttgtagagatggggtcttgctatgttgctcaggcttgtcttgaactcctgggctcaagcaatccactcgcttcggtctcccaaaatactgggattacaagcatgagccaatgcacccagctgtttctgttacttttaaataggtttcctgcatttcttttttttttttttttttttgagacggagtcttgctcttttgcccaggctggagtgcagtggcacaatctcggctcactgcaagctccgcctcccaggttcatgccattctcctgcctcagcctccatagtagctgggactacaggcgcccaccaccacgcccagctaattttttgtatttttagtagagacggggtttcaccgagttagccaggatggtctcaatctcctgaccttgtgatccgcccacctctgcctcccaaagtgctgagattacaggcgtcagccactgcgcccggccaggtttcctgcatttctaatgaagaaataggctggtcctcaattttgcagaagttgtatcatcataggtcatacctaacattcgtttgtcaagagcaaaaaaacccccttgggttctctggatctcacacagcccacaaaccttcagaatgtggttccttcccgcaggctttgtcacacttaagatccaagaacaaatcagcctggctttaacatggggtagatggcaagaaggataatggctaatagaaggttttagtccttgtattagtccccatgttacagatgacaaagctgagtaacagagagagtatcctaaccaagttcatcaagctagacaccatgagacagtattctgtgatgctgatagaacattggtgaccaggctgtgaatgggttagtcctaacacagctgtgcttagaaagtaaaataagagaagaatgcttaggatagcaaggctgatggatccaactaacaacttacacaaaggtctctgttggctcaaaaagttctagttgtgtctctctcgattctgccagtttctgcccttgaaaagtaacacttaaggaacactttaaatagtgatgaacttttccctgactcttaaaaccatggacccacattttcatacacccaataaaatgttatttgtccctcttctgaacttccagttctgaatacatatggcatttcattcattcattcaacattcacgaaggaggtatgtaccaggcaatggggacacaaaagtgaataagatatggtcccatcctagcctcgaggagcacacagacaaataaaaagccaattcctcatacaaggctgtaagagctaagctaaatggaagacaggatgctacagaaggctgcctcactcagactgaaggaaggagtgttttctggaagaaaggattcccccagctgagtaaggaaggatacacaggaggcagtcagatgaagaatcaagggagcaagggaagaaatagtggcttttcaggctgcagcacatgccactccctggccgcgagaaagagtgacgaatctgtagatctggaagtagatcaaggtggctgaggttcaaggacgtgagaaatggtaatggtaagagactggactgggaagagtgctggtgaccagaaaatataggatcacatacatcgagtgtttctgcagaatgagtgtataacagagaatggattttgttattttcctcataacactgtcacaagaataggcaaattttttcggtgaagggccacacagcaagtattctgcgctctgtgggtcacacgctatcactctcctttttcttatatccctttaaaaatgcagaacccattcttagctccaggccacagtttagcaacctctgttctgctgtgacttcttatttagtgtctgcctttactgtgaagactgagctctctgaaggcaaatactgttaccactgtatcctcagtgtctagcacagggcctgacacttaaggggcactcaaataattacctttttgaacccaggagagaaatgacaaggatctgcattaagtgggcataaagaagggggaagattcaagagatagttagaaggtaaaacttaaagagcatggtaactgattagcaggaggtaagaaggaacgagtcaaaaagaacttactacatgttttatctaatcacaattacttgtatgtttcttatcctattagaatataagtgccttaaaagagagaatcacatccttaacactgtgtctagcactgtactgtgcacatagtgggtattcaacttaataactttttgaataaaattcccattatcttaacctttttttcataaacatcaaagtttttcaacaactaagaaattttcttgaggaaagcagatatagttggccctcagtatccatggattcaaccaacagccgatgtaaaatatttggaaaaaagacaaaaataatgataaaataataaaaacaaaaaccaatacaacaacaatttacatagcattataactagagatgattaaaagtatacgagaggatgtgcattttttatatgtagtactgtgctattttatttcagggacttgaggatcttcagattttggtatcctgggggaggtgagagtgagttctggaaccaatccactgcagatactgagggatggctatactatcttttggtactgatatagaaaacataatgattaaaaaacataatgattaaaaaattcctggaccttcccaacatgcaatggtttatagatttatgtaaaaccaaatctgaaactagccctgtaactcagaaagcttggcttacaattgtttaaattccaaaaaaagatttcataaatgatactgaattatccacatcccattcctaatcctttagaaaaccgaaaactaagcccgagtgtttccagctgaaacaataaaaataaagcaaagaggtcccatttttaccacatctttatagcctaagagttaggatgcaagtttcagcaatgagtttcaacttcaaaagacaaaaacgaaaaacttttaagcatccaaacaagcagacacagcaagaggaaaaaaaattctctgaaggcgacaatctacaattactcacagagctgcagcaccagagataatttcaatcaactcttttgtgatgacagcttggcgggtacggttgaatgtcaatgtcaatttgtcaatcatctcagctacaaacaaaacaaaaacactacataaaaaatctgaaactagagtagaataacttgttaactaacttctgttgcttaatttaaaagtaagaaatttttggataccaaaattggcctctcaaataatgttatgaagatatttttacatcttccataggataccttttcacagtacttgcaaatcaactacctatcaagatatactttcttacaggtacaggaatatcatgttaatgttgttgatgctactctcggccacggactcctctcagctgagattcactgtgtgctcacaagcactcctgctggcactgtccatactgtgtacttacaagcattcttgctggcattgtccatggctgtcatcctggcactctgctcactagtggtggactccttcagagagtagtagatgatgttggccagattgtattcttggtaattttgcagcacgtcagcatcaatatcgtcatagatactcatgctgtctgttaaaacaagtgatgagtttctttcaagttatatagaaggaatagtaattcatcaaaaacagcttttcagtgtaaaactcctttataattacagagcagaaattaatgctagataaggtaaatgaatctgttctaataatgtcatctatttccacactacagatgatagcatatttttagcaaaatataatgtgtaaataaaccatttgatattctactccacatgtgtaactttagaaaaattaggtcaacatttgaaataactgcactatatctcgtggttatgaagccctctggacagcattagcatgtgcctgttacaaagccagcaagcactcaatgctttttccagtaaaaaagataataatgaattgaaacgaatttagtgtaatacaggttgagcatccctaatcccaaagtccaaaatctgaagtgctccaaaatctgaaacattttgagactgacgtgatgcacaagtggaaaattccacacctgaccttgtgtgatggggtgcatttgaaactttgtttcatgcagaaaattctttaaaatattgcataaaattgccttcaggctatgtgtatagggtgtacagactcaggtcctgtccccaagatactgcattataaatatgaaaatattctgaaatcccaaacatttctggtcctaagcattcacacaagggatactcaacctgtgcagtaattccaacttagtcatttgattactgaagaaatctgaatgtatcaatctggaaaatgagagagggaaaacctttcaaagcacatgaaagagtgggagaactagaaattggtatgaatcgtagttttaatgttgtagaaatttagaagtacatttcaaaattcattcattggggtcaagtggtgacacagtactatatattatcaaaatactatatttcattaaatggtactggttgtaacacctactttatttctcattaagagagaaaaaaatgtactcaattataaatgatgttccattggctggtagagccatctcaatttcagaaacattaacgtgtaaagtacatacttgaaaataaatgaagtattagaaaatagatggtatatacaagggaaaaaagccttagaaaactaaaatcagttccagaatattattccaggatgcttcaatgatcaatgatgactttattccaacaataaaacaagagaattgagtcaatgtaaattagctgtgaacactgttcaactctctattctagagcttctgttttattgtagttagaggtcccaaacataaattgcaaagccagtttctagctacgctcttcaatccttgaggacaaaaaaatctaatgatgaacctcaatagatactgacttttcaattaatgacagaatagagcaggagttatcaaacaatgactgaattaagtatcatggaagtcaagagatggcacttctcagaaacagccccagatcggccgggtgcagtggctcatgcctgtaatcccagcactttggaaggccaaggcaggtggatcacttgagggcaggagttcaagaccagcctggcgaacacggtgaaacgctgtctctactaaaaatacaaaaattagccaggcgtggtggcgtgcacctgtaatcccagctacttgggaggctgaggcaggagaacggcatgaacccgggaggcgaaggttgcagtgagccgagatcatgccattgcacttcagcctgggtgacacagtgagactccgtctcaaaaaaaaaaaaaaaaaaaaataaaaggctgggctcatgcctgtaatcccagcactttgggaggccgaggcgggtggatcacgaggacaggagattgagaccatcctggctaacatggtgaaaccccgtctctactaaaaatacaaaaaattagccaggcttggtggcgggtgctgtagtcccaggtactagggaggctgaggcaggagaatggtgtgaacccaggaggcggaacttgcagtgagccgagatggtgccactgcactccagcctgggaggcagcaagattccatctaaaaaagaaacagccccaaatcatttgctatagctaccaccagatatcttgacactgtctgccttagtgtacaaatctctccattctatatgccaaaaaatatgtatcatagaaaaactacttaccagcacttgcaacggtattaagggaaaagatgggcttttcttctgtcttataggagatgacagacctagaattgacaaaaacaaatgtaaatctcaaaataatttttaaactgttatttcaaaatatgaacaaaagcatgaacataaaaaagctttgatttctaaatctgtcttgcctgaatttattaaagatgatggagccttcatcaaattcatatccagaatttagtaattcaagggcaatgactgacgcatctccaaaagtggggggctttcttcccacttctttgaatgccaccagaaactggtcagaatgagtcctataagaaaagcaagagctcacatagctagtttaataagatttctgctgaaagagcacaggggacaggcaggagaaaacattgtcaccatggatcaggtcttttggggtatgggtggtggtgatttcctgagttgttccacacactatcataattcctttccttcagcacctgcaaagaactaagaactaaaaatgaggtctgttttatattcttttcccctttattcctctccttctaatcctaatgaactattgctaacatttccaggctgtaacagctcctcagatgcctcatttggcttaatgctgatagcttttgatattcacatggcattcaacttatgatccggatgaagaagcaaaggtagaaaacaggggaaggaaaacagaaatgttccaatatatcctggaaaaaagaaaaaggaaacaaacacccccttgtgaatataccaaaaaaggccctgaagaatataccttgttattgatgaaggttttgagagtttgtcaaaacttttgagagaagatttattcgtgcttacatctttatgaaaataaacaatatatatttaaattacctataaagtatgcctctgattttgtcaccaattccaacaagcataacttctttcccagctgctgttagtgtagcaacctcgcttttcatctgtttagcaatggaggaatgaatagcaccacacagtcctcgatctgaggacacaccaataaggaggtgtttcttcttgtcttcaggccccttgatatcagctttttcatacagagcttaaaaacaaacaaaagcagtaatttttttatatgcaatacactaaatacaataaatctctaatttacaaagcagttggttatttccaaaatacgcatttaaatttagctggcaactgcctagtgtaagcaggtgttcttaggacagctgtaagctgaggccgggcacagtggctcacgcctgtaatcccagcactttgggaggccgaggtgggcggatcacctgaggtcaggagtttgagaccggcctggccaacgtagtgaaatcccgtctctattaaaaatataaaaattggctgggcacggtggctcacgtctgtaatcccagcactttgggaggccaaggcgggcggatcacgaggtcacgatatcaagaccacggtgaaaccccgtctctactaaaaaatacaaaaaaattagccaggcgtggtggcgggcgcctgtagccccagctacttgggaggctgaggcaggagaatggcgtgaacccgggaggcagagcttgcagcaagctgagattatgccactgcactccatcccgggagacagagctagactccgactcagaaaaaaaaaatacaaaaattagccaggtgtgatggtgggggcctgttaatcccagctactggggaggctgaggcaggagaatcgcttgagcctgggagggggaggttgtagtgagctgagattgcaccattgcactctagcctgggcaacagaatgagactccatctcaaaaaaaaacacaaaaagaaaacaaacaaaaaacaacaacaaaacacacacacacacataaaaaaacaaaggacagctgtcagttgagatactgaggatttggtagataaatagggggttcactgcatgatcttctttactatcaaatatgcataaatcttccttaagttaaaaattcttttagatagcctcaactcaggataagacagcatgatcataaaaaagttaagagaaagaatgtaattacaagttaaaatagaaacttctttcccatttccagctctttacaactttatttccaagataaattcataatcaaacaagtataaagcatctaaaaacacaatataaattctttttaaactgtcatatctcatctcttttccattaagaagactaattaaggatggattacataaatttctgaaggaaaaatgtcttcatgcttttgaaaagataagaatggtgattaactatcttgaaaatggaggttctcagctgcttttcctgcttcaacatcgttcggattctcaaaacaccatcatgagtcatatccatgaccacaaggccagctctccactgcactgcccctcacccgcccccgctgcagtcctaaaatgccacactacaaggtcataggatgaaattaagcccttacatctaacgcacggtttccaagttcttctgatggtatacttaacaactgggaacatttcagaatattttaaaagttaacatggtcacggtataatggctaacaaatacacagactcgacaccaaaccacataggtccaaacagaggctcttcatccttttatatgtgatcttaggcaagttacttaacttctgtgtgcttcagtttttctcactggaaagcagggattctaacagtccctacctgtactacctacacgggttgttatcattacgtgtcaagtggatgtagatgaaaaataagtacatggcaagtgctcagataggcttgacatcactgtaagctctaaatgtaagtcatcagtagtcttccttgtgtgaaacagttcttcctaatttgtgaattacactcttcccttacctaaagatcccaatccatatattcgagctggtttcagctctctctcagctcgggcatattttgctgccgctaccattttcatagacttggtaattttctggatgtttttgatggactttagtctcctggtgactgaaaaatagaagtactgtgttaagacaaaggaattacagtataacttccttgtgaatttattgacatatttttctaaagtgcaaggcagaataatgagcgcttagataaacaataaacagcacgatgctaaaccagtcttaatattagaactagtactaatagccgggcgcggtggctcacgcctgtaatcccagcactttgggaggctgaggtgggcggatcatgaggtcaggagatcaagaccatcttggctaacacggtgaaaccccgtctccactaaaaatacaaaaaattagccgagcgtggtggcgggcgcctgtagtcccagctactcgggaggctgaggcaggagaacggctgaggcaggagaacggcgtgaacccgggaggcggagcttgcagtgagccgagatggcgccactgcactccagcctgggtgatagaatgaggctccatctccaaaaaaaaaaaaaaagaaatagtactaataaaaggaaggcaaaactagctactacttaggacaagcaaatggcaacataagacaataatatacaatttaaaacattaaatggtattgaaagttgccttaaccacatattccataacattatttatatataacatgatttaccccttcccacacatacacccacctacaccaacactggtataattttttctagttatatcatgatcattctacaaacaacagaacatagctgtctcaggtgtcctttcttactggtcttttcagaacaagtccaatgtcccaaacatacaatggaaatccatttggtcagttttgatcaaatacacaacgggctaaagcagtatatttttgaaagtatttgtatttgtcaaaatttagtttttctcaattcacatattgagacaaacaacatacttactatctttcaaagttgccatatttcgaacttgaatcctgaggataaaagttttaaaaatgtttcagttttttgaaaaatagttccattatacaagaaaaactttcagttaatatatatttatttaaagaataccccataaagaaacaatctatcaaatacaggactcagaatgtatatgaatagacatatatttaaatcccttagtagtggcgcgaatccctgtattgaaggcctccttttatttggcctgtctgtaccaccaccttcccagaagtcaacatgctctattgactcacacatgctctagtcccacctccatatctttgcttatcttgtttccatgacagaaaagcccctccccttgttaagctgcccaactatacttcgaatcaaggccagccactctaaaaatttccttagttcacagcaacctcttccagtaacagagtcaatgatatagtcgaacatgactacacgtgtaaaagtagtttatataaactgattcttaactttttcaatttagctcaataaacatttaccaagatgctctaaattccaggcactggtaaacacgacatggtctctgacatattgttaccttgtaaacaaggttcataaaaaattacatttacataacatttagtattttttttcaagtctttaaaattgaaatgctaatgtgcagaagtcaaaatgattaggcttaaatgaaatgttggtgaaagatgaatatgagagaattcctggcctaatgggggaagacatgctaaaaaatattagatgatctttctgccttcaaatccatacaaagtgcctgtgtttgcaggcaaagctacacaggagaactgagcatgatgaaatgtgtgcacaaagtagagatgtgaggaggggattctcgggaacagaatgtcattttaagagcattcatgttcaggaaagagtgagaaatggagaaggggaaactggacacatgagttgggtttgttactttaaataattaatatttttaaatatcaaaaaaagcaaattggtttaaatcttatttgtaggttaatagggaaatgaatgtttataagcccacaaatcagtttagtatttcagcaaagtatctcacatggcagtgacaagcgtaaaatgaggttggagttttgatgaacacagaagacatggggatgtaggctgccacagcctcaggagagacctcaagaacctggatgaagatgctggcaaagcaataggagactagatttgcaagcatttaacttcttcacatgtacattcgtagtagaaaggaaagcagtaagaatgatctaaggtttctctaattgaatgaccttggtggacagtgactaatatctctcatgagcataggttagaggcaaaaatcctcaacagtgtattagcaaatcaaatccaacaatgtattaaaaataattatacaccatcactacgtgggatttactccaggtatgcaaagctggttcaatattaaaaaatcaaataatataatctattacgtcaacaggttaaagaaaaaatcatacaatcaataggtgcagaaaaagcatccaacaaaatctaacacccagtcatgataaagtctctcagcaaactaggaatagagaacttcctcaacctgctaaaaaaaaaaaacaacacacaaaatctctgatttaatcccagaggctaggagctttccccataagattgcgaacaagataaggaaatccccactcatcactcttcttcagtatcatactggaagtcttagctaatgcagtaagacaagaaaataagaggcatagaaatttgaagggaaggaataaaactgtttttgttcatagatgacatgattatctatgtagaaaatcccaaagaataaaaatagcccctcctagaaccaataagcatttatgacaaggttgcaggatataaggttagtgtatataaaaagctagttgcattcctctgcagcagccctgaactactggagtatgaagttaaaaatgcccgcacacaattgtatggttaaaatgataaacttcatgttccatgtgttttacaattttaaaaatccattagaatctcagcaagtttgattttagttgatatctattttgtggatatcaataaactgattttcaaggttatataggaaggccaaagacctagaaaagtcaaacaatattgtcaggactgacactacctgacgttaagacctcctctaaagttacagtaataaaaaagcaaaagcaattcaaggaaaaaaggatattcttttcaacaaacaaatggcactggaacaactggacactaatatgcaaaaatattaatctgtacaatgactttacaaatttaataaaaattaacttaaaatgaatcacaggcctaaatataaaatgccaaaccataaaacttctacaagataccacaggagacaatccaggtgccttgggtttggcaatgagtttttaaacacaacaccaaaagcatgatccatgacagaaaaaaatgagttgggctttattgaaatttagaacttctgtcctgtgaaaaatactgtgaagagaatgaaaagtcaatccacaggctgggagaaaatatttctaaaactcatctctgataaaggacttgtatccaaaacaaacaactcttaaaatgcaataagagaacaaacaacccaaataaaaaaaatgggcaaaagatctggaaacttcaccaaagaagatcaacagatggcagggccggtgcggtggctcacgcctataatcccagcactttgggaggccgaggcaggcggatcacgaggtcaggagttccgagaccagcctgaccaacatggtgaaaccccgtctctactaaaaatacaaaaaattagccaggcgtgctggtgggcacctgtaatcccagctactcaggaggctgaggcagaagaatcgcttgaacccaggaggtggaggttgtggtgagcagagatcgtgccattgcattccacctggatgacagagcaagactctgtctcaaaaaacaaaaacaaaaaccaaccagatggcaaaaagcacataagatgatgctcagtatcatgtcattagagaactgcaagttaaaacagtaagatatcactacacacctgcaagaatggataaaacccaagaaactgaccagcaaatgatgatgaggatgtggagcaaaaggaactctcattgatggctggcagaatgtaaaatagtacacagccacttgggaagatgttctggtagctttttacaaacctaaacctagtcttaacttacccaactgagatgaaatgttatgtccacataaaacctacacaagagcatgtaaagcagcttcattcatgatgccaaaagttggaagcaacccagatgtccttcaatacatgaatggataatctaactctgatacatccatacaatggactattattcaccaaaaccacaaaggagctattaagttataaaaaggcatggagaaaccttaagtgcatactgctaagggagagaaggccatctgaaaaaaagcaaatactgtatgattctggctatgtgacatgccagaaaagccgaggatctagcaatagttgagagaagtggttgtcagggttttggggagagtagaggagggatttttagggcagtgaagctctttggcatgatattgtaatggtggatacatgtcattatgcatttgtccaaatccgtggaactgtataacaaaaagagtggatctttgttttttgcggtttgaagacagggtctcactcccctcacccaggctatagtgcagtggtgtgatcatggcttcctgcagtctcaacttcctgggctcaggtgattctcccactacagcacgaaaaatattaggtttggttttaagaatgaatctactaaaggaaaagataaaagctggcaaatcctgacaagctctgttatttcagagcacaaactacctgccatgactgttctactacaacagcttttcataatcacacttgaaaagtaataccagtttttggtcaaaccttccttttttggtgtagtaatgacttttctccctgaacacaaaatttattggttataacaagtcactcttggatattattgttttaggcagacacttcaactgacacaagtttctagtcagagaataccatatggtataaatttgaattgaataccatatttggacaaacacagaatgttttggtttccttaagtactccaagtcagaggtatgaagaggtagcatcttttgtgataatgctacgcatttgccctaatttcatgtgttttaaagcactctcatgtttagctttcatttaattctgaagacgtctatgttactactttaattgttaggtacaatttgagtaagaacagtgatgagctaattgaactctctttagggatagcttcctttattaaatataaaagttttgcaaatgaggagataaagctctgaatcattgcacgtcctgagatcctcgggagactaagaaacacagtggagggagaatcaaatggaccgtggattaccactatctaccatgattccacagcgctgttataacagctgacgaaggcagtggaggagggagtcaggaatgacacccttccaagaaactattgtttgagagatttttaaggagtatattaagatacataaaaacttaaaaagcaagcaatattggctaattctcaacgaaaattatgaagtgactctaattctgatattaagcgtgtaaaagtccattacctgccaccagcaaaaactgactccttcacacttacctaacccacaccatgactgcatcatctttttttttgtttttgagatggagtctcactgtgtcgccaggctgaaatgcagtggcacgatctcagctcactgcaacctccgcctcccggggttcaagcaattctcctgcctcagcctcccgagtagctgggactacaggtgcgtaccaccacgtctgggtaatttttgtatttttagtacagacagggtttcaccatgttggccagtatggtcttgatctcctgaccttgtgatccgcccgcctcggcctctcaaaatgctgggattacagacgtgagccactgcgcctagcccgactgcatcttcttttcctcttttcgcaagtccaagcaatcttcttacattacatttgatgtagaaactgtacttaaaaactcttcatttctctactgatatacagcatttggatccctatcagcatttctcccattgtcctacatgctttgcaaatactctaatcctcacactaacccactgaattgtgcacttttattgcatatatttgacagatgaggaactggtgggacagacactgagtaacctgcccaaggtcacagagctgctaagtggcaatcagaattcagaaattaaaaccactccacagaattaatttggaaggggaagaaaagacctttgtcttaacgaaccatgaagaggcatatttccatgcttctgtcttgattactggaagttttttaaagtacaatttgttattttagtttttgttttcagagaggctaccatgctaacataaaaacattaggcttacttaaattcacagtggttattttaatagttgttagggtatcggcaaaatactctaacgttttgaaaattaaacctttttttaaagcagcatataagaaaatggaaattaaaaatttgagagaagatcccggattttactgtcttcaaatttggaaaacatttctatttcttagagttcagtagtctctaaaatggaactgttttttaataacgtgtcagtagtcataaactacagataccgataaggagatggcatttcaggagagaaaagacaaattgtcatctgagaccatgagggcagatatttactaataaatgtaaaaaatgtgaggcagcagagtgtagtactgtatgaagagagagactctgtagccagtgaagggctgcattcagacggcagggattgaattcttccagattccgtcaagcttcaaaactgaacagcaccacccacaaaccaacttttacctgcccattcccgggccttctaatatgcacttcccccagcccaggtccccctacccggaactaatgtttaaaattctcgaggctcgtggcaccctttagttgcatgtcagttaacaaatgccacttaaaagcccaccgaactcctcccccaggacctgggggcaatttcatgaccttgcagggttacggtttcagcaagtggtttcaaggtagtgctaggtgtccttcccttccccgccctcagacagatctgtacggtcccttctgcaccaaaaccaccctcagaggcatctaggatgttcgcctttgctgttgcagcacccagcaaagcgtctgcaacacgggaggtgctcgacggccgcgctctctgactcgatcgaatcttaaagggtcactctgtccagcactagagggtttcaaagggcgtcaaggacaaaaagcacgacttaaccttcccctgggctattgctcaggctcccgtcaccttgcaggccctgagactgggggcctggcttgcagtggaagtggaagctcaggaagtgctgattagctgagggaactcaagaccgcccagacgtcaatttggactcaggccgcagtcccgaggtcccaggtggccctccgacctcagggaaccgggcgggaccttgctccgccggagcccggccctgcgcacaccttgcccgacctcagagccgcttcctgcagccccgcatcccggcgcctccgacggccagggcccagctaggccctgcgaccccagatctgcccccgcgcccatctcctcctccctgccccgtgcccaagctcttccatccttgcggtcctgccgatcttcccgcaagctgccataccattgcggctgcaaggtccaggccgacagcccagcgacacccgcgcgagagaacatggtagccacagccctgctgaaggtcggtcaggcaggcctcagcgcgcatgcgccgaagctccccagcgcgcccctcccaccttgctctcttcttcagtctcgtttcatcgcgctacggcgaggggagtctcgcgaccgttgcaacccagtcttcccaggccccacctccttccgcctctcagctgggatttgtcccgcccaccgccgccagcccggttccgtttccggctggctgagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgaggtgagtgggcccggagtggccccgtcttcccaggagggcccctggcaatccaggatcaggtcctggacgcggggctgagggcgcggggctggggctccggggtccgggtcgtgaggcttctgaggtctgcagtgggcgagtcaactactcagcgcacgagagccgtccctccccgcagcccccgggcccagcgggcagcctgtgttctgcgacccctcattcctccccagtccgatccccaccaccaaagaaatgaaatcagaaaaggttttgcacccctcacagggcggggatactgcaatactagacgcccgggcaatgccagtaacagtcatcagctctgacttgacttgactcttaagagaaacagggtggttaggattcactcctcttttgggatcaggtgaaaaaggagagctaagctcttccacactactcatctagcaagcatttattgagcacctacactgtaccgggcacagaataatattgtggttaaaattatggatttatctggtttatggatatatcagactgtcaaaatttaaagtcaagcagggccacttaccaaccgtgtggtcttgggcaagttatttacttatattcccctttacttatctgtaaagagggaataataatttcacctacttgatggattgtcgctgagttttaaatgagtgaagtatatatagagtggctcaaggagtctgggcagatctcgaaaagccttatatggctacactgtggaatttacacttttccccattaaagaggtggttgattgaatgctgtgcaggctagtgatgtgatcatatttttctccggagattggactggattgggtaagggtggaagaacactgaggcaattggaataatctaatccagtgtttctgcaagtgaaggaagaggtattttaggtaggactcatactaatattgatacagttactctctttagttctattaaggaatacctgtatatgcattatctaatgtcttagtctgcttggactgccatataaagtgcagtagactgggtggtttaaatgacagaaatttatttctcacagttctggaggctgggaagttcaagatcaaggtgctggcatggtcagattctagtgagggtcctcttcttggtttgcgaaactgcctctatcctcacaaagcagatagagcaagctctaatagaaacttctcttcctctttttttttttgagatacggtcccaccctgttcatcatgcaggctctacccttgtgacctcatctaaatccagtcatctccaaaggcccaccttttaattccattcccttgggggttagggttcaatatatgaactttgaggggacgcagacatgcagtctgtaacacccagacttaacactttaagtaattttgccgtatttactttttaaaaaatattttaaggtaaataccaatatcaggatatttcacctttaaatacttaaataggcatctctaaaatttcaggatacttttctatataaccatagtatatgtcatcaacataacacaattaatagaagttcctctttatcatctaatacacattcacacttcctcagttgtcctccaactgctccttgaaatcaagattcgatcaaaagcaatagactgttataggtttggttattaggacctccgctcccctctccagtctccctcatcatcaacatcctgcaacgaggtgttatatttgttaccatggatgaaactacattgacacatcagtatcatccagaatccatagtttacattagggttcactcttggtgttgtacatcctatgggttttgacaaatgcataatgatacgtattcaccattataaaatctcacaaaatagtttaactgcccaaaaagtcctctgtgctctgagttattaggacttttagttttctccaaatttaattttctctatattctgaatttagaatataacccattttccctccacccctttttcttttttttttttttatagacagagtctcacctgtctcacaggctggagtgcagtgatgcgatctcagctcactgcaacctttgctcccgggttcaagtgattctcatgcctcagcctcccaagtagctgtcccagctactttacaggctgggattacagtgcctggcaccacacctggctaatgtttgtatttttggtagaggcgaagttttgccacgttggccaggctggtctcaaactcccgacctcaggtaattcacctgcctcggcctcccaaggtgctgggattacaggtgtgaaccactgcgcccagccttctttttcttgacattgacttgttgaagagaggaggccaggctgttgtcctgtagcatcccatatatgttgacttgtttcctctggttgtcttttgccttctaactcgtagtttctgtcaactggaaattatatctaaaagctttgattgggttagattaaacattttggggagaaagaatactttgtaggtgatcttgatagattaatttcaggttaaacatttgcagggaggaatatgatttttttttttttttttgagacaaggtctcaattggtagcccaggctcgtgtacagtggcgcgatcatggctcactgcaaccttgaccttcccagctcaagcaatcctcctcctgcctcagcctcccaagtagctgggaccacaggtgattgccaccatgcctaattaacttttttatttgtatagagatagggtctcaccatgttgcccaggctggtctcaaactcctgaactcaagcactcctcctgcctcggcctcccaaagtgctaggattacaggctcaagccaccatgcccagcctatagtattctttataggtgatcttgtatatctcatatagcatcatataaggaagccaataatgtttggtagtacttaaattgagtaaaggtgacagcttgtaaataatattagaaagtattattttcccccttgtaagagcaagtgagtattggggtaatacttagaaatcatacctatatatctagtttcccattaaccttttacctgtgtgttttagcatccttgcctgagtcagttattttattaggagttgcaaagaggttatttttctaatttttttttaacatttatgattggctgccatgcttttgtacaaatgagcttttgctcatcaactagggctatttggttatccttaaacttatttttttttgtttttgagacagggtcttactcttgcccagactggagtacagtggctcgatcatagctcacagcatcctccaactcctgggcttaagcaatcctcccgcctcagcctctcaagtagctgggactataggcacataccacccatgcctggctaattttcaaaaaatatcttgtggagctggaggtctcattgtgttgctcaggttggtcttgaactcggaggctcacacaatcctcctgccttggcctcccaaagtgctgggattacaggcatgagccactgtgtctggccatccttaaatgttatactgagatgcaatttttttgggaaaggagtaaaggattaattcttttctgtaatctcctgatactggaaggctgaagagaatgaaggtcagagccagggtatccccccaatctactcctgggtttctaggatttagtaactgtattgtttgttcattttattttattttttaatatatggaaagtgatactgtttatttatgaggctgataccaagtttcttttaaaaataaatttaaataataactatgattcttatagggcacagatgaggcaaaaattgtgtaagaggtccatgatc

SEQ ID NO: 2946 - DNA, 1546 bp, Homo sapiens
ctagaattcagcggccgctgaattctagaactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagagctgcccgaacagactactggctacagcctgaaattattgtgaaaattatagccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttagttgttcagctaaactttgagaagaatttaattatgtctcatgaggtatcaaactatgtaattttgtccttgttatttttgtttcctttgtaatttacttgatgagtttatatcttcattaaagaatgttattataaaaaaaaaaaaaaaaaaaaaaaa

SEQ ID NO: 2947 - DNA, 1178 bp, Homo sapiens
ttttttttttttttttaagaaaaattttttttttattttaagttgtttattttaagataatttacaaatatcttgctgtcttcagtaattcaaataatggaggaacagtttcttcggacaaaggcagcagtaagctaaaaacaaaatcaactggctgaattttccttctttacctcttgtctgaggatggaacttgattttcattaatccagagctgcagcaccagagataatttcaatcaactcttttgtgatgacagcttggcgggtacggttgaatgtcaatgtcaatttgtcaatcatctcagaagcattcttgctggcattgtccatggctgtcatcctggcactctgctcactagtggtggactccttcagagagtagtagatgatgttggccagattgtattcttggtaattttgcagcacgtcagcatcaatatcgtcatagatactcatgctgtcagcacttgcaacggtattaagggaaaagatgggcttttcttctgtcttataggagatgacagacctgaatttattaaagatgatggagccttcatcaaattcatatccagaatttagtaattcaagggcaatgactgacgcatctccaaaagtggggggctttcttcccacttctttgaatgccaccagaaactggtcagaatgagtcctataaagtatgcctctgattttgtcaccaattccaacaagcataacttctttcccagctgctgttagtgtagcaacctcgcttttcatctgtttagcaatggaggaatgaatagcaccacacagtcctcgatctgaggacacaccaataaggaggtgtttcttcttgtcttcaggccccttgatatcagctttttcatacagagctaaagatcccaatccatatattcgagctggtttcagctctctctcagctcgggcatatttttctgccgctaccattttcatagacttggtaattttctggatgtttttgatggactttagtctcctggtgatatctttcaaagttgccatatttcgaacttgaatccattgcggctgcaaggtccaggccgacagcccagcgacacccgcgcgagagaacatggtagccacagccctgctgaaggtcggtcagtcaggcctcagacgcatgcgccgaagctccccagcgcgcccctcccc

SEQ ID NO: 2948 - DNA, 1113 bp, Homo sapiens
tttttattttttttttttattttaagttgtttattttaagataatttacaaatatcttgctgtcttcagtaattcaaataatggaggaacagtttcttcggacaaaggcagcagtaagctaaaaacaaaatcaactggctgaattttccttctttacagagctgcagcaccagagataatttcaatcaactcttttgtgatgacagcttggcgggtacggttgaatgtcaatgtcaatttgtcaatcatctcagaagcattcttgctggcattgtccatggctgtcatcctggcactctgctcactagtggtggactccttcagagagtagtagatgatgttggccagattgtattcttggtaattttgcagcacgtcagcatcaatatcgtcatagatactcatgctgtcagcacttgcaacggtattaagggaaaagatgggcttttcttctgtcttataggagatgacagacctgaatttattaaagatgatggagccttcatcaaattcatatccagaatttagtaattcaagggcaatgactgacgcatctccaaaagtggggggctttcttcccacttctttgaatgccaccagaaactggtcagaatgagtcctataaagtatgcctctgatgttgtcaccaattccaacaagcataacttctttcccagctgctgttagtgtagcaacctcgcttttcatctgtttagcaatggaggaatgaatagcaccacacagtcctcgatctgaggacacaccaataaggaggtgtttcttcttgtcttcaggccccttgatatcagctttttcatacagagctaaagatcccaatccatatattcgagctggtttcagctctctctcagctcgggcatattttgctgccgctaccattttcatagacttggtaattttctggatgtttttgatggactttagtctcctggtgatatctttcaaagttgccatatttcgaacttgaatccattgcggctgcaaggtccaggccgacagcccagcgacacccgcgcgagagaacatggtagccacagccctgctgaaggtcggtcagaggcaggcctcagcgcatgcgccgaagctccccag

SEQ ID NO: 2949 - DNA, 788 bp, Homo sapiens
  misc_feature (1)...(788): n = A,T,C or G
ggggggnacccctnggnnccttnggcccccaannttgntgggnccccnccnagnngggggttnttgggcaaattttngcccccaattttttntcccncggggaaatttttncaggaccngncncgngccaaaaatncccnnaaggtgcnccangcttgtnaccacntttttaccgnggtttttggggaaaaaagnggnntttttcctggcgtctttanggggaggnnacacccctgaatttttttagagntgangggcncttncatcaanntccatnccagaatttgggtaantcangggcaatgactgacgcatctccaaaagtggggggctttcttcccacttctttgaatgccaccagaaactggtcagaatgagcctataaagtatgcctctgattttgtcaccaattccaacaagcataacttctttcccagctgctgttagtgtagcaacctcgcttttcatctgtttagcaatggaggaatgaatagcaccacacagtcctcgatctgaggacacaccaataaggaggtgtttcttcttgtcttcaggccccttgatatcagctttttcatacagagctaaagatcccaatccatatattcgagctggtttcagctctctctcagctcgggcatattttgctgccgctaccattttcatagacttggtaattttctggatgtttttgatggactttagtctcctggtgatatctttcaaagttgccatatttcgaacttgaatccattgcggctgcaaggtccaggccgacagtcccttnt

SEQ ID NO: 2950 - DNA, 972 bp, Homo sapiens
  misc_feature (1)...(972): n = A,T,C or G
caaataatggaggaacgggtttcttcgnacaaanggccagcagtaagctaaaaacaaaatcaaactggctgaatttacccccttcactgcagcgcccagcaccagagataatttcaatcaactctctttgtgatgacagcttggcggggtaccggttgaatgtcaatgtcaatttgtcaatcatctcagaagcattcttgctggcattgtccatggctgtcatcctggcactctgctcacttagtggtggactccttcagagagtagtagatgatgttggccagattgtattcttggtaattttgcagcacgtcagcatcaaatatcgtcatagatactcatgctgtcagcacttgcaacggtattaagggaaaagatgggcttttcttctgtcttataggagatgacagacctgaatttattaaagatgatggagccttcatcaaattcatatccagaatttagtaattcaagggcaatgactggacgcatctccaaaagtggggggctttcttcccacttctttgaatgccaccagaaactggtcagaatgagtcctataaagtatgcctctgattttgtcaccaattccaacaagcataacttctttcccagctgctgttagtgtagcaacctcgcttttcatctgtttagcaatggaggaatgaatagcaccacacagtcctcgatctgaggacacaccaataaggaggtgtttcttcttgtcttcaggccccttgatatcagctttttcatacagagctaaagatcccaatccatatattcgagctggtttcagctttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgccctc

SEQ ID NO: 2951 - DNA, 588 bp, Homo sapiens
attttaagttgtttattttaagataatttacaaatatcttgctgtcttcagtaattcaaataatggaggaacggtttcttcggacaaaggcagcagtaagctaaaaacaaaatcaactggctgaattttccttctttacctcttgtctgaggatggaacttgattttcattaatccagagctgcagcaccagagataatttcaatcaactcttttgtgatgacagcttggcgagtacggttgaatgtcaatgtcaatttgtcattcatctcaagagcattctggctggaattgcccatggctgtcaccctggaactctgcccactagtggtggaccccttcagggagtagtagatgatgttggccagattgaatcctgggtaattttgcagcacgtcagcatcaatatcgtcatagatactcctgctgtaagcacttgcaccggtattaagggagaaaatgggctttcctcccgcctaatagaggatgaacaacctgatttgataaagatggaggggcatccaccaattcctatcgggaatctggtaatccaggggcaagccggacggttctcaaaatgtggggcttc

SEQ ID NO: 2952 - DNA, 522 bp, Homo sapiens
attttaagttgtttattttaagataatttacaaatatcttgctgtcttcagtaattcaaataatggaggaacggtttcttcggacaaaggcagcagtaagctaaaaacaaaatcaactggctgaattttccttctttacctcttgtctgaggatggaacttgattttcattaatccagagctgcagcaccagagataatttcaatcaactcttttgtgatgacagcttggcgggtacggttgaatgtcaatgtcaatttgtcaatcatctcagaagcattcttgctggcattgtccatggctgtcatcctggcactctgctcactagtggtggactccttcagagagtagtagatgatgttggccagattgtattcttggtaattttgcagcacgtcagcatcaatatcgtcatagatactcatgctgtcagcacttggaaacggtattaagggaaaatgggcttctctggctataagagatgccgacctgaatttttaaagatgatggggccctcatcaaa

SEQ ID NO: 2953 - DNA, 424 bp, Homo sapiens
  misc_feature (1)...(424): n = A,T,C or G
atgaaggttggccccanaattgtaatccctgggtaaattttgccagccacgtcaagccatcaaatatcgtccataagatactccatgctgtcagcacttgccaacggtattaagggaaaagatgggcttttcttctgtccttataggagatgacagacctataaagtatgcctctgattttgtcaccaattccaacaagcataacttctttcccagctgctgttagtgtagcaacctcgcttttcatctgtttagcaatggaggaatgaatagcaccacacagtcctcgatctgaggacacaccaataaggaggtgtttcttcttgtcttcaggccccttgatatcagctttttcatacagagctaaagatcccaatccatatattcgagctggtttcagctctctctcagctcgggcatattt

SEQ ID NO: 2954 - DNA, 408 bp, Homo sapiens
  misc_feature (1)...(408): n = A,T,C or G
tctggagacaagctgaaacttgaccagactcatttagagacagtaattccagcaccaggaaaaagaattctagttttaaatngaggctacagaggaaatnaaggtaccctagaatccatcaatgagaagactttttcagctactatcgtcattgaaactgtgtgagctaccacgccttgcctganttgatcttctacaagagttcaaacaaaaancagaccataccaggatgntcacttcaaacatgaggatgggtataagctgacgtcagacacagcagggttgatgggagacctacagaaaatacatataantcatcagacatgaagtccagcacatagtaggtatttgaataaatggcagtgagtggtcatgtccagaaattgaagccaagaagttgagccctgg

SEQ ID NO: 2955 - DNA, 335 bp, Homo sapiens
tagaaaaagggttttgttttttattatgtttattcagtgtagtacattttgctgtaacaagttagaagaaaagtggagatatttcttcacattaatttttatattcttttccatcataggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaaaaaaaaa

SEQ ID NO: 2956 - DNA, 305 bp, Homo sapiens
ttcccacttctttgaatgccacgagaaggtggtcagaatgagtcctataaagtatgcctctgattttgtcaccaattccaacaagcataacttctttcccagctgctgttagtgtagcaaacctcgctttttcatcttgttttgagccaaaggggaggaaatgaaatgagccaccaacaacgagtcctcgatctggaggaacaactacctaataatagggaggtggtttcccctcgtggcccgaaatactttggcatcctactaagtgtcgtacctggcaagggctcgcgtgctacctagctatt

SEQ ID NO: 2957 - DNA, 279 bp, Homo sapiens
ttttttttattttaagttgtttattttaagataatttacaaatatcttgctgtcttcagtaattcaaataatggaggaacggtttcttcggacaaaggcagcagtaagctaaaaacaaaatcaactggctgaattttccttctttacagagctgcagcaccagagataatttcaatcaactcttttgtgatgacagcttggcgggtacggttgaatgtcaatgtcaatttgtcaatcatctcagaagcattcttgctggcattgtccatggctgtcatc

SEQ ID NO: 2958 - DNA, 390 bp, Homo sapiens
tttattataagttgtttattttaagataatttacaaatatcttgctgtcttcagtaattcaaataatggaggaacagtttcttcggacaaaggcagcagtaagctaaaaacaaaatcaactggctgaattttccttctttacctcttgtctgaggatggaactatgattttcattaatccagagctgcagcaccagagataatttcaatcaacctcttttgtgatgacagcctgggcgtgtaccggtgaaatgtaaaggccaattggcaaacaacctcggaagcatcctggctggaatggccaatggcggtaatccgggaactcggccaccaagtggtgaattccttcggggattagtagttaatgttggcacaatggaatcctgggaaa

SEQ ID NO: 2959 - DNA, 367 bp, Homo sapiens
  misc_feature (1)...(367): n = A,T,C or G
tattttaagttgtttattttaagataatttacaaatatcttgctgtcttcagtaattcaaataatggaggaacagtttcttcggacaaaggcagcagtaagctaaaaacaaaatcaactggctgaattttccntcnttaccccctgncngaggatggaacntgnttttcnttaanccngagctgcagcaccngngntaatttcnancnacncctttgggangacancntggcggggacggttgaatgtcnanggcnanttgncnatcaacnccgaaagcattcttgctggcaatgnccnaggccgtcaaccnggnactcttgntcnccagtgggggaccccnnnagngagnangtagatgaagttgg

SEQ ID NO: 2960 - DNA, 296 bp, Homo sapiens
aattttcaatcacctttttgggaagaccactttggcgggaccggtggaaggcaaaggcaaattggcaaatatttctaaaacattttttgggggctttggccagggtgtgatcccgggactctggtctctattggggggctcctttacagagaaataaatgatgtgggccacattgtattcttggtgattttgcggcacgtcagcatcaatatcgtcatagatactcatgctgtcagcacttgcaacgcggttaagggaaaagatgggcttttcttctgtcttataagagatgacag

SEQ ID NO: 2961 - DNA, 319 bp, Homo sapiens
  misc_feature (1)...(319): n = A,T,C or G
gggtggggngtcatgcnctcgcccccccggnagcagggggtntcagcttgtcgagtcctgggcacctcggnnggaggaacagtnncttcggacaaaggcagcagnaancnaaaaacaaaatcaactggctgaattttccttctttacctcttgtctgaggatggaacttgattttcattaatccagagctgcagcaccagagataatttcaatcaactcttttgtgatgacagcttggcggcgtacggttgaatgtcaatgtcaatttgtcaatcatctcagaagcattcttgctggcattgtccatggctgtcatcct

SEQ ID NO: 2962 - DNA, 332 bp, Homo sapiens
attttaagttgtttattttaagataatttacaaatatcttgctgtcttcagtaattcaaataatggaggaacagtttcttcggacaaaggcagcagtaagctaaaaacaaaatcaactggctgaattttccttctttacctcttgtctgaggatggaacttgattttcattaatccagagctgcagcaccagagataatttcaatcaactcttttgtgatgacagcttggcgggtacgggtgaatgtcaatgtccatttgtcaatcatctcagaagcattctttcttgcattggccatggctgcatcctggcctctggtccacctaagggga

SEQ ID NO: 2963 - DNA, 245 bp, Homo sapiens
ttgtgaagacagcttgttgggcacggctgaatgtccatggctatttctctattatctcataagcattcttgctggcattgtccatgggtgtcattctggcactctgctcactagaggtggactccttcatagagtagtatatgatgttggccagatagcattcttggtaatattgcagcacgtcagcatcaatatcgctatttattctcatgctgtcagctcttgccacggtattaatgtgaaag

SEQ ID NO: 2964 - DNA, 222 bp, Homo sapiens
  misc_feature (1)...(222): n = A,T,C or G
tgcctcgtgattntgtcaccaaattccaacaatgcntaacnttcantcccanctgctgttagtgtagcaacctcgcttttcatcntgntntagcaatggaggaatgnactagcaccacacagtcctcgatatgaggaaacaccaataaggaggtgtntcttcttgtcttcaggncccttgatnncagnttttccatanaggnttaangatccaaatacatat

SEQ ID NO: 2965 - DNA, 135 bp, Homo sapiens
aatccagagctgcagcaccagagataatttcaatctgctcttttgtgatgacagcttggcgtgtacggttggatgtcaatgtcaatttgtcaatcatctcaggagcaatcttgctggcattgaccatggctgttc

SEQ ID NO: 2966 - DNA, 13 bp, Homo sapiens
tgaacgcatctcc

SEQ ID NO: 2967 - DNA, 2816 bp, Homo sapiens
tttttttttttttttttttttttttttttctgctagaaatgagtttattacagagagaggagacagggctccgacaggacgcacacacacggcactcatgctcctaaaacactgggtttgtgaagggacattataaaaatgaggaaataagctgtgatgttcagcatgtgtcagtttctaggaatacagagaaggggagagctgcaaggtggagcgattctgagggctgaaaatccctttcccagtacgaagacagcatccttcaatcccgccagctcatgtgcatctgagggtggggctctgtcttcatgctagaaaccaaactgctctcacagcttcctgctaaatcaccacggctaacggataagcagagacggactatccagtctgactactgagcactcaagtcgtcagtccagtggctacccgggaacgggggcagacagtgtgcgtgcacgtctacggggctggacagagtgtggttaaccggggaactgggcaagccggcgccgagcctgcgtcagccgtgcaagccgctccttcaggaacttccgcttgtcgctggtgtcgctccgctccttcaggagccagctgtaggtgtccttgtcctgcaggagctgcagcatggccttctgaagctgctggccgtacgtctggagcatgaagaactggatgatcaaagggatgtggctggagatgcgcttgctggcctcctggtgataggccatcaggtgctgaaagatctcctccatggaagagtctgttgccgagctggattggaaagccccaaaatcccaggatttcttcttcttttcttcttccagctccttctctctgaccttctgcaatgcacccctgtatacctggtcctggcagtagacaatctgttccatctggaagtggaggcggatcagcttctcaccttctctctcttgttctgctctaatgtcttcaattttggacttggcggttctgtggaggttaaaaaactcttcaaaattttttatcgaaacatctgtgaaagcaagccggaccatatccgtcacggtgtgtagcatatccacagccggctcttccagtgccttgatttgctgtttcacgattgtctcaaatgtcctgtaattcacaaagcctggcagctctctaccacgatactgattttcaaatttctggatttttctactcaaaattttatggccttcttgaaaattgttttcaattattgtactccatttgtggaactcgtgtcggagtctggtaaacagccgaatgtcttcctcccctacagtttcctctccttgcatgagagcagtgatgtcctgattaaaggcattaattttatctatcaggaagaacattttttcattttcgtcttccggtatgtcgacaccatacttttgtagctcctctgttattctctggtgagtctccttgatttgattttctaacaggggcagagatttacagatatgtgtgatgagctcgctggtaagtttttctgccaggcagggaaccgtggcctttccttcctccagcagatccctgaaatatgggtggttctcaaagaagatcttctctctctgcagggcttcggacaggctcagctggtcctggatctcctgctggccccggcacttgacaatcatgtaacccttcttcaggtggaacacgaggttccgcaccacgtccacaaccttgtcttcagttcctttgtccaccagatcaggcttcgtcaagattccgatggtcctgtctccctcggggtccacctcctgggccatgctgagagcctctgtggtggcgatgtccacattactggggaccaccaccaggctgattgtctcctgcctctggatgtacttcttgatgagtgtcttgatcttatacccaatgtcagcaggctgattgcccacagccactctggttatgccaggaaggtctattagagtcagatccgggacatctcgggagctgatctccagggtgattagctcatgactgattcccattccttccccggcgatggcattctgggctttattaatttccttttctacctctgaagcatccgaaatctcaatctcgtagtcctggtaactgaccttgcctctccacttatcttcgttcacaagtttcttcagtttcagcaccagcgggcatctggtcacgatcccgctgcctctgggaagggcaactcctgacagtgcctccaacacggagctcttgcccgagctctggtccccgatgacggcgatggctggcagggccaggtcctgctccacacctagagcccgcagggagtcaatgaggtcgatgcaggggcgcaccttctcctcatactggctgcacaggttgttctcagccaccgagcctggatttttctgggccacagtagcatctccattcagtaatagagggtgggatgcagcagctggatcagcttttgcgatgtccacttcggaaacaaccatcttccttctttgcaaagtaagctctaatatacgttccttcaaataaaagtaatgtcaacaagttaaatggtatcacagagctgttctcctgcacctccttggaatggtggctggatggcggcgttcttcactccagatttcagggagtgggagtcttcctgtagcctccgacccagaaccgatctcctcgcagtgtggccacagaattccaaagcccctgagctgggtgagcaggtgggcggcaagggcgcgagggaggcgtgtccaccgtgacactgggattcctggccggcaactgcggtccaaggcggtccctgcgcagtgctggagtgcggcctccgctct

SEQ ID NO: 2968 - DNA, 3380 bp, Homo sapiens
  misc_feature (1)...(3380): n = A,T,C or G
tttttttttttttttttttttttttttttttttaaaaagtttctttgctttattaaattcctcttcaagacttaacagaacaatggaagctcatcataatcagggaaacaagaagaaaagagaatcactcaggctcctttctggcgggggagtggagaggctgggaaacacaatgacagtgaaccatgggaagcagggggcatggccactggatctgaaagggaccggctaacagtcactaaatgtccaaggcctgggcttgagcaatagcctcaggtatctccatcacttacacagcactcattcgttcagtgagatgtcatttattaagcagttacaatgctgcaggtgctgtgcaggagactggacatacaaaagaagaatttgacccagaccttccccctctggggtctcataatcttgtagggggaagggaatacaaatacaaattagcgaagaatgatagcagtatcttaggacactgtaactgtgtgctacgggacccaaggactggagagccatcccttcgtgaaggtcagggaagagctgggtggtggagagagctgagcctgtgtggacccctgatgcatgctctgatgctgagggagtacagtagagatggacactgatagtgacagaagagtttggccccaaagcagaagcggcatcctgcaccgactccccttagaatgaatgagtacgcacaagaaaacaaccacaggcatcgccgcccttcagtggatctctttgctggagaattgacagagtgcgtgtcgcgcctgagtgagccggtaaattctctccttaaggattcttctcttggtagcggtctcactctgctcttgaagcagccaggaatagcgatttttttcctgtagtatctgcatcatggctttctgcaaggagtcaccattctctcggagcataaaatactgaattataaatgggatctggttggcgagacgtttgctggtttccaagaagtaggcattcaggtggatgcctatttcagtaaaggaggaaaccgaagactcattactgggaaaatgagagttcaacttcatattctgtgaaggcgtccccagagggttaaaaatctcttctcggactttcttcagaacaacactgtaaatctgatcttgacaaaaaaccatctgctccattctgaactgaagttggatcatgttttctgcctttgctgtgtgtttcacttttatgtcttcaatcgtgctctgaacagtttggttaaggttgaaaaattcgccaaaatgttttttggccacgttaatgaaagcttgctggataatttccatggctttctggagcatgctaagggcgggctccaccagctgctggatgtactgatgcacgatgatctcaaatgtcttgtagttgacaaatcccagaagctccttgcctcgatactgcttttcatatttttcaacttcttcgtggataatatttttaactttttgggtattagttgcaagtatgcctacccagtttttaaaatcctctctgattttgttgtataaacgggtctcattctcccttacaacttcttctccttctactaacttttcgatgtcctgattaaacatcttgattttctcaattagaaagaacatcttgtcggcctcctggctggggatgtcagccccgcaacgccgcagctcctcggtcgccttctggtggctctcccttatttgtccttctaacaacgggagcgatttttggatatgcatgatgagttcagtggtaagtctttctgccagtcggggaaccgtggctgacccctcctccaggagaactctgaaatatggatgtgtttgaaagaatgtaatttctttcttggttgcctctgccaagctcagcctgtttgtgatctcctgctggccccggcacttcacaatcatgtagcccttcttgagggggtacgtgaggttccgcaccacattcatgacgcttttctcagtgcccctgtccattagatctggtttggtcaggataccgatggtcctgtccccttccgggtccacctcatgggccatgctcagcgcctccgtggtggcaatgtccacgttacagggaaccaccaccaagttgatcgtctgctgcctctggatgtacttcttgatgagagccttgatctgcagtccgatgtctcggggctggttgtccacagccaccctggtgatgccgggaaggtcaatgatggtcaggtctggaacctcaggggaggtgatctccaggctgatgagctcatggctgatgccccggccattcccggccatgacgttctgggctttgtgtatctctttctccacctggccagggtcctgaagctctagctcggtgttccggtagctgatccttccggcccatgcctcacagggctgctttttcagtttcagcaccagcggacacctggttacgattccgctgcctctgggaagcgcgactcctgacagtgcctccagcacagagctcttgcccgagctctggtccccgatgacggcgatggctggcagggccaggtcctgctccacacccagagcccgcagggagtcgatgaggtcaatgcaggggcgcaccttctgctcgtactggctgtacaggttgttctcgggccccattgcccttggttggctcctgtttcctggtggtggctgattgttcaaagtgagaaagttgaagtccttggcgaggaaagcagcgtccttctctgccccctgccagtttggaggaaacatcatttgtggtggcactgtgccgaatggcggtggctgttgctggaaggaattcatttcttttttcaggtattttcgagaagaaaattgacttctcctccggtagggccaaggcttgtgggccttagacatgtgctgtctccctgtcagagctgggggatgctttctctgctacttggcacctccgatcttcctgacaagctcgctgcacgttcaggatggagaaatcatctctttctccgctcatgaaatactgttatacaaacaatagaaccatttgcaagagaaatatgcatgaagaaaaatgtccacgtgcaggaaggcaagactgtttagttgccacggaagtggtcatcgccgtttgctgaaacagagctcatgggaaacttttctctccgaacaaccccacaccgccccactccaacggtgccacgggagggcccctttccttacatggtgccaatgcacccccatgctggcccgaggaccgtcatcgtactttgggggctcctagcgatacaatctcaggattcagctcctctcctgtcccatttcctctgctcgtcacagctttcacagaagtagctntgctggaagtgttagagccgcaggttccaacaattaacttga

SEQ ID NO: 2969 - DNA, 754 bp, Homo sapiens
  misc_feature (1)...(754): n = A,T,C or G
ggntaaaacctatntttacaaaaaangtacaaaaatatctgggtatggtggttcatgcctgtggtcccaactactcagaaggctgaggtggnaggatcacttgagcctgggaggttgaggctgcagtgagtcatgattgcgccactacactccagcctaggcaacagagggagaccctgtctcaacaaaacaaaacaaaatcaagacacgaggacatcagaggcagtggaattgccctgtgttgagtggctgaggtcgacgccccatatttctgggttttgttcgttgagagacagttgctgattaccaagggttccacggtcttggatgggcgtgttccactcttggcacacttatcatgtgctggacatagcctctggtctgggtaaataccaccctgttttgcagggagccctgcccagaacttacctttttgggtattagttgcaagtatgcctacccagtttttaaaatcctctctgattttgttgtataaacgggtctcattctcccttacaacttcttctccttctactaacttttcgatgtcctgattaaacatcttgattttctcaattagaaagaacatcttgtcggcctcctggctggggatgtcagccccgcaacgccgcagctcctcggtcgccttctggtggctctcccttatttgtccttctaacaacgggagcgatttttggatatgcatgatgagttcagtggtaagtctttctgccagtcggggaaccgggctgac

SEQ ID NO: 2970 - DNA, 606 bp, Homo sapiens
  misc_feature (1)...(606): n = A,T,C or G
ttttttttttttttttttttttttttttttttttttgctaaaaatgagtttattactgctagaaatgagttcattacagagagaggagacagggctccgacaggacgcacacacacggcactcatgctcctaaaacactgggtttgtgaagggacattataaaaatgaggaaataagctggtgatgttcagcatgtgtcagtttctaggaatccagagaaaaggggagagctgcaagggtggagcgattctgagggctgaaaatccctttcccagtacgaagaacagcatccttcaatccccgccagctcatgtgcatctgagggtggggctctgtcttcatgctagaaaccaaactgctctcacagcttcctgctaaatcaccacggttaacggataagcagagacggactatccagtctgactactgagcacctcaagatcgtcagtccagtggctaccccggaaccgggggccagacaatgtgctgccctttcatgcgggtggacgaaagggcttgacacagaatgtggtaaccgggaactggcaagccgcgcccaacctgcttagcggcaagccgtccttaagacctncccttgtgccctgg

SEQ ID NO: 2971 - DNA, 540 bp, Homo sapiens
tagaaatgattttattacagatagaggagacaggggtccgagaggacgcacacacacgggactcatgctcctaaaacactgggtttgtgaagggacattatccaaatgaggaaataagctgtgatgttcagcatgtgtcagtttctaggaatacagagaaggggagagctgcaaggtggagcgattctgagggctgcaaatccctttcccagtacgaagacagcatccttcatccccgccagctcatgtgcatctgagggtggggctctgtctccatgctagaaagcaaactgctctcacagcttcctgctaaatcaccacggctcaacggataagcagagacggactatccagtctgactactgagcactcaagtcgtcagtccagtggctacccgggaactgggtcagacactgtgcgtgcacgtctacggggctggacagatctcagtttaactggcgactggggcagacggacgcgacctagggtccgcggtgcaaggcggctgcctcagaggactaggcttgatcgctggtgtcg

SEQ ID NO: 2972 - DNA, 772 bp, Homo sapiens
  misc_feature (1)...(772): n = A,T,C or G
gcatttatttctgctagaaatgagtttattacagagagaggagacagggctccgacaggacgcacacacacggcactcatgctcctaaaacactgggtttgtgaagggacattataaaaatgaggaaataagctgtgatgttcagcatgtgtcagtttctaggaatacagagaaggggagagctgcaaggtggagcgattctgagggctgaaaatccctttcccagtacgaagacagcatccttcaatcccgccagctcatgtgcatctgagggtggggctctgtcttcatgctagaaaccaaactgctctcacagcttcctgctaaatcaccacggctaacggataagcagagacggactatccagtctgactactgagcactcaagtcgtcagtccagtggctacccgggaacggggcagaaagtgtcgctgcacttctacggggctggacagagtgtggttaaacggggaactgggcaagccggcgccgagctgccttcaccgtggcaagccgctcccttcaggaacttccgcgcttgtcccggtgttcttccgttccctaagggccagcctgtaagtgttccctgtaccgaaagagcctgcagaatgggcccttcgaagcgtcggccctagctctggagncttaaaaaacggatgatccaagggatgttgtcggaaaagcgcctgtggcccacggtgaaaggccatcaagtgcgaaaaattcctcatggaaaatccttgcccagctgaattgaaagccccaaaatccc

SEQ ID NO: 2973 - DNA, 522 bp, Homo sapiens
  misc_feature (1)...(522): n = A,T,C or G
ttttttttttttttttttttttttttttttttttttttttgctaaaaatgagtttattacaaagagaggagacagggctccgacaggacccacacacacggcactcatgctcctaaaacactgggtttgggaagggacattataaaaatgaggaaataagctgtgatgttcagcatgtgtcagtttctaggaatacaaaaaaggggagagctgcaagggggagcgattctgagggctgaaaatccctttcccagtacgaaaacagcatccttcaatcccgcccagctatgtgcattttgagggtggggctctgtcttcatgctaaaaaccaaactgctctcacagcttcctgctaaatcaccacggctaacggataagcagagacggactaaccagtctgactactgagcacctaaagtcttaagtcagtggctaccccggaacggnggcacaacagtttgttgcctctaccgggctggaacaaaaattgtaaacgggaacttggcagcccgcccgagcctg

SEQ ID NO: 2974 - DNA, 670 bp, Homo sapiens
  misc_feature (1)...(670): n = A,T,C or G
acgtttttaaaaagtttctttgctttattaaattcctcttcaagacttaacagaacaatggaagctcatcataatcagggaaacaagaagaaaagagaatcactcaggctcctttctggcgggggagtggagaggctgggaaacacaatgacagtgaaccatgggaagcagggggcatggccactggatctgaaagtgaccggctaacagtcactaaatgtccaaggcctgggcttgagcaatagcctcaggtatctccatcacttacacagcactcattcgttcagtgagatgtcatttattaagcagttacaatgctgcaggtgctgtgcaggagactggacatacaaaagaagaatttgacccagaccttccccctctgggtctcataatcttgtagggggaagggaatacaaatacaaattagcgaagaatgatagcagtatcttaggacactggtactgtgtgctacgggaccccaggactggagagccatccccttcgtgaagtcaaaggagagaccttggntggggagaagctgagccctggtggacccttgatccttcctttgttccttgaggaagtcagtaaagatgcacactagtatgggccagagagttgggccccaagcagaaacggattcttgcccgtctcccctttaaaatgatga

SEQ ID NO: 2975 - DNA, 562 bp, Homo sapiens
cggcactcatgctcctaaaacactgggtttgtgaagggacattataaaaatgaggaaataagctgtgatgttcagcatgtgtcagtttctaggaatacagacaaggggagagctgcaaggtggaccgattctgagggctgaaaatccctttcccagtacgaagacagcatccttcaatcccgccagctcatgtgcatctgagggtggggctctgtcttcatgctacaaaccaaactgctctcacagcttcctgctaaatcaccacggctaacggataagcagagacggactatccagtctgactactgagcactcaagtcgtcagtccagtggctacccgggaacggcggcagacagtgtgcgtgcacgtctacggggctggacaaagtgggcttaaccggggaactgtgcaagccgccgccgaccctgctgtagccctgcaagcccgttccttaggaacttccgctgtcgttgggcgcccctccgctccttcagagccacgctgaaagtggtccttgtccttcacgaactgcaacatggcccttcgaagctgttggccgta

SEQ ID NO: 2976 - DNA, 913 bp, Homo sapiens
agtttttttttttttttttttgtagagatggggtctcaccatgttggccaggctggtctcaaactcctgacctcaggtgatccacccactttggcctcccaaagtgctggaattacaggcatgaggcactacacctggtcagaccttgtttttaaattatgattcgatgtacatgtcaaaaattaaattatttcatgcattacgtcctactgaatttgtgtttcaaatgaaataatcaattttaggattcctacacttattttataaaagtgaaaattaaatcaaatgatctaactatttccaagcaaattttgggatgaaagctattctaggaaggcttgcccttgattcttgctacatgtacttgttcagccactcaattaaattccttctggcctcgtcaatgtagggcttgtctgcaggtgagcaatcttctctcttccgatgcacgaacccatgagtctgcccagaaaatgttttaatttgatattcaactttgcagtgttctttcaacttctgagtcagcaaagatacgtccttgagtggaatcacaacatcattttcagcaaaaatgaacaaagtggggttctttaaattgtaaatgtcttcagaatccttgacgatgccatagacggacacccctgccctgaattctgagtatttcatcatcaaatgatggacagcagttccaccccagcagaatcccacgatgccaattttctgggcatgacactgttgtttcagatacttcaagatagcactgatctctctatcgatcttctgggcatttcttgttttcagccactcagggaagatagaccagtcgccagaggggtcccaaggctcttgccctacaaagaagtctggaacaatggttgtgtatccatttcctgagatcatgtcagctatatat

SEQ ID NO: 2977 - DNA, 712 bp, Homo sapiens
  misc_feature (1)...(712): n = A,T,C or G
gttgccgagctggactggaaagccccaaaatcccaggtttcttcttctttncttcttccagctccttctctctgaccttcctgcaatgcacccctgtatacctggtcctggcagtagacaatctgttccatctggaagtggaggcggatcagcttctcaccttctctctcttgttctgctctaatgtcttcaggttttaccttggcggttctgtggaggttaaaaaactcttcaaaattttttatcgaaacatctgtgaaagcaagccggaccatatctaatcaaagagagaaaaatagttcaatattggtaggatcatttgttctcttcttaagatgcaaaaaaatatgaggatcaaatggtatgaagtaaagtttcccctctccctgctcccttcttctctttaccatgaaaaagcaaggcatgctctttttgcttaataatttgctggaagaatcttaaaagcaaatgacccctggcatacatttatttgatatttaaactttttatcctaaatagctgccaagaatgtaaatttcttttaaattataaatattaatattttataatacaactcttaatataagtcaatcactcttnatatatcatggaatttgagtgtctacttatccatttaaaaaaattcagaacaagctctagtttaaaaatttatattaataatccttaatttggaactcattccaatcacctc

SEQ ID NO: 2978 - DNA, 492 bp, Homo sapiens
tttttttttcaaaaattcaaaaaattagtttattagcttaatataattagatcaatggaatcctgttttgatctcaatacttcccatattgcaatatataaatgtgacaaattcagctgttttgtggcatagataagtgtctaagctgggcagttagtctacccgtttatagttcatgttcttcatggctttgcagcatttgtcactttctatgatgtgttcaaagaccagaaaaggccacacttgacctgtcagctggtccttgaacagctgtaggtttttttttttttttttgagacagagtctccctctgttgtccaggctggagcgagaccttgtctcaaaaaaaagaaagaaagaaaagaaagaacccaacggcccacttcatttctgccttaccttggaatggtggctggatggcggcgttcttcactccagatttcagggagtgggagtcctcctgtagcctccgacccagaaccgatctcctcg

SEQ ID NO: 2979 - DNA, 656 bp, Homo sapiens
  misc_feature (1)...(656): n = A,T,C or G
ttttttttaaaaattcaaaaaattagtttattagcttaatataattaggtcaatggaatcctgttttgatctcaatacttcccatattgcaatatataaatgtgacaaattcagctgttttgtggcatagataagtgtctaagctgggcagttagtctacccgtttatagttcatgttcttcatggctttgcagcatttgtcactttctatgatgtgttcaaagaccagaaaaggccacacttgacctgtcagctggtccttgaacagctgtaggtttttttttttttgagacagagtctccctctgttgtccaggctggagtgcagtagcgcaacctcgactcactgcaacctctgcctccaggttcaagtgattctcctcctcagactcctgagtagctgggattacaggcacatgccaccatgcccggctgatttttatatttttagtagagatggggggtcccccatgttggccaggcctggtcttgaacttcctgacctcaagtgattccacccanctcggccttcccaaagtggctgggattacagggcgtgaaacccaacacccgggccgtaggttttaaanaataaattaggggtattaacccctaatcattccctccaatcattcaaatttctcccagggtaactgg

SEQ ID NO: 2980 - DNA, 522 bp, Homo sapiens
  misc_feature (1)...(522): n = A,T,C or G
tttttcaaaaattcaaaaaattagtttattagcttaatataattaggtcaatggaatcctgttttgatctcaatacttcccatattgcaatatataaatgtgacaaattcagctgttttgtggcatagataagtgtctaagctgggcagttagtctacccgtttatagttcatgttcttcatggctttgcagcatttgtcactttctatgatgtgttcaaagaccagaaaaggccacacttgacctgtcagctggtccttgaacagctgnaggttttttttttttttgagacagagtctccctctgttgtccaggctggagtgcagtagcgcaacctcgactcactgcaacctccgcctgggtgacgagcgaatctccatcgcaaaaacaaaaacaaaaacactggccgggcctggtggctcacgcctgtaatcccagcactttgggatgaaagctattctaggaaggcttgcccttgattcttgctacatgtacttgttcagccactcaattaaattcctt

SEQ ID NO: 2981 - DNA, 515 bp, Homo sapiens
taatataattagatcaatggaatcctgttttgatctcaatacttcccatattgcaatatataaatgtgtctaattcagctgttttgtggcatagataagtgtctaagctgggcagttagtctacccgtttatagttcatgttcttcatggctttgcagcatttgtcactttctatgatgtgttcaaagaccagaaaaggccacacttgacctgtcagctggtccttgaacagctgtaggtttttttttttttttgagacagagtctccctctgttgtccaggctggagtgcagtagcgcaacctcgactcactgcaacctctgcctccaggttcaagtgattctcctcctcagactcctgagtagctgaggcgggagaatcacttgaacccgggaggcggagcgtgcagtgagccgagatcgtgccactggactccagcctttggctaggaggagccctgagcctcagtcttgagtcacagcagatcacaacttcgaacacaaggaaatcctctg

SEQ ID NO: 2982 - DNA, 352 bp, Homo sapiens
tcttcttggaggctgcttctcgtctgacccttccggagacgcaccggctgtatacctgggcctcggcagtagacgatctggtccatctggaagtggaggcggatcagcttcgcaccttctctctcttggtctgctctaatgtcttcaattttggacttggcggttctgtggaggttaaaaaactcttcaaaggttttttatcgaaacatctgtgaaagcaagccggaccatatccgtcacggtgtgtagcgtatccagcagccggctgttccagtgccttgatttgctgtttcacgattgtctcaaatgtcctgtaattcacaaagcctgcagctctgtaccacgatactga

SEQ ID NO: 2983 - DNA, 355 bp, Homo sapiens
  misc_feature (1)...(355): n = A,T,C or G
tttttttttttcaaaaaattagtttattagcttaatataattaggtcaatggaatcctgttttgatctcaatacttcccatattgcaatatataaatgtgacaaattcagctgttttgtggcatagataagtgtctaagctgggcagttagtctaccccgtttatagttcatgttcttcatggctttgcagcatttgtcactttctatgatgtgttcaaagaccagaaaaggccacacttgacctgtcagctggtccttgaacagctgtaggtttttnttttttttttttntttgagacagagtctggagggctggaggacnacttggaacccaagagttagaggctgcaganga

SEQ ID NO: 2984 - DNA, 485 bp, Homo sapiens
gagacggagctgggtctatgggtgtgtgccatacctggctaatttttgtatttttagtagagatggggtttcaccatgttggccaggctgatctcgaactcctgacctcaagtgatctgcctgcctctacctcccaaagtgctgggattacaggcatgagccactgcacccggccagtttttaacttttaaacttactgctgacagctgaaggaagctgtcgtcacatccttgaagcatgtgcatggagacagaggtagcgtgtctcctagtgtggtgggagactgccagtcttcacataaactcttgtccataacagataacatcagctcgcagctcaggaaactgctgctccttttcttttaccttttttttttcttttgagacagagtcttgctctgtcacccaggctggagtgcagtggcacaatcttggctcactgcaacctccacctcccggattcaagcaattctcctgccttagcct

SEQ ID NO: 2985 - DNA, 605 bp, Homo sapiens
ttgcatcatcctgtaaactactaaatatttagccggcgaattgtttttctctgaagtttaccagtctgttgaccaagaccaagaatccaactgctacagttaacaaagaataaaaaatcagacttttggctgggcacagtggctcagacccagcatgttgcgaggctgaggcaggaggactgcttgtgcctggaaaatttctgcataattcaccccttaatttgcatgtagttaaaagtgggtataaataggattgcagagctgctgctgagctgctaactctgggcacactgcctatggggtagccctgtccacaagaagcagtgtacctctgctgctgctgtgcaatgctgcttcaatacagtttgctaacaccactggatcgcatcaaggcaaagccaagaaccctctcaggctaagccccaattttggggattgcctgccctgcatcagaggcatcactccagtctctacctccaacttcacatggcatactcccctgtgtcttctgtttccaaatttccctcatctttttttttgagatggagtcttgctcttgtcacccaggctggagtgcagtggcatgatctcagctcactgcaacc

SEQ ID NO: 2986 - DNA, 6699 bp, Homo sapiens
  misc_feature (1)...(6699): n = A,T,C or G
atcttgacagtnttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggctttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgtttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacacttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaaaaaaaaaaaaaaaaaaaaaaaaaaa

SEQ ID NO: 2987 - DNA, 2436 bp, Homo sapiens
ctgtgtgtcaaaccggccgcagcgcgaggccggcgcgcggggtcggtggcggtggcggcggcgagagcgaggcttgggcccaggcgcaggcccaggccaggcaggagcggccgcagcgggggcggcagctccagaggcgccggcccagcggccctgcaggcccggagcggcagccgcgggcgccgggggacccagggggcgcggcgatcaccccggcgcgcacccgccgcccctcccccccgccacgggcggccgcgcaacttgcggccaaactttccccccggcctcccgcgctcggatggcggcccgctgagttggccgcagcccccgggcgagcggcggccaggccagaggacgccccctgcgcggctcgggccgggccatggccgcgcgcccccgccggggccccagggcggcgggacggagtccatctgggcccccggcccgcgcctctagcgtgcccctcccggccccgggcccggccccgcgcacggtgggaaagttggcctggaaccggcccgaccagttccgcccgggcgcgaggaccggccgcagaagttgctgcaaaacttttttggggggtgcagcccgtgccccccgcgcgccggggccgaatgcgcgccgcgtagggtcccccgggccgagaggggtgcccggagggaagagcgcggtgggggcgccccggccccgctgccctggggctatggccatggtgaccggcggctggggcggccccggcggcgacacgaacggcgtggacaaggcgggcggctacccgcgcgcggccgaggacgactcggcctcgccccccggtgccgccagcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctgcaaaaaaaaaaaaaaaaaaaaaaaaaaaagtcgtatcgatgtcgagcgatcat

SEQ ID NO: 2988 - DNA, 580 bp, Homo sapiens
ctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcaaaaa

SEQ ID NO: 2989 - DNA, 990 bp, Homo sapiens
atgaggtgtcagtggccaagagaggtgctcgtcgaaaccgggagagacccgaggtaaactccccaatcatcagcagagctcgaggttctcggctcaagggagaagaggatatagtaggactgatactcatggggccagacatctccagcaggtgcctctggatggtgacggctggcaaaagccctgctctccctgtctagaggtggacatggctacaggctctccatctctcatgactcatgaccctcctctgccagtttttaaatcagatcaccctccatgttgtcctgacccacagggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaa

SEQ ID NO: 2990 - DNA, 1005 bp, Homo sapiens
cggtgctgggcatcgacaacgtgtgcgagctggcggcgcggctgctcttcagcaccgtggagtgggcgcgcaccgttcttccccgagctgcccctgcacacggcgccgctactggccgccgccggctccacgccgcgcctatggcgccgagcggccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggcgctcaccgagtatgtgcgggcgcagtaccgtctcagcccagcgcttcgggcgctgctgctgcggctccccgccctgcgcgcggtccctgcctacctcatctcccagctgttcttcatgcgactggtggggaagacggccattgagacactgatcagagacatgctgctgtccgggagtaccttcaaatggcctaggggtcgggccagtgaccttttagggccccaatttccctggccaaggcctgaagacagacctcaggggacagggaatgctgaggcctcgagggcctcccggggcccaggactctggcttctctcctcagacttctattttttaaagactgtgaaatgtttgtcttttctgttttttaaatgatcatgaaaccaaaaagagactgatcatccagcctcaggtgatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaaggcatttcctacctga

SEQ ID NO: 2991 - DNA, 631 bp, Homo sapiens
  misc_feature (1)...(631): n = A,T,C or G
tcgggcagccccccngagtcggcgctggcggcagtggcgagcgngagagagctattacaaaatctttctgttattttcttttctcgcagntgntgcgcgctgagccctaccctgcggcggccggacgcttcggcccacggggcggcgcggcnggcgcggtgctggncatcnacaacntntcccacctggcggcgcggctgctcttcagcagcntngagtgggcgcgcgacgcgcagcttgggggggagctggcnntnccnaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccanntgccccccttccaggagcaggtggacagaggtgggccggcgtggaggtgggctcncccnantntnnctgcctcaaggccatcgcgctcttgacgcgacgcgcgtntnncctctcanacccggcccacgttgagagcctgcgggggangcggcggggggcctcagcgagtgtgtgcagtctgggtcccctncccacccccaccttcaggcgcctgc

SEQ ID NO: 2992 - DNA, 449 bp, Homo sapiens
  misc_feature (1)...(449): n = A,T,C or G
gcaggtaggaaatttctttattattggccttgagtcatcatgtagtgtctgacataggttacgtgtccagaggatctgcctggcacacgctagctacccctcccggggcccaggactctggcttctctcctcagacttctattttttaaagactgtgaaatgtttgtcttttctgttttttaaatgatcatgaaaccaaaaagagactgatcatccagggcctcagcctcatcctccccagggacccctgtccagggatggagggtccaatcctaggacagccttgttcctcagcacccctaggcatgaacttgtgggatggtggggttggcttccctgggcatgatggacaaaggcctggcgtcggccagagggggcttgctccagtgggcaggggtagctagcgttttcccagggggcttctncccantttttnggctcnagggcaa

SEQ ID NO: 2993 - DNA, 498 bp, Homo sapiens
aggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttcacccctccctttcacaggggtctgggtgcctcacagggtgggggccggcgcctgctaacctcattaccactgatcccttgatcccgtgggctgctccagtgggcaggggtagctagcgtgtgccaggcagatcctctggacacgtaacctatgtcagacactacatgatgactcaaggccaataataaagacatttcctacctgcacaaaacaca

SEQ ID NO: 2994 - DNA, 476 bp, Homo sapiens
  misc_feature (1)...(476): n = A,T,C or G
aacacaaccccccgncccccttgccncccccggacnccacgacccaacccccccagcaanaaccnagggtatgtgggaaaggtccagggccgtggtaaggaaatagaaccaaagaggggagtgaatacggggtgggggcactggccgcccggctaaacttggacattaattttatatccatgaccccccttttaagcccagtgagctgggccttcagtttttccccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaacactaaaaaaaa

SEQ ID NO: 2995 - DNA, 542 bp, Homo sapiens
  misc_feature (1)...(542): n = A,T,C or G
ggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgncggcctccacgccgcgcctatggccgccgagcgcgccgtggctttcatggaccangtgcgcgcctttccngagcangagggcaaacatgtgccccctgctgaggacaaactcgccggatgttggctgctaaaagggcaacgcgcttttaacgcccgaagcctgggggcct

SEQ ID NO: 2996 - DNA, 340 bp, Homo sapiens
  misc_feature (1)...(340): n = A,T,C or G
gatgcttctgccttggcctcccaaagtgctgggactgtggccgtgagcatcatgcccggccccctgttcttacccacagtggcgagtggtgtcccctagtcacccctgtgggctctgtgttctctagctgcctcccacctgtctgacttgcctttgtccccctagacgcctgtggccttctcagacccggcccacgttgagagcctgcagggagaaggcgcaggtgggccctcaccgagtatgtggcggggcgcagttacccgttcccaggccccagcgctttcgggcgcttgctggttgcgggttncccgncctgcgcgnggttccctggcctncctca

SEQ ID NO: 2997 - DNA, 480 bp, Homo sapiens
gcggccgcatcccgcactcgctgcctggtgccgtggcgcctcctcgggcagccccccggcgtcggcgctggcggcagtggcgagcggcggagactcttcccggggcagcgtgtcgaatgatccgcactgctggctgagcctacctgcggcggcgagcttgcgcaggcgccgcggccggtgctggcatcgaaagttgcgagctgcggcgcgtgtcttcacacgtggagtgccccaccttcttcccgactgcggtggcgacagtggcgctgtgcgtgagctggagcgagctcttcgtgctgaacgcggcgcagcggcgtgcccctgcacacggcgccgctactggccgccgccggcttccacgccgcgcctatgccgccgagccgccgtggctttcatggaccaggtgcgcgcctccagtagcaggtgtacaagctgagcccctgcaggtcgactcgcccagtatgggtgctcaagccatcg

SEQ ID NO: 2998 - DNA, 515 bp, Homo sapiens
  misc_feature (1)...(515): n = A,T,C or G
ggggccgcatcccgcactcgctgcctggtgccgtggccgcctcctcgggcagccccccgctcggcgctggggcagtggcgagcggcggagacctcttcccggggcagccggtgtccgaactgatcgcgcatgctggcatcgagccctaccctgcggcggccggaccttcgggcagggggcggcgcggcgggccggtgctgggcatcgacaacgtgtgcgagctggcggcgcggctgctcttcagcaccgtggagtgggcgcgccagcttactgataccccgagctgccggtggccgaccaggtggcgctgctgcgtgcagactggagcgagctcttcgtgctgaacgcggcgcaggcgggcgtgcccctgcaacacggcgccgctactggccgccgccggctactcacgccgcgcctatggccgcccgaggcgncggcccgggttttttggggggtgggggccctctttttttttattttttttccccaaaaaatttttttgggggggggggggg

SEQ ID NO: 2999 - DNA, 487 bp, Homo sapiens
  misc_feature (1)...(487): n = A,T,C or G
ccccccggnctcggcgctggcggcagtgtctagcggcggagacctcttcccggggcagccggtgtccgaactgatcgcgcagctgctgcgcgctgacattttacttgctgctaaagaacacttcgggcaaggggttttaagtcgctcctttgctggcatcgacaacgtgtgcgagctggcggcgcggctgcaagggtaataaaaaaatggttcctcccgggcccttcttcccgagctgccggtggccgaccaggtggcgctgctgcgcctgagctggagcgagctcttcgtgctgaacgcggcgcaggcggcgctgcccctgcacancggcgccgctactggccgccgccggcctccacgccgcgcctatggccgcgagcgcgccgggtttcatggacaggtgcgcgcctccaggacaggtgacaagctggccgcctgaggtcgactcggccgagtatggctgcctcaaggccatcgcgctcttcac

SEQ ID NO: 3000 - DNA, 629 bp, Homo sapiens
  misc_feature (1)...(629): n = A,T,C or G
gatggccgcctgtagtcgcggctactcgggaggctgagacgaggagaagatcacttgaggccccacaggtcgaggcttcggtcggccgtgacccactgtatcctgggcagtcaccggtcaaggagatatgccccttccccgtttgcttttcttttcttcccttctcttttcttctttttgcttctcttttctttctttctttctttctttctttctttctttctttctttctttttctttttctctcttcccctctttctttcctgccttcctgcctttcttcttttcttctttcctcccttcctcccttccttctttcctcccgcctcagcctcccaaagtgctgggatgactggcgggaggcaccatgcctgcttggcccaaagagaccctcttggaaagtgagacgcagagagcgccttccagtgatctcattgactgatttagagacggcatctcgctccgtcacccccggcagtggtgccgtcgtaactcactcctgcaggtggacgtcctggaattgagcgatccttcaactcagctcagagtaagagctggaacgcggcagccaatgtggccacacgttttatgtttttttcccgaganaattcatctctggcanatgatgg

SEQ ID NO: 3001 - DNA, 1143 bp, Homo sapiens
atcctcaatcgccactggagaattcatacaggagagaagccctatgaatgtcgtgaatgtgggaagacttttagccatggctcatcccttacacgacatctgataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcctgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagatttcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccctgtttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctta

SEQ ID NO: 3002 - DNA, 482 bp, Homo sapiens
cagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttacccgtcacctcaggattcacactggagaaaagccatataaatgtaatgagtgtgggaaagcttttagcaaaggctcaaatcttactgcccatccaagagtacataatggagagaaaccccaagagtgtggtaagtgtggaaaagcctttagactatatgaacactatacatgtgagaaatcttacagaaggaggaaactgtatgaagcagtggttatcatggtaaatttcctagatctcctattacatagaaaatttatactgggaaggctctg

SEQ ID NO: 3003 - DNA, 1128 bp, Homo sapiens
agaagacgtgtctcatagcacatcagagatttcacacaggaaagacgccctttgtgtgcagtgaatgtggaaaatcctgttctcagaaatcaggtctcattaaacatcaaagaattcacacaggagagaaaccatttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgttgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaatta

SEQ ID NO: 3004 - DNA, 14697 bp, Homo sapiens
gaattcagtgcttgagggcagaaccaatgagaaaatctagtcacatttctacagcgcatcaccgttaaaaaaaggattctcttttatgctaggcaaggagggatgattatttattagcttctacagattagacaatggggtgggggtgggctcaaggtgagatgattttttgggtccaagtctactcaagacaggcatcccagtcttcggtctccaaatccacctcctgtctgtccccccacactgctcctcaggccttgtggatccattgactgtgatttctgtggttcagctcccacatcaggcaggaagggcagctactgggtctgagatcccacattgcctccaacccttgcttcctagctggcctcccagggcaccacgaggggctgggccaggctgctgtgctgcacgtggcaggagtagggggctgtgtcctgcgggggcactgccaccaccacccaggactggtaagtgccatttccattgtgaagaacatctccccgtaactcaggctcctgcacctcgccggcccgagtccagtgcacatcaattttccctgggtagaagtcgtaggccaggcacttcagtttcttcttttctcctggggcctggtggctggtgaccaccacagagggaggatcttgccgggcaaagagtgtgacactgcaggcttgaggtggacttctcccggcccaggtctcttcctacccccacccctggatgtcagcgatcagcagagctcgaagctctgtacctgcccacccccagccccgggagactttccagaatatcagggaaggctgacgctttccctcttgcccaatccccacctcacccatgtattgactctgacggcaataagttgtgaatgctccgtgtgcttctccatgttttcccacatctcagtgggctttggagttctgtcccccagtctcagtccagctgcttggttcagcccatgcctctatccagcaaccacttccctgcagacactgcacaatcctgagtctcactacgtctccaatccaagtctcagcttgcagccatcaattccgctcacactggcttgctcttgtccttctggggctgacattttacacgcctcccttctctccaccacccagatgggaggcatcattgtagagataaaaaacgatgggatttggaatctgaaatctggaatttgagtcccagctctgcctcttacagacagtgttaccctcacctccctaacctcaagctccttgtctgttaattggagatgatttggggacactcatcaagaaagaatggccttcctggcccattctgcctgaaattttgatgatgttctttttggaccacaaattatattatcccagggaaggaataaatcctaaaagatgaaagctgggggtctgagggacatccaggaacagatgagaccggactaagatgttgcctgagctcctagcctgagatcgtcttttattctgggctcagtactggggagcaggaagcagtgagtaccttgccggtccaggatatttttgctgtatttcaggtatttccgcagagtcgcagggcactcctcctccaggtaagccttggcccgctgcacgtagactggttctgcctcccacttctgcttggttatctgggctgctgggtcgaaggggacccaggctgggatttctttgttgaattcaatgtagtcctttccatcatagtaatatttccagaatgctccgctgcttctgttattctcgatctcacaaccaaaccttccctgcaatacgtgagaccctgaaaactcccccgaccccacagagagacagtcagcctggtgagaaatttatcaaaataactcttagtcttgcacattgggcaacccaaaagaaataaaggtttttgcaattcaagcatgcaatccctttatcaagacaaataggttattactccaatatatacaacagacagagaggggctaactcagtttggtttggcatttcaggtttgtctcagatgagatatgttcctccttaagagagctacagcctgggcgctgtggctcatgcctgtaatcccagcactttgagaagctgaagcgagtggatcgcttgagcccaggggttccagaccagccagggtgatatggcaaaatcccaccactacaaaaaatataaaaattagcgcagcatggtggtgcatgcctgtagccccagctactcaggaggctgaggtgggaggatcacttcagcctgggaagtcaaggctgcaatgagccaaaatcacactactgcatttcagcctgggtgacagagtgagaccctatctcaaaaaaaaaaaaaaaaaaaaaaaaaaaaaaaaaaaagcaccaggcccagtggctcacacttgtaatcccagcactttgagaggctgaggaggatggatcaccttaggtcatgagttcgagaccagcctggccaatatggtgaaaccccatctctaccaaaaatataaaattaggctggacgcagtggctcatgcctgtaatcccagcagttagggaggctgaggccaaaggatcacctgaggtcaggagtttgagaccagcctggccaacatggtaagacctcatctctactaaaaatacaaaaatttgctgggtgtgctggcacatgcctgtaatcccagctactcatgaggctgaggcaggagaatcgcttgaacctgggggacagaagttgtagtgagccgagatggagccattgtacatcagcctgaaagacagagcaagactcagtcttaaaaaaaaaaaaaaaaattaaccaggagtagtgacacatgcctgtagcctgtagtcccagttatcgggaggctgaggcaggagaatcccttgaacccaggaggcaaagtttgcagtgagctgagattgcatcactgcactccagcttgggtgacaagagcaaaactccatctcaaaaaaaaaaaagctacagaatatgaatatatttctatctcttctatagcatctcttctaaggacaattatttgtttgaatttatgctgagtcctgaggaagctgtcacaactacaccaaagtgtacttccaaattggatagaaattatttgtgatttcatatgagtaaaggaaggctctctttttctctcagttctaggaagagttcatatcatcacctaagtaaccctaatctgatcacttctttctacttttctggtgtttgatatctttatcccaaatctctaaagccccaaccttcttgcccattagccacaactctcagaaatggacctcatagggcaggggacacagcctctttgttctgatgataaaagcaggtgtttacccagcactggttggtgctgttggcatagactctgaaagctctcaagctgtctgggctcacgtcccaggtctctccccagccccccacccccacctggtgtgttgcctgaactggagccactcaactccctgtgcctctatttcctcacctctgaaatggcaatgccaagagcactgttttagggggctattctgagcattatatatgctcatagatgggcctggcacaaagtaagtgctcagtaaatgtcagctactattatttcctttttttgttttttgtttttagacaacgtttcactcttgtcactcaggctgtagtgcaatggtaggattttggctcactgtaacctctgcctcctgggttcaagcaattctcctgcctcagcctcctgagtagctgggaccacagacgtgtgccaccatgccaggctatttttgtattattagtagagacagggtttcaccatgttggccgggctggtctcgaactcctgaccttaggtgatctgcctgcctcagcctcccaaagtgctgggattacaagagtgagccaccaagccctgccttctattattttctaataccctgtgttcatctcctcatcctccttcctcttaattatccactttgccatttctattcctgtccatcaatgcttcccccagtgtcttttctgatcacctgtgccccctcctctcctattgctgacacacagcctgggccattttccttaccaagacctcccccaccccacatccttgaaacatctgcctatctctttcttgcctccttttgaaaatcttcagatcccatgtagcaccttgggcatttttgtacttagtagcccatcttttgacacccactctatgataatttaacaccagcagttcaccagacctgaggttggctgccttggggctggcagtgtggtttaggagaaagagcactgggccgggggcacagggaccatctctgcacgggctctgccaccagctcctctgaccatagcgcaggtggcccttcctgggtctgcatcgtatggtaaggaggaactttagggctccaagggaactctaacagcccacagttttgaatccagcacttcctgagcccccagcatgggctacggtgtgtgccgggtgcttttctctgtggattccacaaatttcaattgagccaatattggctgtaccctgtgctaggtgatggagctgcaagggagatcaggacagactgtgacatccttatagaacagacatagttaaatattacagacttgtttggaggtaggtctcagtgctccaatgtttgcagatttcaaccagatattttgggaacgtttcactgtcaacagctaggactggcagaaccaccaggtgagcccaggtctgagtgactttgagagtggctcactctccaggcaacctccctggacaggggtgagtctgatgccttctcacgggggtatcagcctccgatgggtggggtgtggaggtgagaggtcataggtgcctggataggaagtgactctgccatcacttcctgtgtgacctgaggcctgggatgaggatggggcaattgatggggaagcggggagcacctgtgctgtggggtgggtgggatgtggacatgtctgtgtttctgctgtgtctcctgttcttcccctgggattgggactatttccatcctgctgatcccttgccactcacactgggggggctgcctcttgggttagaccttccacccctgtggtctgttattcactgaccgttactgtcgttgtaatactccacgatgtctttcagggtctccataaagatgtcctccctggccttctgaagttggctgtcctgcttccaatcctccattccttccacctgtctccagagtcccatgggctgagacttcctgtctttactgttgtatctaaagaactggaggtcattgagtgagccaagggcctgaaacgcggggacgtcttcaacatgcttggacagcccagtgtagatataggtcagagagtaacgacctgcaaaagaaaagattctgatggttgaggtccatgcaagggtcccactgtggggctgcatagggctaggaggggagacctgccactggccttttcttccccagctctttctcctgccatcaacttcacaccactggaggctcactcaagtgaatatgctctactttcatgcctgagatgatatttcagagaccatcctgtgtcttcactacattatttcctctgcttgacacataggaagataacattactcagccacctcgaagatatattgggaccatgtgactgagttttgtcaaaagagaatgtgagcagaagtgatgtctttcttcttgtccaagaccctaccagctggcttgtcccttttgtttctcatccctagaggtgacgactttgaaggccacaggataatatgaaagagtctcaatatgcaattggcctggatccctgagtcaccccatggaggaatggaaccttgcccagtgtgcatggaatctgacatgcgttagaaattaacatttctaggctgggctccgtggctcatgcctgtaatcccaggactttgggaggccaaggcaggcagattacttgagatcaggagttgaagaccagcctggccaacatggtgaaaccccatctctattaaaaaatacaaaaattagctgggcatggtggtgcgggcctgtaatcccagtcatgctggaggctgaggcaggaaaatcacttgaaccagagaggcagaggttgcaacaagccaagatcatgccactgcactccagcttggatgacagagtgagactccgtctcaaaaaaaacaaattaacatttcgtccgggctcagtggctcacgcctgtaatcccagcactttagggggccgaggcgggtggatcacgaggtcaggagatcgagaccatcctggctaacatggtgaaaccccgtctctactaagaattcacaaaattagccaagcatggtggcgggtgcctgtagtcccagctactcaggaggctgaggcaggagaatggcatgaacccgggaggcggagcttgcagtgagctgagatcatgccactgcacttcagcctaggtgacaaagcaaggctccatctcaaaaaaaaaaaaaattaacacttctagcttaacctgacaaatacatatagttagaaagggtagaaaggagaatttaccagaaaattcaagaaatgacccagactgaattagcacagggtaagactaggatggagctcagaattcccggggttgtaccttgcattttggtacaaggtgggatctgggagagagggacatttccataatagttccataattattttatgatacaatttacacaggtgctaatgatgttggaggtcatatggcagaatcctagttcaattactaaaattattcttgctcctgagtgtctaaatgtgattagcctttaaatcagtagaccctacaattgaattcatggacatagagagtagaaggatggttaccaaaggctgggaagggtagtggcagggttggggggaaattgggagggtggttaatgggtacaaaaaaaatagttagaaaactatttgatagcacacaacaaagtgactccagtgaataataatttaactggggccaggtgtggtggctcatgcctgtaattccaacactttgggaagctgaggcaggtgggtcacttgaggtcaggagttcgaaaccagcctggccaacatggtgaaaccccatctctactaaaaatacataaattagccgggcgtggtggcacacacctgtagtcccagcgactcagaaggctgaggcaggagaatcgcttaagcccgggaggcagaggttgcagtgagccaagattgcaccactgcattccagcctgggcaactctgtcacaaaaaaaaaaaaaaaagaagaatgaataagacctactatttgatagcacaacagggtgactatagtcaataataatttaactggggccaggtgtggtggctcgtgcctgtaattccagcactctgggaggctgaagtgagtggatcacttgaggtcaagaggtcaagaccagtctagccaacatggtgaaaccctatctctattaaaaatacataagttagccgtgtgtggcagtgtacacccgaggcaagataattgcttgaacccaacaggcggaggtttgcagtaagccaagatcacgccactgcactccagcctgggtgacagaacaagaatccatctcaaaaataataataataatcataatttaattgtacacttttaaataaccaaaagagaggccaggcgcagttgctgacacctgtaatcccggcactttgggagaccaaggcgggcagatcacgaggtcaggatatcaagactagcctggccaacatgatgaaacccgtctctactaaaaatacaaaaaaattagccaggtgtggtggcaggtgcctgtagtcctagctactcaggagactgaggcaggaaaattgcttgaacctgggaggcggaggttgcagtgagccgagatcatgccactgcactcctgcctgggtgacagagtgagactctgtctcaaaaataaataaataaataaataatcaaatacttttaaaaactaaaataaccaaaaaagtataattggattgtctgtaacacaaacgataaaagcttgaagggatggatacctcatttttgatgatgtgattatttcacattgcatgcctgaatcaaaacctctcatgtaccccataaatatatacacatactatgcacccacagttttttttttaatttacaaaaaaatcagtagaccttgagtaaagtggattactctccatagtggtgggcttcatccaatcagttgaaggccttaagagaaaaagcctcagatgtcccctaaagaggaaagaattctgcctacagtctgcccttggaatcaagactaagacatcaactcttccctgggtctccagcctgctggccggctctgaagatttaggacttgttactcctcccaatagtgtgagtcaatttcttaaaataaatctctactctctctctcttttgtatacatatatgtaaatctcttcctatgtgtgtgtgtatccatgtgtatacagtgtatgtatgtatgtgtacgtacatatatatgtatatgtgtaccacctattagttctgtttctctggagaaccctgagtaattcagattttggcacagaatcagattaacattccaaagtgattgttatataacaaacatataacaccttttctgacaatttgtaaatgtcatgaattttaaactcacacaactgagaagccattcgcttccatgtctttatcctgcacattctcatgccacaaacagcctccttcccttatcctaggagtgactcttgatctcccggagctcccactctcttctcttccagccactcgccttccagacccactgcagtggtgtctgagtgtgggatttgggcacgggtttccttctagcaccatccctccagccaacctgccttcccactttccccttggggctgctctctcttttcctcagcgtcaggcaggtgtacccagccatcggaaggagggaaggaacaggagcagaagcagctccaggcatatggttcctactccgtcctgactgtctaccccaagcaggtcgcttggtctttggagtctttgttttcactgtaaactaggggttttagattcagattcctgaaggtcttatttcgggccagcgcagaggctccctgaatgctcctggaagtgtgtgagctgagggagttgacagccttgggcacccattcctgccgtatgccagggtatcccagctgcatccagcctgtctcccagccacatgtcctgttcctcacctccttccagtcctctccagcacccatcccttgctttccccactcaccatcttggttctcctgggggacagcaggacccagaagcagcagcagagacagcaggacaggcaccattcttaccattgtgtctgcttggagggttctgggcaggaggcacagatattatcctgggtcctggggccctgcccaggggaggtgaatctacaggccaatgggagtgccaggacgggctcctcccctaatagagaaaaaaaaatgatacacaagctaggctgggcagaggttatgaagaatgaatctacacacaggatatgcaaattcagagctgagtccagagttgatctctggactgaggctttgtgtgtgcctggggtggaaggatgccagtgggtaggaggtgcgtgtgatgggtggcaagcgcctgggatgtgtcacccttccagtctattgtgacaacccctgggccagtaggggcatttgtgtgtttttggaccacactgtatccctgccttccagaaaaactctcaacatgtccaagacatggacctgggtagaccccagctggggtgggaccctcactctcccacatccgatcctgccagaggctgtgtctggaggacagtcacattcccatctctccctccttcctttctgtgcctgtggaatcccagccttccatgatggaagcagaaatagccgcatcctccttttgcagcctccctggcaacagaacgagcctcccaaaatgctgggattaaaggcgtgagccaccacgcccagccaagataatttttaatgcatacaacaagactcgttttacacagacgaagccagttatttgaaaaccaggtctttccaggcacgctcagtgttgatgggctatttgcagagagaccctccgaatacaaagcaacatgctattctaaagtgactggggcccgggtgcggtgactcatgcttgtaatcccagcactttgggaggctgaggtggttggatcacctcaggttgaggtcaggtactcgagaccagcctgggcaacatgatgaaacctcgtctctactgaaaaaatacaagaattagctgcgcgtggtggcacatgcctataatcccagcactcaggaagctgaggcaggggtttcaccatgttggccaagctggttttgaactcctgacctcgtgatctgcccgcctcggtctcccaaagtgctgggtttacaagtgtgagcaactgtgcccagcctctcttttggttaaagaaacctacaaagggaccttttatagtgacttcaattttatggaataattgtaatgctcctaaggccgttgtgctccaaagtctagccgcaggtattgttattgattgggctccaaaagggcattattggcaagattgctccagcaaaaatacctcatgctcagagtttaattatttgttagattatgtagaggatggatggcagtcatacaggctgagacaatgggtgtccccttacctatttaaatggatggatgcaggcattactcctcctagaccaaaaatgattcatccctttgttaccccagaacatcctcaactatgaaaattagctgcagctatgacaggaataaggatatggaacactacctatcaactccttcacactaataccaaaacacccacattcaacatcaccctcatatctgaacgggtgatacccatcaggagctatgtcaaacccccttacatgctgttggttggaaatataattatcattcccaatacacaaactatagaatgtgataactgtaagctgttcacgtgcattgatgctacttttaatcccactacaagtactctcttggtaagggctagggagggggtatggataccagtttctttacatcgtccatgggagtcttccccctctattcacatagtcaatgaagttcttaaaggtatccgcaaaagaacaaagagatttatttttactcttattgccatcattgcaggactaattgcggttactgcaacagcagcaactgctggagttgccatccacaattctgttcaaaccgttcaatatgttgaattgaagcatggcagaaaaactcctccagactttggaattctcaggctcaaattgatcaaaaattagctaatcaaattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaacaagagttatactagatctagatcatagatatgattatatatcaatatcattaatcattagttttttccaaatttatttattccaatattataatattataataatcctccaatattataatttattccaatattataataatcttcgctgcataatcataacctaagaaaaaccaggccatacagagataggagctgaggggacatagtgagaagtgaccagaagacaagagtgcgagccttctgttatgcccagacagggccaccagaagggctccttggtctagcagtaacgccagtgttctgggaagacgccccttgccgagcggacggtggtctagcggtagcctcagtgtcaaggaaaacacccgctacttagctgaccgggaaagggagtctccctttccttgggggagtttagagaagactctactcctccacctcttgtggagggcctgacatcagtcaggcccgcccgcagttatccagaggcctaaccgtctccctgtgatgctgtgcttcagtggtcacgctcctagtccgccttcatgttccatcctgtacacctggctctgccttttagataacaatagcaaattagtgaaagtactaagtctctgataagcagaaataatggcataagctgtctctctctcttcctctttctctctgccttggctgccaggcagggaagggccccctgtccagtggacacatgacccacgtgaccttacctatcattggagatgactcacactctttaccctgccccttttgctttgtatccaataaataacagcgcagccagacattcggggccactaccggtctccacgtcttggtggtagtggtccccggggcccagctgtcttttcttttatctctttgtcttgtgtctttatttctacactctctcgtctctgcacacggggagaaaaaccctccgaccctgtggggctggtccctacaccaatctaccataacagatacctcagccaactgttgaagttatcactgcacaccaggcctgccagaatcccccaagactcttgtgttttcactgcgcagccccaatctggcccagtaaccaacctcagcttcccagccctccatttccctgagtaaatactgcctggaaacaatccttgtaccaatctctgtatccgccaggagtatttgttattggaaacgtaatgcagttctgaccttaagcagaaaataaacgtatttattggttagctctcagaatccacagaaaggatggagaacccaggctcagaattccagaggagcccaacagtcaaaatcacacctgcaaccggcccagtaaatatacagaagctgccagcagggggcagcagaggccacagcacgggatctacaacatcccgggggactgaagctcaagacgcccccgcagctactgcagccccactgccccgggagctggcagttgcaacccctgccaagaccaccagaaaacattgtccactgtgccctcctctttgtttccctaacacttgacccgatatccaaggcagtagcttcgacttgctgagcataaaccctgtgcacacctgctcgttctattgccagggaggctgcaaaaggaggatgcggctatttctgcttccatcatggaaggctgggattccacaggcacctaaaggaaagagggagagatgggaatgggaatgtcctccagacagctctggcaggatcggatgtgggagagtgagggtcccaccccagcgggggtctacccatgtccgtgtcttggacatgttgagagtttttccagaaggcagagatgaagtgtggtctgacaacacccaagtgaccccagagggtgtcataatagactggaagggcgacacatcccaggcacctgccacccatcacacacacctcccacacactggcatccttctgccccaggcacacacaaatcctcagtccagagatcaactgtctcagctctgaatttgcatatcctgtgtgtagactcactgatcacaacctctgcccagcctggcttgtgcatacttctttcttactgtcaggggaggagcccggcctggtactcccattggcctgtagattcacctcccctgggcatggccccaggacccaggataatacctgtgcctcctgcccagaaccttccaagcagacacaatggtaagaatggtgtctgtcctgctgtctctgctgctgcttctgggtcctgctgtcctccaggagacccgagatggtgagtggggaaagcaagggatgggtgctggagaggactggaaggaggtgaggaacaggacatgtggctgggagaagggctggatgcagctgggattccctggcatatggcaggaacaggtgtccaaggctgtcaactccctcagctcacacacttccaggagcattcagggagcctctgccctcacccaaaataagaccttcaggaatctgaatctaaaaccccttagtttacagtgaaaacaaagactccaaagaccaagcgacctgcttggggtggagagccaggacggagcaggaaccacaggcctggagctgcttctgctcctgttccttccctccttccgatggctgggtacacctgcctgacgctgaggaaaagagagaacagcccccaaggggaaagtgggaaggcaggttggctggagggatggtgctagaaggaaacccgtgccctcaccccacactcagacaccactgcag

SEQ ID NO: 3005 - DNA, 1276 bp, Homo sapiens
gatacgaatcccaaattcgcgccgcgtcgactgatacgcctcattctgggccaaacttctccctctacgtcttttttgctaggcaaggagggatgattatttattagcttctacagattagacaatggggtgggggtgggctcaaggtgagatgattttttgggtccaagtctactcaagacaggcatcccagtcttcggtctccaaatccacctcctgtctgtccccccacactgctcctcaggccttgtggatccattgactgtgatttctgtggttcagctcccacatcaggcagggaagggcagctactgggtctgagatcccacattgcctccaacccttgcttcctagctggcctcccagggcaccacgaggggctgggccaggctgctgtgctgcacgtggcaggagtagggggctgtgtcctgcgggggcactgccaccaccacccaggactggtaagtgccatttccattgtgaagaacatctccccgtaactcaggctcctgcacctcgccggcccgagtccagtgcacatcaattttccctgggtagaagtcgtaggccaggcacttcagtttcttcttttctcctggggcctggtggctggtgaccaccacagagggaggatcttgccggtccaggatatttttgctgtatttcaggtatttccgcagagtcgcagggcactcctcctccaggtaagccttggcccgctgcacgtagactggttctgcctcccacttctgcttggttatctgggctgctgggtcgaaggggacccaggctgggatttctttgttgaattcaatgtagtcctttccatcatagtaatatattttccagaatgctccgctgcttctgttattctcgatctcacaaccaaaccttccctgcaatacgtgagacccgttactgtcgttgtaatactcccacaatgtctttcagggtctcccataaagatgtcctcccttggccttctgaagttggctgtcctgcttccaatcctccattccttccacctgtctccagagtcccatgggctgagacttcctgtctttactgttgtatctaaagaactggaggtcattgagtgagccaagggcctgaaacgcggggacgtcttcaacatgcttggacagcccagtgtagatataggtcagagagtaacgaccatcttggttctcctgggggacagcaggacccagaagcagcagcagagacagcaggacaggcaccattcttaccattcatcgtcccgaggatcgtgccc

SEQ ID NO: 3006 - DNA, 708 bp, Homo sapiens
ggtaagaatgggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggtcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgttccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagggaggcattgctttggggaattattcccagtgtcctccttacttatcgcaagtaataaaaatcccctgggaaatcctcaaaaaaaaaaaaaaaaaaaaaaaaaaaaaaaaaaa

SEQ ID NO: 3007 - DNA, 418 bp, Homo sapiens
cactgatgtttgtgtcctgatgatccctccccggggcaggtccctcacctttctgggaagtacaacttctgcatgttacaaattccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagggaggcattgctttggggaattattcccagtgtcctccttacttatcgcaagtaataaaatccccctgggaaatcc

SEQ ID NO: 3008 - DNA, 463 bp, Homo sapiens
  misc_feature (1)...(463): n = A,T,C or G
antagaggtaagagnnaaananaggagaggnnagatnganngannaatagnggntngaggaagaanangnngaanaaagaggaaagaanaagagagaggagnagnnngagntgaaanaaaaaaanaanaataaaannnnanatnggagnggggtgggggggggngnnnnanaaaannaanaaaaaaaaatatttttnctgtatttnaggtatttccgcagagtcgcagggcactcctcctccaggtaagccttggcccgctgnacgtagactggttctncctcccacttctgcttggttatctgggctgctgggtcgaaggggacccagnctgggatttctttgttgaattcaatgtagtcctttccatcatagtaatatttccagaatgctccnctgcttctgttattctcgatctcacaaccaaaccttnccctgcaatacgtgagacccgttactgctcg

SEQ ID NO: 3009 - DNA, 838 bp, Homo sapiens
  misc_feature (1)...(838): n = A,T,C or G
ctcncanncaaaatgnaannacntcccaaaaaannaaaggnccaagggccntttngaggcccanggnnccnnnaccncaagggnacaananacannaattncctnnacaacnatngcagaaaccccgncctcnnnntncaaaacnccnaaaaatttccccanncantnnntgttggggacccntgaanncccnaaaccaaannngaaannctnangccngnaaaaanngccntaaaacncgggaagncaaacattttnagnnanancttaanaacngtnccanctgganncaccaacacccntnggccannataaaanccgaaancaccnanccncnaaaannnaaancacaaaccaaaggtcaatnaccnagtnntacttttttaacaattntctttnccaagggcaaagncaggggntgatttatttattaagcttctaccagaattnagaccaaatcnggatacnggtggacctcaaggtgagatgatttttttgggtccaaagtctactcaagacagncatccnaagtcttcggtctcnaaacccaccncctgtctgaccccccanactgctcctcaggccttgtggaaccattnactgtgatttctgtggntcagcncccacatcaggtannaagggcagctactgggtctgagatcccanattgnctccaanccttgcttcctagctggcctccnagggcaccacgaggggntgnnccaggctgctgtgctncacgtggcaggagtagggggctgtgtcntgcggcncgtgccgaattcctgcagcccgngggatccactagttcncagagcggncgncaccgcggtggagc

SEQ ID NO: 3010 - DNA, 759 bp, Homo sapiens
  misc_feature (1)...(759): n = A,T,C or G
ttttnnattattggttttntttttctntttntgtgttnttttttttgnncaantcttntttntttnngtntcnccaantctntgnttntaantctanctnnctnnnntnncncnncacattgtncttttnnnntttntgnatccattgatttgtntttcttntttttngntncntntannannnatgnnagntnannaattgggttntgngaccnnnattnnttccnnccnttgtttcttancttgcttctnantnaccacgagnngntgggccaggctnctgtgctgcacntggcagnantagggggntnttcctgtgggggcatgccaccaccacccaggactggaaagtnccatttccatggtgaagaacattccctgtaacncaggctctntgcacctcgccggcccgagnccagtgcacatcaattttcccngggtagaanccgtaggccaggcacttcagtttcttccttttctcctggggcctggnggctggngaccaccacagagggaggatcttgccggnccaggatanttttgctgaatttcaggnatttccgcagagtcgcagggcacncctcctccaggnaagccngggcccgctgcacgnagacnggtnctgcctcccacttcngctgggttatctgggctgctgggtcgaaggggacccaggctgggattcttngntgaattcaatgnagtccttccatcatagaanattccagaatcnccgctagncntccncgtgccgaatnc

SEQ ID NO: 3011 - DNA, 572 bp, Homo sapiens
  misc_feature (1)...(572): n = A,T,C or G
gctaggcaaggagggatgattatttattagcttctacagattagacaatggggtgggggtgggctcaaggtgagatgattttttgggtccaagtctactcaagacaggcatcccagtcttcggtctccatactgggtctgagatcccacattgcctccaacccttgcttcctagctggcctcccagggcaccacgaggggctgggccaggctgctgtgctgcacgtggcaggagtagggggctgtgtcctgcgggggcactgcaccaccacccaaggactggtaagtgccatttccattgtgaagaacatctccccgtaactcaggctcctgcaccncgccggcccgagtccagttgcacatcaattttccctgggtagaagtcgtaggccaggcacttcagtttcttcttttctcctggggcctgggtggctggtgaccaccanagagggaggatcttgccggtccaggatatttttgctggaattcaggtaatttccgcagaatcgcangggactcctncnccaagtaagccttggcccgctgcacgtagactgggttctgcctcccact

SEQ ID NO: 3012 - DNA, 318 bp, Homo sapiens
  misc_feature (1)...(318): n = A,T,C or G
aatacgtgagacccgttatgtcgttgtaatactccacgatgtctttcagggtctccataaagatgtcctccctggccttctgaagttggctgtcctgcttccaatcctccattccttccacctgtctccagagtcccatgggctganacttcctgtctttactgttgtatctaaagaactggaggtcattgagtgagccaagggcctnaaacgcggggacgtcttcaacatgcttggacagcccagtgtagatataggtcagagagtaacgaccatcttggttctcctgggggacagcaggacccagaagcagcagca

SEQ ID NO: 3013 - DNA, 203 bp, Homo sapiens
  misc_feature (1)...(203): n = A,T,C or G
aaaataatgccaattatcataacccatttngaagtanatncttttgagtaagtgccaccttggtaatacctggtggctgntgaccaccacagaggnaggatcttgccggnccaggatatttttgctgtatttcaggtatttccgcagagtcgcagggcactcctcctccaggtaagccttggcccgctgcacgtagactagtt

SEQ ID NO: 3014 - DNA, 569 bp, Homo sapiens
  misc_feature (1)...(569): n = A,T,C or G
naantttgggggttnggggggtgggctttaaaagngttaaaaattaaatttnttttagggggcnaaaaaggncttacnttaaaaancaagggaatccnaaggtcnttngggcncnaaaatccaatcgtccttgtctgcccnccanactgnncctnaggcctttgtgganccnattgacgtgtgatttctgtggttcagctcccacattcaggnagnaagggcagctactgggtctgagatcccanattgcctcnaanccttgcttcctagctggcctcccagggcaccacgaggggctgggccaggctgctgtgctgcactgtggcaggagtanggggctgtgtcctgcgggggcactgccaccaccacccaggantggtaagtgccatttccattgtgaagaacatctccccgtaantcaggctcctgcacctcgccggcccgagtccagtgcacatcaattttccctgggtanaagtcgtaggccaancacattcangtttcattcattttctccatgggnccatgcantgtncaaaattccatgatgcccaggggnaccacaangt

SEQ ID NO: 3015 - DNA, 2779 bp, Homo sapiens
tttttttttttttttttgaaggttttaccacatttattacattcataaggtctttctccagtgtgagctctttcatgtgcttgaagggacgtgggacatctaaagactttggcacatttttgacattcgtagagttttcctccactatgagttctttcatgtctgtgaagggaactggaacaactgagttttttcccacattcctgacattggtgggatttctccagcgcgtgagatctgatttcatgtgtccgaaggtaacctgcggaaatgaaggctttaccacattgtttacatttgtaaggtttttctccagtgtgagttctaacatgaatttgaaataaactgggataatcgataggttttccacagtatttacattcatagcgtttttctccagtatgcatttttccatgttttcgaaagaaactggaaactgtgaaggctctcactatttccctacatttataggacctctttccagtgtgagttctttgatggatttgaaataaattgggagaattaaaggctttcccgcacaccttgcattcataaggtctctttcgagttggtgttactgtgcgccgtgcaccactactgggggaaatggaggctttcccatgttgtttctgtttacggggcgtctctctccattccccaccacactcagatcgtttgtgtccagcatgagctctcatgtgcctgtccaggaatgaatgacggaggaagactttcccacacacgctgcatttgcatggtttcactccagtttgacttttcttgttcaggtgacaatcaggaatctggctgaaagtttctctgtgttcattcccttctttacgtccacagagtctctccaccagacttcttagcttaatccccaggttttggtacagattctcaatgtcctggtctttccattggattccgaggccaggttcctgaaggtttccagcgtcacatctctgtagagattcttctgggaaggactcagcaaagcccactcctcctgggtgaagttcacagccacatcctcaaaggccactgagtcctgaaacatcccacaggtgtggaggaggaggggtgagactcagcactggggatctctactcaatacatgagtgatcccatgacgccgggctctccaaacactcactccatgattgagtcatcggcctcctcctctctatctacacgcacttcctccctcgcagcagttccagtgtgagaactgacctactcagagagccagccacagaggaggaccaccctctctgtggtgggtccagggagtcagttgtgctgctgcgttgccccaaatgctctttgcagagtgaatctctagtacctgtcacaacaaactcccaccacctggtgtgcagacagcgctcatttcagcagtcctgagtctgggtatccttagaaaggcctgtttaccaagttcgacctttgctactatcggggtcaacttagactacgagagggatcccatcaacttaagtgacaaagtggcttactgtggctaaacggtttatggtattgacaaacaggatggtactgactgaactgttttccttctgaaagcctactcttttgttccaaactagaagtggtgcctagggcactagccccagaaaaacactctgggcacagagtctttaatgagctttcctgggagacaatatgtcacacgtgttgtcacaacttgtcccctggggaactgagctcatcccatgtggttataccaagagagaatatcctgaagcttgcaagcagtttactctagaccaaatttaatcaagtagtaaataagattcatgatcaatatttaattgtcctaatggaagaattttaaaatttctgtcaggtaatgtcaaagcagtatggagtaagtggaaagataacatgtgttcctagaaaaaactcaataagatgtcccttcttccaaatgatatccttacaaaatttcataaatacccaatacagctgggtgtggtgactcacacctgtaatcccagcactttgggaggccgaggcaggtggatcacttgaggacaggagtttgagaccagcctggccaacatggtgaaaccccatctctactaaaaatacaaaaaattagccaggcgtgatggcgcatgcctgtagtcccagctatttgggaggctgagacagaagaatcacttgaacccaggaagcggagattacagtcagctgagatcatgccactgcactccagcctgggcaacagagcgagacgccgtctcaaaaaaaaaaaaaaatccccaaaacagacattttaggtaaacaaaagctacttttccaaacctcccaccacctggtgtgcaggaattaacatctaataattgtcaaagccttctgaatagcaggtggatggcttacctaacaccaaagatttccaaaccatcacattcaggacagcatactattagcagagagataaacaaatagatcaaggaaaaagaagagtcttcaatgggccagtattcatatgaaaacttggttaataacagagcaggcatgtagagtagtagggtggaccacttgaggtcaggagttaaagaccagcctggcctacatagtgaaaactggtctctactaaaaatagaaaaattagcctggcatggtgggcctgggcaacagagcaagactccacctcaaaaaacaaaaaaattaaaagttatagccacctctagaaaaattttttaaaaacattagcagggtatgttagcaggtgtctgtggtcctagctacttgc

SEQ ID NO: 3016 - DNA, 2322 bp, Homo sapiens
acccgggctcgcgtctccgtttctccgagaggctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaaccgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaataaaaaaaaaaaaaaaaatcttctatagattgagttggtttaagaggtctactttgtattgcaagcattgttgtttctacggattagcgagcctgttcttgattaaaccaactagatggga

SEQ ID NO: 3017 - DNA, 673 bp, Homo sapiens
gcgtccagctggatgtgggtgggccggcagccgggactccgggcgtcctgtcccgtccctgcccgtcgactgcggccttggcccgaagcccttttgtgcagctccgcgcccgcagcccgacgccccagcttgtgcggggccacgggagggtcatgcgcggcatcctgactcgggtgtggggttcgtgcgtgggaggagcagtggtctgtggggcccccagtccccactttctcctgttaaaaattaaactgaggtacgttaacaattaaagagttcatttgagcaaacagcgattcacgaatgagaaacaccccgtcctggcttgtggtttgtcaacggaaaaagccaaactatgtaaaataaagaagtttattcagagccgagtaggagagaccttggcccgagggaacaacacaaccccaagcagcctggagtaagtggtccggagccggctcaggacagtttggttttattcatttcagagagacaggaattgcagggaaaatgatgaattagtgcctggaaggtgtaatttccttaggcagaaagggagggacctggccgggcacggtggctcacgcttgtaattccagcactttgggaggccaaggcgggcggatcacctgaggtcaggagttcaagaccagcctggccaacatggtgaaacccgtct

SEQ ID NO: 3018 - DNA, 407 bp, Homo sapiens
tgggccggctgccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgaggtacgttaacaaaaagttcatttgaggaaacagccattcacgaatgagaaacacccggtcctggcttgtggtttgtcaacggaaaaaaaacagactatgtaaaatacagaggttgcagcccagccgaggatgcgccactgcactccagcctgggtaacagagtgagacccca

SEQ ID NO: 3019 - DNA, 448 bp, Homo sapiens
gatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcaaa

SEQ ID NO: 3020 - DNA, 456 bp, Homo sapiens
  misc_feature (1)...(456): n = A,T,C or G
ccttgnggctaattngccgcgcccactactacttatgcgagagcccnacagaaggggaagcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatggattcagtggcctttgaggatgtggctgtcagcttcacccaggaggagtgggctttgctggatccttcccagaagaatctctacagggatgtgatgcaggaaaccttcaangaacctgacctctgtanngtaaggaatgacaatattgcttcccantggaattagagaacaanatgccttctagctcaatcantgncggttcanttgattttgggga

SEQ ID NO: 3021 - DNA, 958 bp, Homo sapiens
  misc_feature (1)...(958): n = A,T,C or G
acttggtttcgcttcgctagtcccagaggcccagagtggctcgcctggagtctctgtggcgcggtttcctgtacctgccttgggatccggagggaggaagctgggacacccgggagtcaggaaatggactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccacnaacattaaagatcactncaaacaccgagggagaaatctaanaagtcatatgtttanaaagactctatcaaactaaggatggtagtcagcgtggaggaatttttanccnctttgcaaatcanaatctgagcaagaaaaatccctgggagtggaaacttcttttgaaaagccattgttttatgggaggaaaggtcagcatggggtcaattcatccccttttataagacgccctcaaagaacacccgggggacgttgaacccaaaggaatatcatggaatatttgcggaggaagccccgaatacacccttaaccagtgtggacgagccttgagttatcatcgctcttttccagtacgtgaaaggnctcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggnaagctttcagttgttccaagtacattcg

SEQ ID NO: 3022 - DNA, 380 bp, Homo sapiens
  misc_feature (1)...(380): n = A,T,C or G
cttgttcagttgaaaatcagnaatctggctgaaangtttctctgtgttnattcccttctttacttccaaagagtctctccaccagacttcttagcttaatccccaggttttggtacagattctcaatgtcctggtctttccattggattccgaggccaggttcctgaaggtttccagcgtcacatctctgtagagattcttctgggaaggactcagcaaagcccactcctcctgggtgaagttcacagccacatcctcaaaggccantgagtccatttccggcttccgggtgtcctgggtccttcctggggctggagcagccagaacaggtcccacacgaaagaatcagccgtatccggggcaccaggggctccccgagg

SEQ ID NO: 3023 - DNA, 389 bp, Homo sapiens
cactgagatgccctatttaaatgacagaaactaagaaaccatctctacatctgctcaaagcttcgtgcaggtgctcacgcggatgcgtccaggctccaaattatcaacaccatgtaatggattctctacctgtcggaggaggccagcggttctgttggaacccacagcctccactttctcctgttaaaaattatactgagatgtttcaggacccagtggcttttaaggatgtggctgtgaacttcacccaggaggagtgggctttgctggatatttcccagaagaatctctacagggaagtgatgctggatactttctggaacctgacctctataggaaaaaagtggaaagaccagaacattgaatatgagtaccaaaaccccaggaga

SEQ ID NO: 3024 - DNA, 622 bp, Homo sapiens
  misc_feature (1)...(622): n = A,T,C or G
cagtagggtgccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcaagagttgattctggacaccaacccacatgagtatcangga

SEQ ID NO: 3025 - DNA, 823 bp, Homo sapiens
  misc_feature (1)...(823): n = A,T,C or G
gggccgctggatgtgggtgggccggcagcgggactccggcgtcctgtcccgtccctgcccgtcgactgcggccttgcccgaagcccttttgtgcagctccgcgcccgcagcccgacgccccagcttgtgcggggccacgggagggtcatgcgcggatttcgactcgggtgtggatttcgtccgtagaggaagcagcggtctgtggggcccacagcctccactttctcctgttaaaaattatactgagatgtttcaggacccagtggcttttaaggatgtggctgtgaacttcacccaggaggagtgggctttgctggatatttcccagaagaatctctacagggaagtgatgctggaaactttctggaacctgacctctataggaaaaaagtggaaagaccagaacattgaatatgagtaccaaaaccccaggagaaacttcaggagtgtcacagaagagaaagtcaatgagattaaagaagacagtcattgtggagagacttttaccccagttccagatgacaggctgaacttccagaagaagaaagcttctcctgaagtaaaatcatgtgacagctttttgtgtgaagttggcctaggtaactcatcttctaatatgaacatcagaggtgacactggacacaaggcatgtgaatgtcaggaatatggaccaaagccatggaagagtcancaanctaaaaaagccttcagatatcacccctcccttgagancacaagnaaggggtccacactgggaaagaaaccctatgctttgttaaagaatgatgggaaaaaaccattattttaccattcaaggatttca

SEQ ID NO: 3026 - DNA, 456 bp, Homo sapiens
  misc_feature (1)...(456): n = A,T,C or G
tttgtttctgganaccgtccccacccgggctcgcgtctccgtttctccgagaggccccaaggtgtcttcgccgcagcctctgtcgcgccgtgacctgtacaggtcgcgggagtcgtagggaggacgccgggacacctggaagccgagaaatggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagaccagaacatttgaaagaccccattcaaaattcccaggagaaattataaagtcatattccagagagactctgtgaaaagtcaaagaaggtgggtcaaggtgaagaaacctttcagccagattccagatggtattctgaacaagaaaacttcctggggtaaaa

SEQ ID NO: 3027 - DNA, 303 bp, Homo sapiens
aggacggccagacacctggaagccggaaaatggactcagtggcctttgaggatgtggcagtgaacttcacccaggaggagtgggctttgctggatccttggcagaaaaaactctacagagatgtgatgctggaaacctataggaacctggcttcagtaggtgatgacgacaacattccttcacttagagaacaagttgcccatcaacgatatttcaagacctggcatgtggaaagggaatacttcagtaaataaaccaagcatggtgacagctaaaaaaaaaaaaaaaaaaaaaaaaaaaaaa

SEQ ID NO: 3028 - DNA, 504 bp, Homo sapiens
ccaactacttgggaggctgtggtgggaggatcacttgaacccaggagacagaggttgcggtgagttgagatcgagattgtgccactgcactccagcctgggcacagagtgagattccgtctcaaaaaaaaaaaaaaaaaaaaaagtagaaagcaagaaagtgtctctgtacaggtaggcatgaaatgaatccttctcttcctcccctttactcctttaaccccttctcctgcaatgtcttgaagtaaattactgtcattacagaagagcaatgcactgcatccccccaaaacctttctatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaatgtataagttttaaactgcaaaaaaaaaaaaaaaaaaaaaa

SEQ ID NO: 3029 - DNA, 1054 bp, Homo sapiens
  misc_feature (1)...(1054): n = A,T,C or G
ntaaaagccaaaatgntgccccgaggaggcccgcaccggtagcagttgaaggttggggagcaagcttatgcggganagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatccggccagtatgcagcctcttcttccttggtgggttgggggttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaaaaaaaaaa

SEQ ID NO: 3030 - DNA, 439 bp, Homo sapiens
agccccagagagcccctacagctatcctttatcccgttttttgtttgttttttggagacggcatctccagcctgggcacagagtgagattccgtctcaaaaaaaaaaaaaaaaaaaaaagtagaaagcaagaaagtgtctctgtacaggtaggcatgaaatgaatccttctcttcctcccctttactcctttaaccccttctcctgcaatgtcttgaagtaaattactgtcattacagaagagcaatgcactgcatccccccaaaacctttctatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaat

SEQ ID NO: 3031 - DNA, 429 bp, Homo sapiens
  misc_feature (1)...(429): n = A,T,C or G
acttcccctcaacattancgggttcacctaaggcccacatgcctcctaaaaaccccgggacactgacctggggaagttcctatgtctggtttaccatgggaagcgacacctaaaattgacttgtaccctttccttccttttattgtagaacgagatggcctatttatgaattcattcataactttgtggaagttttagatgagtatttcagccgagtggtaagtctaatggctaaaaaatggtttacttcctcaacccagtttcccagaaattgagtctctttggatctatatcaagaacatgtgttaatacagagttttaataagtaaaagttaaaacttaagtgatgccaaattttctttatctttccttctggtttatccaaagtgttacaagcctatacatgcctgagatctttataaagaacta

SEQ ID NO: 3032 - DNA, 407 bp, Homo sapiens
gaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtggtaagtctaatggctaaaaaatggtttacttcctcaacccagtttcccagaaattgagtctctttggatctatatcaagaacatgtgttaatacagagttttaataagtaaaagttaaaacttaagtgatgccaaattttctttatctttccttctggtttatccaaagtgttacaagcctatacatgcctgagatctttataaagaactgg

SEQ ID NO: 3033 - DNA, 396 bp, Homo sapiens
accgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaat

SEQ ID NO: 3034 - DNA, 593 bp, Homo sapiens
ttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggattatcacaaaacattggcaagtatttttatttaaattattttcaaatttgacttctacagccaagtggaattggtaggctgtagctgttacactgaaatttctagtctttgtaagtgcctcctgaaagtcattaaaatggaaaaatatttcaatgagcttttccttttttcatatttatggacatgaatattttattgaagatcattaactggggtatccttccaaagacattataaataggcattttccacagttcctaaaaagaaaacacaactgtactttaaaatatgtacacagaaaaaaatttcattaaactgagagagaagttttattttctaattgtaaacatatctgtcgcac

SEQ ID NO: 3035 - DNA, 595 bp, Homo sapiens
  misc_feature (1)...(595): n = A,T,C or G
gtgcttcccaggttcaagtgattcttctgattcagcctcctgaatagctgggattacaggtgtgtactaccacgaccagctaatttttgtatttttagtagagatggtgtttcaccatgttggaccaggctggtcttgaactcctgacctcaggtgatctgccctccttggcctcccaaagtgttgggattacaggcatgtgccatggcgcctggncccaagtttatttttaaattgttttatctgctgtttctcatgctataccagattttcctccccatggcttgctccctagagttctttggtatcacatctgtatacctttttgggatttccagcatttgagatattaatcttaaattaatttggggggtttcaatcaattttagattgttcatggtaattgctagtgagcaaccaattaactctgttttattagtttcctcaatagcactatatgcagctgttgataaaataaatgtaaagttctaatttttgttttagctaaaggttgactgttagggataatatttatatttatagtatttatttatttattttgatacggtgacagagcnaagatccgtctcagaag

SEQ ID NO: 3036 - DNA, 3258 bp, Homo sapiens
gaattcggggtgcagtccccgactcgtcccggcccgttcggagccgcccgagagcgcacaaaggccgacggtttgggcgcgtgcgcgggacacgggggacgggcggtgtcacgtgatcgcgaggccgcgggcgcgcgggcgcgactcggcttcaacttctttttccacagatcctggtcctacaaataagcctgctcatgtgagataagaaagagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagccttctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaaccagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaaaaaaaaaaaaacccgaattc

SEQ ID NO: 3037 - DNA, 392 bp, Homo sapiens
  misc_feature (1)...(392): n = A,T,C or G
ggcacgagcccagttatccgggaggctgaggcaggagaatggtgtgggcctggnaggcagagcttgcagtgagccaagatcacaccactgcattccagcctgggtgacagagtgagactccatgtcaaaaataaataaataaataaataaataaataaataaataaataaataaataaattttntntcctcaacttgcgtatgttgacatctttaactcccaaagtgcattgtttttaggagctggggatttttggggacatgatgaagtcatgaggggctctgcagaatgggattaccccccttcatgggaaggacaccccaaaggntatttcatggccactttctacttgtatttgggtttacttcaaggaaggtnggcttctctgtgga

SEQ ID NO: 3038 - DNA, 4518 bp, Homo sapiens
gggagctggtaggagtccctgtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaatgtgtaaggtacatagtccttttgcagagaatctgaactgattacatacaaacaaattcatgcagagagaaaaccacgttagtaatgtgaactgattaaacagcagtgtgctcctagcatacatgcatataggcagtgtagagcagcctgttgctagattttcacccttggaagacaatgcaatttccaggagcgaattttaatgaatgcagagaatgcactagtgccttcggtgattaattacctcatattttatgtcacaataaacatgtaggaaataaacttgatacatccaatgcagaaaagtcttgaaaattttctaagtaactatgtcttgaaaagtatttactgagataaatcttacaaaggagtaggctaggaaagccttctatgggaagaaagaccctatctcttcagtgatcataatagatcatcaatgaacttacacatactagcagcattatcatgggaaagcctttgcccagaaataaaaccttaacagttggcagatatatttcatactggagaacaagtttcagatggcagtgaatacacgaggatttcagtgatacatgctgcctcatcatcattacttcatacagaaataaaacttatatgaagagtaactttaaaaaggatcaggaaattcatgaagtaaaaaagtctcatgaaaatgatacataatgccgggcatggtggcttgcacctgtaatcccagcactttgggaggccaaggtgggtggatcacttgaggtcgggagttcgagaccagcctgaccaacatggtgaggcccccctctctgctaaaaatacaaaattagccgagcatggtggctcacgcttgtaatcccagctactctggaggctgggctggagaatcacttgaacctgggaggcagaggtttcagtgagccaagattgcgccattgcattccagcctgggcaacaagagcgaaactctgcctcaaaaaaaaaaaaaaaaaaaaaaccatatttgaggactgtcacaaatctaaactcatgatacacttgatatctattctgtgacagcataccttgcatcatattatcaatgattccataattgtaaagcgggctgttcttatcactgattaaattttaatcctatatataacacaggtgttttctgtgccaatctggtgttatttattagttcttacatattataggccccaaatttatttttttcaatttactgataaatgtaattcagtatatttggatgtgtttatccaagttactaggtaccattatgtagtttacaaaaatgccttaaatgttatttttctaaaatttgttttgaaataattctagattcacaagagattacaaaatatacaaaagtttcctgagtattctttgcttagcatcatcaatgttatcttacataaccataataataaaaaccacggagttctgctcttgttgcccaggttggagtgtaataggcacgatcttggctcactgcaaccccgcctcccaggttcaagagattttcctgcctcagcctcctaagtagctgggattacaggcacccacgaccacgctcgactaatttttgtatttttggtagagacggggtttcactgtgttggccaggctggccttgaactctcgaccccgggcggtccacccgcctcagcctcccaaagtgctgggattacaggcatgagccaccacgcctggcctcctcttgctacctctttatactcacactgtcctcccaatatgacccatggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgactatttgtgtacccg

SEQ ID NO: 3039 - DNA, 449 bp, Homo sapiens
tccttagagctccagctaatccagatgcaacattgacgaattagtgccggaatgagtatcagcacttgaaaaccctacagagatgccttggtcactccagataagagtttctgtggctgagaggccccactgtatgactcctgtttctgcctgctggacttcactttctggggcttggcatctgatgacctctgtatacatgctgtgcctcctgttctttatgtggccacttcactttgtcctttgggtttcagcttaaaagtagagtcaactagaaatcttcattaccatgctgagactagttaggatgcccctggctcatcagctgtaatgcctctgtcaaagctccactcaaacatgctagaaccatcgccttcccctcctcaactgtaaaccacagaaatgcagaggccctgtctgttttgttcatcagatctccggagcatagc

SEQ ID NO: 3040 - DNA, 730 bp, Homo sapiens
acttgagggaggaaagtgcaggacaccgaggggacctgtgtcttgtgtttcagatggctggagtacagtggcacgatctcagctcactgaagccttacctactgggctcaagcgatcctcccacctcagcctcgcacatagctgggactacagtatagaaacttgatacctccctgcaagctgagggagcaggctccggccttggcagcccagaaaggggatcccacaatgcagcggtgggctgaagtgttcctcaagtgccgccaaagtgggagcccaggcagaggaggcgccgagagcgagtgagggctgtgaggactgccagcacgctgtcacctctcaacactgcggtgctgataatgacacttcctgataattaggaatgtggagccaagatggccgaataggaacagctccggtctacagctcccagcgtgagcgacgcagaagatgggtgatttctgcatttccatctgaggtttttcccatggtgttccctttccaatgtctttctggaagtcacacattgaccactaacaacaggagagaggacaaagaaaggcagcaaaagactatttccaatgcgaaatatgatcagttcctgcttcctggttgctgtgaggattcaatctaataatatatattagaatgttcctgaacctctaaaaggcttaaaaaatcttgacaggcttactgttattctaataaatgttccaaataatagaaaaaa

SEQ ID NO: 3041 - DNA, 1485 bp, Homo sapiens
  misc_feature (1)...(1485): n = A,T,C or G
tnctgggacaccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttgga

SEQ ID NO: 3042 - DNA, 535 bp, Homo sapiens
acaaagtttgtggttatagggccccaaaaacactgtttgtcacaatatagcaactggaggaatgtcattttggcaccacagaaccagatttttgagaagcacccgtgttataaaccccccgacggggggctcctaaaagagtcttggcacatcgcgggagcattccacgaggaggcccaagagacgccttctcttgagcaatatgcggtgtgggtgtctctcccggataaagaccggagttctcggtaatcctcccaaccccgggttcatgtggactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaaaa

SEQ ID NO: 3043 - DNA, 451 bp, Homo sapiens
gttgatgccaacccattttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctgtatccttggtgtctgaatcatttagaaggtgtcttctgtaataaacatatcttaacttgtaaaaa

SEQ ID NO: 3044 - DNA, 775 bp, Homo sapiens
ttttttttttttttttttagaacaaggtctggttttattttcttttttttttttttttttttttaaataaaagagggaatttattagaagaatacagaggttcttgcagagattccaacagctgcaaggggtcaacagctagaatcacgcctttctgaaggacagagtatgctgtaaccacaaacttctaattctgggttctgcaccatcaggaagagaatatcctacaggacagttctccttgtatactgcataaaggactagaatgtggattcatttctgcttgctttttgatccttatagtcctttatgctggcctcaaacttgtcaagcacatgttggcagacattcatgagctcattcaggcctctctgaaatggctcaacagctggaagggtacctcgagtctgaatgcgtaaattaattttgctctctgaaggatgggtcgtagtgtaaccacaaaattccacttccgggttcttcatgatcatgtaacgtagagaatttcctagggtatggtcttcctcgtgcaatacaaatgtcacacagtgtctatctgttccagctgcctggaccatttccagggctgtcttcctctcgccttcagccattgaggtcttcaatccagatatttttctctccagctcctgatcctcttccatcgctggggcggtttctggatcctcaggtggtgctggcggatcgggggctctgtcccattagcgcgaggcgcggaggcgaagcaggaaggaaggcccgaccgacggaaggcgcg

SEQ ID NO: 3045 - DNA, 911 bp, Homo sapiens
tttttttttttttttttttttttttttaggatttataagtattttatttttctgagaaatgaccaaaaaattggaaccagttttaacaatctctgaaaactttaaattctagacatgtttattttgaaacacacttccaaacaagataaacaacaatatgtaagtctactacactgcagaagtagcttaaacttgccaagacatcctcctttgcacttgtttcctcaagagttgctaggtcattttttttgcctgtggccagcagcctctttaaaaacaacaaaggacctaatgtcaaagtcactctcaggtgtttgccctgccagctcaggccttctccgcacaccgcaccccgaaggagcacggaggcccgcagggctggctggccctggttccagcctcaccgccggttggaccgcttttcgtacttgtcctggctgtccgctttcgtggcggggagtaactggcggaacctcgagcgcggaagctgtgcttgtaaggatggcttctgtgtttcttcgggttttcttctttctgggcctggctcttcgctggttccttatcgccctctttttgttcatggtcttgctctttatgagagggcaatgtgtttttaattgtgttaattagaaatcttttattggtgctagcaagaggacacttcatccaacccatgggtcccattgtttcagctctagttttcccacgttttgcctccttaagcagttcttctattgctttcctctccagctcctgatcctcttccatcgctggggcggtttctggatcctcaggtggtgctggcggatcgggggctctgtcccatagccgaggcgcggaggcgaagcaggaagcaaggaccgaccgacggaaggcgcggaggacggaaggagggaggaggagcgcagcgg

SEQ ID NO: 3046 - DNA, 800 bp, Homo sapiens
  misc_feature (1)...(800): n = A,T,C or G
gggtttcccccanggtnccggccgnttttaaaccgccggcccaggtggattttttattncggccncncntttggggcggaatttgggntcccggggccccccccnccggtttttttttnttttttttnaattaaaggnggggatttttttttggaangatccagggggttctttccagngttccaacagntgnaaggggnnaccagctagantcacgccttttctgnaggcagagtatgctgtacccacaacttctaattctgggtnctgcaccatcaggaagagaatacctacaggacagttccccttgtatactgcataaaggactagaatgtggattcatttctgcttgctttttgatccttatagtcctttatgctggcctcaaacttgtcaagcacatgttggcagacattcatgagctcattcaggcctctctgaaatggctcaacagctggaagggtacctcgagtctgaatgcgtaaattaattttgctctctgaaggatgggtcgtagtgtaaccacaaaattccacttccgggttcttcatgatcatgtaacgtagagaatttcctagggtatggtcttcctcgtgcaatacaaatgtcacacagtgtctatctgttccagctgcctggaccatttccagggctgtcttcctctcgccttcagccattgaggtcttcaatccagatatttttctctccagctcctgatcctcttccatcgctggggcggtttctggatcctcaggtggtgctggcggnancgggggctctgtcccattagcgccttntgn

SEQ ID NO: 3047 - DNA, 501 bp, Homo sapiens
  misc_feature (1)...(501): n = A,T,C or G
ttttttttttttttttttttttgaaaactttaaattctagacatntttattttgaaacacacttccaaacaagataaacaacaatatgtaagtctactacactgcagaagtagcttaaacttgccaagacatcctcctttgcacttntttcctcaagagttgctaggtcattttttttgcctgtggcagcagcctctttaaaaacaacaaaggacctaatgtcaaagtcactctcaggtgtttgccctgccagctcaggccttctccgcacaccgcaccccgaaggaggcacggaggcccgcagnggggnntgggccctggggnttccagccttcaccgccggttggggacccgntttttcggtacttgtcctgggggttgctccgntttcgtggggcggggggnaggtaactggggcggggaacctcgaggcgcgggaagnttgttgntttgtaagggatgggntttctntgtttctttgggggtttttcttctttctgg

SEQ ID NO: 3048 - DNA, 522 bp, Homo sapiens
  misc_feature (1)...(522): n = A,T,C or G
tcctcaaggaccatttggttgcatggaacagaaaccagtcaaactagtttaaataaaaagagggaatttattagaagaatacagaggttcttgcagagattccaacagctgcaaggggtcaacagctagaatcacgcctttctgaaggacagagtatgctgtaaccacaaacttctaattctgggttctgcaccatcaggaagagaatatcctacaggacagttctccttgtatactgcataaaggactaggaatgtgggattcatttctgcttgctttttgatccttataggtcctttatgctgggcctcaaactttgtcaaggcacatgttgggcaggacattcaatgagcctcattcagggcctccctcgaattgggctccacaggctgggaagggggtaccctcggaggtctggaatggcggtaaatttaattttggctctctggaaggggtgggggtcntaggtnttaacccccaaaattcccacttcccgggtttctttcaaggtccnagtaacgt

SEQ ID NO: 3049 - DNA, 424 bp, Homo sapiens
  misc_feature (1)...(424): n = A,T,C or G
tttgttaaacaaaagagagaatttattaggcaaatatacttgcagagattccaacagctgtatgggtcaatagctagagccacattttctttcctacaggacagtacatgctgcaatcacaattctgggttctgcaccatcctgagggtggtcctgcttgtaccctgcacgagggactagaatgtgggctcctttttgcttgcctttttagctttatagtcctttatgctggcctcaaacttgacaagcacatgctggcagacattcaagagctcattcaggcctttctgaaacggctcaacagctggaagggcaccccgggtctgaattcgcaaattaattttgctctctgaaggatgggtcgtagtgtaaccacaaaattccacttccgggttcttcatgattatgtaccgcagacagtttn

SEQ ID NO: 3050 - DNA, 806 bp, Homo sapiens
aggctctctccagtgtgactctctggtgttcaatgaggtgagcattacggctaaaggattttccacagttactacacccgtaagccctttctccagtgtgaactatttggtgtataaaaaggttggacatatctctaaataacttcccacattcactgcattcatacgtcttttgcccagcatgtagtctctggtgctgaacaagtaaatatttctgaccaaaggctttcccacattcactgcatttgtaatgcctttttccagcatgaaaggcctccctacttttggagctcctatgtgacttctctcctgtgtgagtcacctggtgcttgagaacacctgagctgatcaggagggccttcccaacctccctgctttgcaaggacttctctgataggtgaactttgcaactcctcaaaactgggaccctgccctgttgtctttttaagggtttctctccacagtgctgcttctggtgttgctgaatgtttgaactgagcagtcctacagaagcaatctgctcaggagcctcctcagcctcggctccatgccaacaacctctcggtatggctgaagtcacaacttcccaagcaggcatgaagggctcctcccatgactccagctgggttatttcatgggtcttggaagacgcaagtcccagagaggccagaagtgtaaagttctccagcatcacattgcggtagaggagcctctgagcgtcatcaagcaatctccattcctcctgggagaagtagacagccacatcctcaaaggtcacatagcctgagcggggtccctcagggcgg

SEQ ID NO: 3051 - DNA, 575 bp, Homo sapiens
taatggtcataagggtgtatgggaaataaatatttattaaagaagatctaacattcacaagaacagcaaaagtgagtcacatttgaaccaagaccactcctttcctcccccaactccaaactcagcgagatcaaaactccattcgacgggtacagccaagaatacagggctccctctctctggagctccaaggcagagggctgtcttctcaggaaggacaatctgtcaggaattctcatcttgcctccagtgtgcatatttagatgaatgatgttcaattgccagctccctcataaaggccatcctcagagtttctctcggtatggctgaagtcacaacttcccaagcaggcatgaagggctcctcccatgactccagctgggttatttcatgggtcttggaagacgcaagtcccagagaggccagaagtgtaaagttctccagcatcacattgcggtagaggagcctctgagcgtcatcaagcaatctccattcctcctgggagaagtagacagccacatcctcaaaggtcacatagccctgctgagcggggtccctcatgggcggccgcaagc

SEQ ID NO: 3052 - DNA, 491 bp, Homo sapiens
ttttttttttttaatggtcataagggtgtatgggaaataaatatttattaaagaagatctaacattcacaagaacagcaaaagtgagtcacatttgaaccaagaccactcctttcctcccccaactccaaactcagcgagatcaaaactccattcgacgggtacagccaagaatacagggctccctctctctggagctccaaggcagagggctgtcttctcaggaaggacaatctgtcaggaattctcatcttgcctccagtgtgcatatttagatgaatgatgttcaattgccagctccctcataaaggccatcctcagagtttctgttttaagtgaggtcatattgattcagagacagtacataacctgtcaccctaaggcctttctccagtgtaaactttctggtgttgaatagggttaggcctttggctgaaacctttttccatattcactacattgtccacattgtaaactgtccagtgttgaatg

SEQ ID NO: 3053 - DNA, 381 bp, Homo sapiens
tttaagggtttatggcaagtaaatatttattaaagaagatctaacattcataagaacagcaaaagtgagtaacatctgaatcgagaccactcctttcctcccccaactccaaactcagtgagattaaaactccattcgactggtgcagccaatacagggctccctctctctggagctccaagacagagggctattttctcaggaggaacaatctatcaggaattctcatcctgcctccagtgtgcatatttggatgaatgatgttcaattgccagctccctcataaagatcaccctcagagtttctgggttttttttttttttgagacgaagtccactctgtcaaaaaaaaaaaaaaaaacaactggaatgaaatagttgg

SEQ ID NO: 3054 - DNA, 602 bp, Homo sapiens
gaatcgcctgatgacaatgctcagaatgtgtctccatcattaagagatacatgactacctaccccatcaatcttgcctattccagaaacaaagtgaaattaataatataaaattggtttgatcaatttatgaattacattgtcattgaaagtaggagaactagaccaggaggcactggtgtgaccctggagtagatggaactgtttgtgcatgtgtctttcttaccttccattctcataaagaattagcacattccccacatacaccctggccagactgtgtctttgggactgcagcactaaggtgtgtttttgtttgttaacttattcccagtgcctgtgttgaccagggaggctttgggaataaaggtacataaaggtcttcggagcctgggatgagcctgtggtcaagagatgggcaggcagtgtccttgaatttgggaatgtgactcacactctgcctgtaggggggaagaaaagagagatccagactgtttactgtgtctatgtagaaagggaagacagaagagactgcattttgaaaaagacctgcactttaaacaattgctttgctgagatgttgttaatttgtagctttgccca

SEQ ID NO: 3055 - DNA, 542 bp, Homo sapiens
atttacttttttcttttaatattcacgaagctttattgcagctgtttcccttacccagttgaagtggccagtcattttaatttgcagttctatttacattcccaaggtaaccacgttcagtaactctctagaggctaagctgttaaaatttccatttttatacaaatagcaaagatatttctttccctttctttctttctttctttctttctttctttctttctttctttctttctttctttctttctttcttttctttctctctttccttccttccttccctccttccttccttcctttctttctttctgtttgagacagagtttcgctcttgaccccgaggctggagtgcagtggcccggatcttggctcactgcaacctctgcctcccggattcaagcgattctcctgcctcagcctcccgagtagctggggctgcaggctcgcccgagcccaggaaagttcgagtccaagctgggcaacagagcaaaaccttgtctcttaaaaaagaaaaaaaatagagttcagaatagataaaagag

SEQ ID NO: 3056 - DNA, 474 bp, Homo sapiens
ttttttttttttatattcacgaagctgtattgtagctgtttcccttacccagttgaagtggccagtcattttaatttgcagttctatttacattcccaaggtaaccacgttcagtaactctctagaggctaagctgttaaaatttccatttttatacaaatagcaaagatatttctttccctttctttctttctttctttctttctttctttctttctttctttctttcttttctttctctctttccttccttccttccctccttccttccttcctttctttctttttgtttgagacagagtttcgctcttgaccccgaggctggagtgcagtggcctgatcttggctcactgcaacctctgcctcccggattcaagcgattctcctgcctcagcctcccgagtagctgggattacaagcacacaccaccacgcccggctaatttcacccggctaattttcatcgtgccgaatt

SEQ ID NO: 3057 - DNA, 489 bp, Homo sapiens
  misc_feature (1)...(489): n = A,T,C or G
tttttttttttttttggagatatatattcacgaagctttattgcagctgtttcccttacccagttgaagtggccagtcattttaatttgcagttctatttacattcccaaggtaaccacgttcagtaactctctagaggctaagctgttaaaatttccatttttatacaaatagcaaagatatttctttccctttctttctttctttctttctttctttctttctttctttctttcttttctttctctctttccttccttccttccctgccttccttccttcctttctttctttttgtttgagacagagtttcgctcttgaccccgaggctgggagtgcagtggcctgnatcttggggtgacaaaggcaaggactccatcccaaaaaaatggaatgaattaaattaattaaaaaaaaaaaggaatttttctaccnggggacagacaggntttccacanggggccccnaaacagtgttcaggtncattcc

SEQ ID NO: 3058 - DNA, 436 bp, Homo sapiens
cccagttgaagtggccagtcattttaatttgcagttctatttacattcccaaggtactcacgttcagtaactctctagaggctaagctgttaaaatttccatttttatacaaatagcaaagatatttctttctctttctttctttctttctttctttctttctttcttttctttctctctttccttccttccttccctccttccttccttcctttctttctttttgtttgagacagagtttcgctcttgaccccgaggctggagtgcagtggcctgatcctggctcactgcaacctcggcctcccggattcaagcgattctactgcctcagcctcccgagtagctgggattacaagcacacaccaacacggcggctatttcaccggctatttttgttttttagtagagactgggtttcgccatgctagccaggctg

SEQ ID NO: 3059 - DNA, 426 bp, Homo sapiens
tttttttttttgtagagatgggactgtcactatgttgcctaaattgatctcaaatttctggcctcaagcaatcctcgtgccttggtttcccaaagtgctgggattacaggcatgagtcactgcattcaacctacattttgtttaaaatccttccatttgtattcggcttccttgtttacagtttttcacatatatctcataactggattatgagaatcaagggccaattagaagaagtaggtattgttacttattttatataaagagaagaattatggcttaaagaagtgagcaactgaaagtcaaacaacaggagcttgaaattaagcctatgtcattagattccgtagccaatgcactatcagatggtttcctacataaagctaaatttcttgggaaattttacaaagacgggatatatgtatc

SEQ ID NO: 3060 - DNA, 479 bp, Homo sapiens
aattaaccctggctgtgtggtggttgatggcatgccccggggttgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtagccttgagttacggtgtttattttccaatcaagtgaagatatctcctacttctcctactggaacatctcagcttctgcagtgaagaaaaattcctgtgatag

SEQ ID NO: 3061 - DNA, 249 bp, Homo sapiens
ttttttttttttttcacatctgcatcagatttattttttaaaggaatggattttgtgtggattatggcatggaaagtggctgagaaattctgtagcagggtaacaaaattatcttggtccaggagtcctgtagtggagaagataaaagtcaatgcttaactcataggttaacctcagcatgcttttgatttggtcaagcaatcaaagtactggtgaagaattgaagattggaagtgacacattttttgc

SEQ ID NO: 3062 - DNA, 507 bp, Homo sapiens
tttaggggatagattctttatcttatgagggtttgggcaagtcaaatacttagtttctgagccttattttgtctctagagcaagaaaactgtaaattaggcagccggtgaggggccctcacagctttggctgtgggttcaggacaccagatttctaccactcactttcttcttacttctcctgcacagggatcatggcccaagttgcaatgtccaccctccccgttgaagatgaggagtcctcggagagcacggatggtggtgacattcctcatgtcagctctcgagtccatggtgaggccttctgttccatcattccatagttcgggtaggcctgcacattgaatgatgttcatccgcttttcatctgccccagggaaagctttaggcaaatccacagtggtacctgtaccatatgagaaagatgctgcgagaccagttcggttgtgtagtgcagggctttccggaggtgtgcctttaacaccccgagaactagacttgcaaccct

SEQ ID NO: 3063 - DNA, 411 bp, Homo sapiens
ggctactctggctgcccacgtccgttccccctgcttctcttaatggccctacaatagccttccagggcgccatctccatttcttccagcagaacatgagctttgtggggaggagacaccactatctgctccagagggagagcaaagaacctcaactatcagaggattacttctccctggccacagtggctggttcaatacgagacttctgttaggacttccagctgaccacgaagctggaaagaaggctggagtttctgcagctactttgcactgtaacaggaagatctgtccacagatagaggaaaccaagcccagtgcctgtgactgggggagcagaggtggggagttaacacactgggatcctggttgatgtcgtgcctggaggaagttcataacacttgctctttgt

SEQ ID NO: 3064 - DNA, 1495 bp, Homo sapiens
cgagaccagcctggccaacatggtgaaacccagtctctactaaaaatacaaaaattagccagatgtggtggcacgcacctgtaatttcaactactcgggaggcagagtttgcagtgagcccagtcgagaccctgtctcttaattaaaaacaaaaacaaaaacaaaaaaaactaggctgggctcagtggctcgcctgttatcctagcactttggcaggctaaggtgggtagatcgcctgagctcagccgttcgagaccagtctggacaacatggtgaaacctcatctctactaaaatacaaaagaaattagctgggcatggtggtgtgtgcctgtggtcccagctgctcgggaggctgaggcaggagaattgtttgaacccaggaggtggaggttgcagcgagccgagatcttgccattgcactccagccggggtggcagagcgagactctgtttctacaaaacaaaaaacaaaaaacaaaaaaaaaaaactggtagaacgttaggttcacaccatccaaagacgtttgcgtcttcttgtaggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaataggtgacacactctgcacccccgccccttcagttcatttaaagatgaaaccaatagcctaattttaattcactcgtgcatcccgcctgctgcgtttcagagctgactgttcagatgtgtcatgcttttttcattggtccgtgctgggtaatggtgttgcttttcttgcagacccttcctaggaccagagagtcagctgggtaagtgacagcttctcaggtttggtggctcttctgagctgctgaaccacttcttcttcattaaaacttgaattgggggccgggcgtgatggctcacacctgtaatcccagcactttgggaggctgaggcaggtggatcacaaaggtcaggagatcgcgaccatcctggctaacacggtgaagcccagtctgtactaaaaatacaaaaaaaaattagccgggcgtggtggcgggcgcctgtagtcccagctactcgggtgtctgaggcaggagaatggcgtgaacccgggaggtggagcttgcagtgagcggagatcgcgccactgcactccagactgggcgactgagcaagactccgtctcaaaaaaaaaaaaacaaaacttgaatttgggtgaggggagggaacttagaggatgggccaataggtgcagcaagccattgtggcacacatgtgcctaggaaacaaacctgcacattctgcagatgtatccccccctttttttttttagaagaaataaagaatattttttaaaaaaagaaaaatacatttgtagctaaaaaaaaaaaaaaaaa

SEQ ID NO: 3065 - DNA, 950 bp, Homo sapiens
tttttttttttttttttttttcttttttttctttctttttttttttttttcctggtcagggctctgctgtatgaaatattttaaatggtatacttgaaaagagtagctatatttttgaagaattttcatcacaaagttatttgttagtcttgatccaataaactcttaacaataagccaagccaagccaagccaagagctggtcccaactgctatacagtgctctttgcaatcaaatctaaaattaattacccaaggtaatatatttaagggaaataaataaaactgtatttaaatgcttatggaaggtataatcacagtctgtaggggatatggtttgttttacccgggcaaaatttaagtttccctttccacaggtcattctgtgtgcatgcatcaacacacacatatttattatttctccttctataagaactatcttgtttgaaaaatttggcttagaaatttattatagtgactacagggtcctcaaaataaaaggaggcacagctgggttagtttatgaatcatgctgcattatcaattttaattgactagaaagagtagaataccctgtcacctgatacttagaaccatctgcaccacaaaaaggttaatctgataaattcaccatcaatttggtaagctttaatataactaccctgttttttgaatacagataatgcaaaagaaaaccattttatactcggctatataccttccactacgaaaaaaggggcacagatacaatcttctacttaataataaaaaagggctggcagatgcactcagcattacgaacaccatttaaacctgtattttacagctgtaggttttaagtatcttgtcaaaagcttagtttcatgatatgtaatttacaaagtgacatattctttaaaagtactcctatatacattttcctcttggaacgtgcctctgatttccagcaga

SEQ ID NO: 3066 - DNA, 672 bp, Homo sapiens
ctgtctcccaagctggagtgcagtggtgtggtcataggtcactgcagcgtcgaactcctaggctcaagtgatcctcttgcctcaggctcctgagtagctgggacaacaggcgtgtaccacacctggatactttttaaatttttggtagagaagggatctcactctattgccaagctggtgtcgaactcttggtcttaagcagccctcccacgtcagcatcccaaagtgttgggatttcagagggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaaaccgagagaggatggcggcttttgttaatgccaggagcggattttacaggaaagattttggcaaaatactgtaggtgttttaattttatcctttgtattcccaatctcaaaaggatgcgcaggcaagacttccacagtattttcttctaagctatcataagcattctcctagaaacgattcctaacacatcttcttggattcagcttaccaaataaacactgcttaacactgccaaaaaaaaaaaaaaaa

SEQ ID NO: 3067 - DNA, 543 bp, Homo sapiens
  misc_feature (1)...(543): n = A,T,C or G
ggccccacattgcacttctggggggtgaccgacttcgtacacgggtttaaagtttatttttatggtttagtcattgcagagttcttattttggggggagggaaagggggctagtccccttcttttggccctccgacccgcgcaggcnttctcgtgtgctgctaactgtatttattgtgatgccttggtcagggtcccctctacccacttctcccagtcagttgtggccccagcccgtatccctgttgctgtgtggagtggacaccctgacccttgaagcggggagggccgctgtggccttcgtcacagccgcgcagtgcccatggaggcgctgctgccaccttcctctcccaagttctttctccatccctctcctcttcccggccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaaaaaaaaaaaaaa

SEQ ID NO: 3068 - DNA, 634 bp, Homo sapiens
  misc_feature (1)...(634): n = A,T,C or G
ttttttttttttcataaaatacgtgtttattattaccataggcctacagtccccggtattcttaacacatcttgcctgagaagtatcacactcatgcctatcaaccagctcacacatttaatcaaaggaatttggcagctgtagggttgtcttttcatccatatcgtccctggaattaactgtcctgctataccagtcagattgagcagcatctgtcaagagtttcagtcccacttgcagaggaaaggctctctggcttcggtccgtggctctccgtaggtgccgtgtctggacccagcctaccttcatctctgttaggcttaggggtctttctctcacactgtgtcttgtccaatcacaagacttcaacggagcgggcggtctggcctaaggctcttatgcgtgggatgtcttgcaggccaacaatcccaagtcgggattcgaagccgctgcgcagtgcccggaatgacccctccacattgatgccactgtagagcccggaaggaaaagcaaagcgcctcggccccgcacagcccaggattaaatgtttgcgccagggcccctctggctacctggtggctggccgcgcngnntcggcagncgcggcgtaagctcgcggcggcgaattcttcca

SEQ ID NO: 3069 - DNA, 1232 bp, Homo sapiens
gctctctttcttctgggtgaattggatttgcaggttatgctgttgagtgatgacgcatagctgcttttgctccattttccccagatgacttggtaaattctccgtgaatgactctgctacataacctagataacctaacgtgtgtcctttaaatgcatgtaagccagaagatgtatgttactttgaaaacataagtaacaaaattttgaatgtattgctaaagagatgtctctctgaaggctcttttgatgtttgggtgtcttgtccttcttattaaaccatatcttaggtaaatagtttgggtacggaatgggatttatcactgaggcagggtctggcaaaataatttaatcgggtaaccgtttttgtttcctgttggatagggaaataaaaggagactgatgggaaggctctcaggattcaaggcaaggaacccagaccccacgtgggtaggacctcttccctcctaggggttaaatcagcttctgtggtccaggggatgctgtgtggggtgtcccatcctggaaccccctggcatacggcgtagtaaatgtgatcttccccacttttcacataaggtgggtggtcctggccttcaggggaatgtggggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttggcagagttaacaagtctgatcctgttagtccagatttcttaaatttggccaagttataataggagcagtagcttggagacccgaagtcaggaaactttgacaatggatttttttttttttaatccagagacttgtactggaatttgccttaccctgtcaagctcatgggacttaaggtttcatcccgctttatgagtgcttcttgaatccaagtcattgttacctgaatttgcaaattaagtttgtgatattccggacttgtaaaatccctgtaataagattaacctctttgcttgcttgtttgttttctctcctattttagcttaaagtatcagtggttgagaagagcttttcggacctgtt

SEQ ID NO: 3070 - DNA, 4267 bp, Homo sapiens
gcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtccctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgattaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttctgcagagccaggccccatcaccaaccagaccttcctctgctcccacggaggcatcccgccccacaaataccactacatcgacgacctggtggtcatcctgccccagaacgtctgggagcacctgtacaacagattcggtggtttgtcccgccgtgaaccacctgtacgtgtgctccatcttccaggtggagatcgaggcactggtcaagcgcaggaggatcgagatcgacactttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatcttgctgggcttagtctccccatgtgccccaccccgcggaaggcgttgtttgtgcccagaagagaggccgggcttgcttgcagaaccccgccgttttaaagaggcagaaaagttggttttgtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaaggggctctgggaccagaccccccacaactactgcgtctttgtttctatcagtctttgtagaagcaggtggtggtggaaattccagcaggtgggtccccggcaggaggccctgaggcctcacttttcggatcttctgtcccagatcctgctccctccctgctgagcctggggttcccctggcattggccccagccttctgaaagctcggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 3071 - DNA, 2000 bp, Homo sapiens
  misc_feature (1)...(2000): n = A,T,C or G
gggcgggggcgcggctgggcccccagcggatgggcggcgggggacggggcgcgggcggacgagggaactccgcatcgtggaggagcggctgcaagttgcgagcgtcgccaaggagagtatcccgctgttcacctacgggcctggtcgaacttgccttcctgttctgcaggagcaggtgcaagttcttcagtctgactgagacaccagaggattacactatcattgtcgatgaggaaggattcctagagctgccctcctcagagcacctgagtgtggcggatgcacctgggctggccctgaaacgtggtgtccggcggtggcagcttctccagctcccagcctattggcatggaccaagatccgccaagtcagtcattcgccccactggcttgaccagaacatattccgtgtttcatgnttgttccacgtattcagacagattttcatcctgggtgtttaaagcggggacctgcccttttgttcaaccacaagtttgttcaatcaagagtttcaccattcctgtgggtcagtgggcttagatttttaggcaggccgagaaaccttcggcaatcaccagtgggtttcgtgaagcccaagctggggccttggtgtaccttgttgtagtgtttgaaaacatctgaggctggcatccatctccaggcaccccataaaggcaacagcttgcagaacccggctaggaggcggcgccgctggtgtagccgctctatctgtaaatgatcctcctgggaatcacctgggctcacatggaaggcaaaagggaatcacagacttaagcttcctgccctatatttctgagctacaaccaagccccagcccttactgagccccaggtatnagagtcactgcaccactgcccaggtcttcccggctggatgaagacgtggtccatgaggaagctggctagctcagactggagagtagcttcaggaaaaaagacaagtggcctaaggaaatcacggcccccaactatcatctgagggctaaagcatgagaagtagatcacttaataagacaaaagcctgtaggggggaaaagaaaggatgtttaaaaggacagaatgtttcccaaggtagaaatgacactgtcaatttctccttggaatgggggcagggaatactcgccttgttgctcccacttgagtcagtactcacctgctcctgggatctcagtatccacatctgagaggcaactctgggcagagttcacaggaaggccaccattctgtcccttcaaactcgacagctgcttctgtggggcacagtgggctttgaaggggaaggattgaaggacacagattcctctgttcccattatcccatctaagacccacactcacctggggaagcatctgatttagaaatgtggggttagtgtccagagaatggaaaaatagacaagagtcaaggctggcaggataacctgtaaacaaacaagggtttggaaaaaatgaggttttgggttagggagagggagagacagattagccaggaaacacacccagtgaagaggagagaaaatgaagtaaagggagagctaattcccttttcccagtggaaaatgagtgatattctggacattcttcagaggcatctacacgaagtaggaaatgtcaccgctccctaatttactctacgtcttctagaatccctcaatattatccttggcttccagggaaatccaagaagaccctgggaagtagagtccaccttcttaagagaggaatgtaagaggtgacccccacccacctgatcttcctcgctttgtccactccacgcactgagacttgacacacctagtggccacctagaaccgtaggtccttaaaatctagccccccagcccccaacccatctctagcctgtccactcacctggtgaggaacctctcctgtgtccacagccttctgcaggagttggcaacatggctcatagagctcccagcgagtcaggtcatgagtgctttgggggagaaaggggaataa

SEQ ID NO: 3072 - DNA, 4551 bp, Homo sapiens
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgagcattcctcatgtcagctctcgagtccatgtgtaaagaactggccaagtccaaagccgaagtggcctgcattggagtggtatgaaacagaggtgtttgtggtcggaactgaaagaggacgtgcttttgtcaataccagaaaggagtttcaaaaagattttgtgaaatattgtgtgggggagagagagagaggagctgcagagatgcgtaagagtgagatctacaacccaggcaaatcggatgagtgtagatgctgtagagattgagacactcagaaaaacagttgacggactatttctgcttttgctatggggaaagctttaggcaaatccacagtgggtacctggtaccatatgagaagatgctgccgagaccagtcggctgtggtagtgcaggggcttccgcgacgtgttgcctttaaacaccccgagaactatgatcttgcaaccctgaaatgggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgaggggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaagggaaaggattcgttttgtgattaagaaacatgagcttctggaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaggaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctccctggggatggctagttaaaataaacactaaagctttgcagtcccccaaaagaccaccgaagtccctgggagtaattcaaaggtttcctgaaatttgaggtcaccgtgggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttattttgagtcttttcccggaaggactttttatgtgggaaggcttacctgaggggtgttgccctttccgaaggacccattcgactttttgggcatttccgagggttggagaagatattcaggaaacaaaggccaaaattaaggttcatcatttaaaaagcccgaaatgtttgagacggcgattaaggagagcacctcctctaagagccctcccaggaaaaataaattcatcacccaatgttaatactactgcatcaggtgttgaagaccttaacatcattcaggtgacaattcccagatgatgataatgaaagactctcgaaagttgaaaaagctagacagctaagagaacaagtgaatgatctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctactttttaggattggaaatgtctacttttttccagccagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaaatcatttaaatgatcctttgttcacggctctccttaatgactgagtgaacagttcctatctgtattattttgactaaacctttttcctaaggctatctctcatggttcctatgtttttttaatcataattaaaagcaaaaccatctggatcacctaacagtcagaggtcagtatctcaagcgtgtgaattatagaggaaatacagataggaacctctttccacttttacttttcgtcccaaataaaatgcatggtgtaccagaagttgaagatcgggttgagggattggggctagctcggatgacacctaagggcccaacatcgcggggacctgctgtggcgcggattcttaggaacgctgttctagccggccccctctccaggggtcgccgtggccggcattatttcctagtttctttcttgtaaccctgaggtgccagcgcggggaagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaagtcgga

SEQ ID NO: 3073 - DNA, 4617 bp, Homo sapiens
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcctgagagcaggatggtggtgacattcctcatgtcagctctcgagtccatgtgtaaagaactggccaagtccaaagccgaagtggcctgcattgcagtcgtatgaaacagacgtgtttgtcgtcggaactgaaagaggacgtgcttttgtcaataccagaaaggattttcaaaaagattttgtaaaatatttgtgttgaagaagaagaaaaagctgcagagatgcataaaatgaaatctacaacccagggcaaatcggatgagtgtaggatgctgtaggaaatttgaaacacttcaggaaaaacagttgagggactatttctgcttttgctatggggaaaggctttagggcaaatccacagtggtacctgtaccatatgagaagatgctgcgagatcagtcggttgtgtgtgtgccagagtctttccgaaggtgttgcctttaaacaacccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtccctttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaggaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattaagggtcaccgtggaaggccctaataacaacaatcctcaaacctcagcttgttcgaaccccgacccagacttaacggttcttaacgttccctttcaagccacggagggaggagagttttcctttgaaggcctgggaatgccaaaatcacgggaccttaaaacaggaaagtttgaaaatcttctttcaattgaggaaatttggggggaagctttttggcctttaaacaagctgttgaagggtgccgttcgcgttatttggagtctttcccgggaagacttttatgttgggagggttacctgagggtgtgcccattccgaagaaccatcgacttttggcattccgaggctggagaagatactcagaaacaaagccaaaattaagttcatcattaaaaagcccgaaatgtttgagacggcgattaaggagagcacctccttttaaggagccctcccagaaaaaataaattcatcacccaatgttaatactactgcatcaggtgttgaaggacctttaacatcatttcagggtgacaattccaggatggatggataatggaaaggactcttcggaaagttggaaaaaggctaggacagctaaggaggaacaagtggaatggacctctttagttcgggaatttgggtggaagctatttggtatgggtttccctgtgaaagttcccctacaggaaaatcacaattaacccctggctgtgtggtggttgatggcatgccccccgggggtgtccttcaaagcccccagcttacctggaaaatcagactgccatgagaaggatcttaggactctgccgagtttatcaaaattcacggtcattagaccatttccaaggacttgtgatttaataaccagctggttgttcaaagtgagtcagaaggccccgtgatacaagaatcagctgacccaagcccagttgggaagttccagccacagaagaaataaaagagactgatggaagctctcagatcaaggcaagacccaggacccacgtggttagacctcttccctcctaggcttaaaagtatcagtggttgagaagagcttttcggacctgttactacccccaagctgtgtaatatactttgtataacaggaataccttctataccaacccttttttttcctcttttagatagaaaatgtcctactttttccagcagttctgtgaattaaaagagccagagtgaactgtggggtctgggaatgggctgggtgtacttggggaatgtacctatccaggattttaaccagcaatgcctggggaaatggacagggaaaatgacagggaatggaatcctcacccaggtttttttatgtacggcaggcaggagcctttggagttacgggtgttttatttttcccaattcaagtggaagatatctcctacttcctccctactggaacatcctcagcttctgcagtgaagaagagattcctgtgatagttcagttcctttagtttttcctatttgaaaaaaaaaaaatcatttaaatgatcctttgttcacggctctccttaatgactgagtggaacagttcctaaccggtatatttgactaaaaccttttcctaagctatctcttcatggttcccatgttttttttattcataatttaaaagcaaaaccatctgggatccacctaacagttcagaggtccagtatctcaggcgtgtggaattataggagggaaatacaggggaggaaccttcttcccactttttactttttcgtcccaaataaaatgccatggtgtacccagaaagttgaaagatcgggttgaggattggggctagctcgatgacactaagcccccaaacatcgcggggaccctgctgtgggcgcgggattcttaggaaacgcctgttcctaggccggcccccctctccccagggggtcgccgtggcccgggcatttattttcctagttcttcttgttaaccctggagggtgccaagcgcggggagtgaggaggagtcagggggctaaggatgcaacctctgacgttctgcgccttcctaggagagtcttacatgtgtttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaaaaaaaaaaaaaaaaaaaaaaaa

SEQ ID NO: 3074 - DNA, 2037 bp, Homo sapiens
cgcgaaaggaaagaaagctgcaaaagttgttcctgtgaaaacccaagaacgtgcctgaggatgaagatgaagaagaggatgatgaggacgaggatgacgacgacgacgaagatgatgaagatgatgatgatgaagatgatgaggaggaggaagaagaggaggaggaagagcctgtcaaagaagcacctggaaaacgaaagaaggaaatggccacaacagaaagcagctcctgaagccaagaaacagaaagtggaaggcacagaacccgactacggctttcaatctctttgttggaaaccctaaactttaacaaatctgctcctgaattaaaaactggtatcagccgatgtttttgctaaaaatgatcttgcctgttgtggatgtcagaattgggattgactaggaaatttgggtttatgtggattttgaatctgctgaagacctggagaaagcgttggaactcactggtttgaaagtctttggcaatgaaattaaactagagaaaccaaaaggaaaaggccagtaagaaagagcgagatgcgagaacacttttgggttaaaaatctcccttacaaagtcactcaggaatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactaatactggagagaaaggtcaaaatcaagactatagaggtggaaagaatagcacttggagtggtgaatcaaaaactctggttttaagcaacctctcctacagtgcaacagaagaaactcttcagaaagaatctgagacaaggcaacttttatccaagtgccccagaacccaaatgggcaaatctaaagggtgtgcatgccttacagttcgcttcattcgaagacggttaaagaagctttaaattcctgttaataaaaggggaaatttgaggggcagagcaattcaggctgggagtttgcaaggacccagggggattcaccttaattgccagaagccagccatccaaaactctgttttgttcaaaggcctgtctgatggataccactgaagagacattaaaggagtcatttgacggctccgttcgggcaaggataagttactgaccggaaaaacttgggtcctccaaagggtttggtttttgtaagacttcaacagtgacggaggatgccaaagcttgccaaggaggccatggaagacggtgaaattgatggaaataaagttaccttggactggccccaaacctaacggtgaagggtgctttcgggggtcgtggtggaggccagaggcggctttggaggacgaggtgggtggtagaggaggccgaaggaagattttgggtggcaaaggcccgggggaggcctttggagggccgaggaggcttccgaggaaggcaagaaggaaggaaggaaggtgacccaccaagccacaaggaaaagaagacgaagttttgaataggcttctgtcccctcttgctttccccttttccattttgaaaagaaaggactcctggggttttttactgttaacctgaatcaatgacagagccttctgaggacattccaaagacagtatacagtcctgtggtctccttggaaaatccggtctagttaacatttcaaagggcaaatacccgtgttgggttttgaactggataatccatataaacctctttaaagagttgagtgatagagcctaaccccttatctgtaagttttgaaatttatattgtttcatccccatgtacaaaacccatttttttcctacgaaatagtttggggttttgttgttgtttcttttttttgttttgtttttgttttttttttttttttgcgttcgtggggggttgtaaaaggaaaaggaaaggcaggaatgttttatcaggggttttgccttcagcggctttaggacaaaataaaagccacttttggggcccaaacaaaaaa

SEQ ID NO: 3075 - DNA, 4549 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggtggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaaatgaaatctacaacccaggcaaatcggatgagtgtagatgctgtagaaattgaaacactcagaaaaacagttgaggactatttctgcttttgctatgggaaagcttttagggcaaatccacagtgttacctgtaccatatggagaagatgctgcgagaccagtcggctgtgggtagtgcaggggcttccggaaggtgttgcctttaaacaccccgagaacctatgatcttgcaacccctgaaatgggattttggagaacaaagcatggatttcattcatcattaagagaccttttttagagcccaaagaagcatgtaggtggtcgtgtgatggtaacagatgctgacaggtcaatactatctcccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgcccagaatcactaaatttaagaaagatggtggatcagcttttctgcaaaaaatttgcggaaccccttggggagcactgaaagccaaggctgtaccgtaccaaaaatttgaggcacaccccgaatgatctgtacgtggaaggactgccagaaaacattcctttccgaagtccctcatgggtatggaatcccaaggctgggaaaaaatcattcaagtgggcaatcggatttaaatttgttaattaaaagaccagaactttctgactcaccagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacggaagtcctggggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgcccgttcgcgttatttgagtctttcccggaagacttttatgtggaaggcttacctgagggtgtgccattccgaagaccatcgacttttggcattccgagactggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttaagtcggaaatttggtgaagctattggtatgggttttcctgtgaaagttccctacaggaaaatcacaattaaccctggctgcgtggtggtcgactcggcatgcccccgggggtgtcctttcaaagcccccagctacctgggaaatcagctccatgagaaggatcttatgactctgccgagtttatcaaatttcacggtcattagaccatttccagggacttgtgattaattaaccagctggtttgatccagagtgagtcaaaaggccccgttgatacaagtattcagctggaaccaaggccagttggaaggtcccaggccaacaggaaggaattaaaagagactgatggaagctcctcagatcaaagcaagaaccagacccccacgtgggtaggacctcttcccctcctaggcttaaagtaatccagtggttgaagaaagagcttttcggaccctgttacctaccccccaagcctgtgtaatataccttggtataacaggaaatacccttcctatacaaacctttttttcctaccttttagatagaaatgtcctactttttccagccagttctgtggaattaaagagccagagtgacctgtgggtctggaatggctgggtgtaacttgggaatgtacctatcaggattttaacagcaatgcctgggaaatgacagggaaaatgacaggaatgaatctcaccagattttttatgtactcagcagagccttgagtttacggtgtttattttccaatcaagtgaagatatctccgtacgttctcctactggaacatcatcagcttctgcagtgaagaaaaattcctgtgatagttcagttctttagtttttctatttgaaaaaaaaaaaatcatttaaatgatcctttgttcacggctctccttaatgactgagtgaacagttcctatctgtatatttgactaaacctttgtcctaagctatctctcatggttcctatgtttttttatcataatttaaagcaaaaccaatctggatcacctaacagtcagaggtcagtatctccagcgtgtgaattatagaggaaatacagagagaaccccttccacttttacttttccgtcccaaataaaatgcatgggtgtaccaggaagttgaagatcgggttgaggattgggggctaaagctcgaatgaccacttaaggcccccaacatcgcggggacctgctgttggccgcgggattcttaggaaacgctgttcctagccggcccccctctcccaggggggttccgttgcccggcattatttccctagttcctccttgttacccctgaggtgccaagcgcggggagtgaggaggggtcagggggcttaaggatgcaaccttttgacggttttgccgccttcctaggagagtcttaccatgtgttgagatttgcacaagcaatgtcgagttgtaaaataccagctctacaagaagtctaggctctgtgacgggcatagttttcagtagctttatcacaatattcacaatggagaatatatatgacatggtaagcagaaataggcccttttatgtgtgtgcttctattttacctgcaaagttgtaagatatagggtaatcaataaaatccatccatgcctttccacacactaaaaaaaaaaaaaaaaaa

SEQ ID NO: 3076 - DNA, 2149 bp, Homo sapiens
tttttttttttttaaaaaaaaggttggaaaaattactttatgaagccttaagcactaagaataattaattaaactgtaatccaggattagatacaatttaataatagttcaattccaaaataaaagttattgtaggtaagaccatgaaatttcctaacacttgattttaatacattgcgctaattttctaaaacaactcagaggaacccatatttacagtaggcagaatatttatgaaaaaaatctggcatcaggtatatttatatatatgtatgtgtgtgtatacgtatgtgtgtgtatatatatgtgtgtgtgtgtgtgtatcccgagattatatgaactaagaaacaagttgtgtatcttaacagcagtactagagcgcagagtttcagacttggatttataaatgctttcaacgtgtggtgtttggaaaaggagaagacatcatctgattttcaaaacctgaagtttttctcaggactgaagtcaaaatcgtaactgccacagagggaaaagggaagcttttccccttaattgttcatctgcgtcagaaagtccagtatccctgagataggaaccactgtaattagaagattggaatgaacaggtttctcccaaaggaagattgtttgttgctgaattatgcctactgccctgatcatcaggtataaactttgcatcttccaacctaatgcttggcagcaccaagacgtttcagtaatggttcatcataaacccagcattctccatcttcatgaaataaccttgtctcccactgaatttccttctccttcctttctcgggcttctgctctttgtctttcttcaagcctgtgctttgcttcagttgctgcatcaatgtctctgatttttaagttgaaagtgacatccttccaaaggctgcgggattcatactcgttctgatcttccaacttcctcactttcttcttgattataggcaacttcttggtatctacaaagactgtattttcccctgttgcatattttgcatacatcacaccattccattccccttcaattgagcaaaaagacttcttgtcatttggagaaaaaatctcggcagtaattctgtgcttcttgcccccatagaagggtttagtgtggaagatgatatttgcactatagcctgttttggaacaattaatattgcattctcctcctaattccacccagggcactgtgaggatagaccttccatagccattggggaatgtgagaatgtaatgttcatcatagtctagacatgagacacagccctgccctatgttgtgcacccccaattggaccatccccaagggaattttgatttggtcccagatatgagcattgaattgtatcttcttgttaaaacactcagcataaaaggctgaaatgggtggatgatgggaaacctgctcagccacaaatgttacactgtttttggaaacccagggaactggtccttctgaaactagttctgtgttctcttcagtatcatttggtaatgtccaatgacactgaaaaatctcgcccaaaatgggattgtatggctttttggcaactgatcctttccttcccgcatgaaaggctgagaggtaccatttcacaacctgaaccattcgatccttgggatccttctggtcactaatgctcacaaacaggtccggatgtgcaaaaaagtctgcatacatttctaaaagagatcttctttcaagaataaacgttggaagaactaccttagtaagatccattccaagcctgacttgtgataagaggtgcatgataacgctcttgtgctcctccactgacccagcctccccatcatcatctctgtcgtcatgtgagtcaaaaagatcagcatcgcttgtgccattggacatggaggaattcagagactctgtggtatctgggcgttttaagctatttccggagctgctgtgtgtcaagactgaggcagatccagaagaatctattaagcgctttggggacgagccactttgatggaattcatcagcatcataagaactcatcttcactgctaagagtaagagaactctgggactgtatttggagacaagttgacatggctgggaggagtcagactgctgctaggtggtgagttcccactgcctgtactatttgggtgttga

SEQ ID NO: 3077 - DNA, 220 bp, Homo sapiens
cgtcgacgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgacc

SEQ ID NO: 3078 - DNA, 688 bp, Homo sapiens
  misc_feature (1)...(688): n = A,T,C or G
tttaggactgcaaataagtaacanttgcctcatcatgttagcacttaaagtgaacctggcatttagntctcaaaatctagaggcaaatgantaaggcagggaatctntccttttttccccatgaaaggtaaagcccttggtaattcagctgcacactctgataatgtacatgaaaggtcttccttgataaacgataaaccttgtgattttgccacacaagaatttagctaaaccctttcctaatgtcattgtatatgagtagtacagattccctgtgtttgttccccattgaatataccagaaatactgaatacctcccttaaaacagccttttattgaaaaaaggaagctgataaaaatcactttgcttttttataaaaacgcttgataggattacctttctagagagacttctgtgtatggccacacttatccaccacagtttttgtttatatagagagcattttaaaaagaagaaggttttcctggccatgcacagtggctcacgcctgtaatcccagcactttgggaggccaaggcggaaggattgcttgaggccaggagtttgagaccagcctaggcaacattgtgagactgtttctataaaaaaaaaaactgaaaaatcagccagccatggtcgcccatgcctgtggtcccagctacttgggaggctgaggcaggaagattc

SEQ ID NO: 3079 - DNA, 1371 bp, Homo sapiens
ctttctttctttttctttctttctttttctttctttctttctttctttctttctttctttctttctttctttctttcttttctttcttttctttcttcctcttcttcttcttttttgcaaataatttacaggcatatgtaaaatacagtaagaatactgggtcatagtttcatccagtgaaactctgtgacaatccttcactagaaggagagtacttttttcacacagtcaggggatgaggatctgatccgaattacattttgtcgagtcactcattcccacagatttgagtttgaatgcagcttgtggggtacatcatcaggaacattgcacaattattttatgtcatttaaaagaatgatggaaaggaatgttagcggtgcttaaaggcctcagtaggcactcaataattttatagaatagttaaataaatattgcttacacataaaaactcatctcatttcaagatgagggggaaaaaggcatttgggaatctcttaatttaaaacaaaacaaaagtacttgctaagggcatgatcctcttatgaatccacaagaattcagccatcaacaaaaatcccgtgagtggaaaattgtatggatctctaacatgacataaaaacgcaactgcgttttacttgctaccttattgcacacctcacttccttgattgagcctttaaaaaacaattccaagttgatatttttttttaaaaagtagatgacaatcttaacattttactgtattttacattcactctgctaaacaaaagcctttaaacaggcacaaaacactgcaacaatacattaacttcctaataaaacaaacctttttaataacattgaaataaaatggtttcattttgcattaaactacataccatgaacttctccaacataaaaggactaaaaacaagcattagaagatatttacaaactatctttaaacttctacaggtctctcctcctcctcctggatgtgcacaccccaatccagttcacccatcaagtgcacagcaaaggaagagaggcccatttaataaacataatgtttccaacacccttgaggaccatggacagttttgcaagaaacatggtaaggcaactagaagcataactttctgctgaaaagagtctctgggggtcttgtctacgataacatacattctttgtccctacaaactcatacttcaaaaatgaataaaagcattagaaatggcattaaagttttacattgggcaattaaatagctatgcaaaggtgtcttatgcaactcgattaaaaccttgtgcttactctgctactgaaatagcacacgtagaagacaatacttccccgaaatctgtaaaattcataatcacggttcacacct

SEQ ID NO: 3080 - DNA, 382 bp, Homo sapiens
tcggacagtgcgaaggataggggatagcggaaggaataagagtgtttcttcctcttcttcttcttttttgcaaataagttgaaagaggagggtgagaaagagagatggaagaaggagaagagagagaagaaagtgagaaaaggggaaggagaagagaagggagggggaaagaggactgaggagggggggaggaaaagataggaaaagagattgtggagtcaatcattcccacagatttgagtttgaatgcagcttgtggggtacatcatcaggaacattgcacaattattttaagtcatataaaagaatgatggaaaggaatgttagcggtgctaaaggcctcagtaggcactcaataattttatagaatagttaaataaat

SEQ ID NO: 3081 - DNA, 473 bp, Homo sapiens
tttttaaagatagaggcgtcgattctgtcacccaggctggaaggcagtggcacagtcttggctcactgcaacctccgcctcccaggttcatgaaattctcctgcctcagcctcctgagtagctgggattacaggcacacgccaccaggcccggctaatttttgcatttttgtagagatgaggtttcaccatgttggccaggctggtctcgaactcctcacctcaggtgatctgcccatctcagcctcccaaagtgctggcattacaagtgtgagccactgcacccagccctgaccagtgatttttaaggagaagtttgctgggcttccggtgatgaagaagttgtttttcattttccctcagctcctgcttatggactctgcaatgtaaggccaggctccatgaggctagtggaaccattttggacccacaaggtgacaaggatcaggacaagggacacccacggagtcgacg

SEQ ID NO: 3082 - DNA, 1302 bp, Homo sapiens
  misc_feature (1)...(1302): n = A,T,C or G
ctgccgacctttgataaccacgcacccccaggcgacaccctcaagtgggctcccgggacgcctcctcaagaaccgttctccgcgcccatcgggcacccaccttgaggaccagtgtgaggaaaaacccccccgagggttgggcctgattgtaccactgttgccacacatgccagcagaaaaatatgtatattattgtaaatagaaatgacccacatcagaatgtccaccacatggctgttcctggagagggccctctgagaaggcactgaatgaggcgagggacccttcctacattgtcacccatccccagtaaaccttgggtcattattcatactgacaaggaaccgagtcaatttggtgaataggaaaagccttctcatgaaaactacaatagaatactgttaccaaattcttcctaagaaagatcgtattatgggaatgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtactttcatgtacagattaatacttatatgagacgacacgacatatgttagggctgaanggcatgacgctgcattttcctgttacttaactatgtggtaattcatattccggaaagtctgggatctcatactcttcacacctacacgaggtggtcctccatgggagctaaagcctccactggggcgcatttacctccaatagggcggagtggcgcgagagctatttcagggttgcttatctaggaatctgcaggtttctaatgacgaagggatcttggggaaaaccatcgcgtcggaat

SEQ ID NO: 3083 - DNA, 838 bp, Homo sapiens
attcggcacaggagaaaccctatgtgtgtgctgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaa

SEQ ID NO: 3084 - DNA, 1006 bp, Homo sapiens
tttttttttttttttttttttttttttttttttttttttttttttggagtttaaatgcattttatttttagacaacctacatgacatgtttttcttaaaaacaatgcctccactccaaataaatcacagtcaaaataaatgaagagctcaagatgacatcagtcccatttgtcttaagtcctggtgttgtgtggatgacaagcagaagccagttatgatgacaggtgatagatccaaaataattgccacatttgttaacatttttccatttctaaaccatccttaaagaaaatcatatatggggtcacaccatcctcacggtagtccaatagagcaaccatgccatctggattcatgttttcaccaataaagaactggtagtttttgaaattagcaaggatgtgcttgatttgttctgcagcccctgtcataaaaggttttactctttctggtctctgttcttcaagtttccctttgattgatttcatgtaatctttgatgtacttcttgtaggcttcttttgtgaaacttgtttcctgcaggtgatggttcatgacaatatcgacaccagtgattactgtgctttcggtaccttcgccctcggggccttcagcggaggcatttccaccaatgagcgagtcatcaatgttaccttctgtcctactgaccatcttcccctccaccttccaggcacaaccccgtccgggatcttcccggatctttgtagatgtcggagaacatctcatcgtggctgatgaggtcccggtagataatcatgatggcgactgaagggagacgacgacggcgctagcttagcacgagcctgaaactccgagcgacgcgcgtgcagccggcccccccggggggaagccctgcggattcccgaagccggggatcacaatttcaaagcgcgccacggctgagctcaactttgtccttaggaaggtaattcgagctggaatcaggcacagggttccgggaaatgtatcggaaatcccaaaaaggg

SEQ ID NO: 3085 - DNA, 800 bp, Homo sapiens
ttttttttttttttttgagtttaaatgcattttatttttagacaacctacatgacatgtttttcttaaaaacaatgcctccactccaaataaatcacagtcaaaataaatgaagagctcaagatgacatcagtcccatttgtcttaagtcctggtgttgtgtggatgacaagcagaagccagttatgatgacaggtgatagatccaaaataattgccacatttgttaacatttttccatttctaaaccatccttaaagaaaatcatatatggggtcacaccatcctcacggtagtccaatagagcaaccatgccatctggattcatgttttcaccaataaagaactggtagtttttgaaattagcaaggatgtgcttgatttgttctgcagcccctgtcataaaaggttttactctttctggtctctgttcttcaagtttccctttgattgatttcatgtaatctttgatgtacttcttgtaggcttcttttgtgaaacttgtttcctgcaggtgatggtgcaggacaatatcgacaccagtgattactgtgctttcggtaccttcgcccttcgggccttcagcggaggcaattccaccaatgagcgagtcatcaatgttacccttccgtcctacggaccatcctccccttccacctccaggcacaccccgtccgcaactcccggatcttgttagatgtcggagaacaattcacactgggtcggtgagggccgctgaataactatctatttaggcgattgtagggagaataacgagggcgttattaagacacgaccttaa

SEQ ID NO: 3086 - DNA, 574 bp, Homo sapiens
  misc_feature (1)...(574): n = A,T,C or G
tttttgagtttaaatgcattttatttttagacaacctacatgacatgtttttcttaaaaacaatgcctccactccaaataaatcacagtcaaaataaatgaagagctcaagatgacatcagtcccatttgtcttaagtcctggtgttgtgtggatgacaagcagaagccagttatgatgacaggtgatagatccaaaataattgccacatttgttaacatttcatgtaatctttgatgtacttcttgtaggcttcttttgtgaaacttgtttcctgcaggtgatggttcatgacaatatcgacaccagtgattactgtgctttcggtaccttcgccctcggggccttcagcggaggcatttccaccaatgagcgagtcatcaatgttaccttctgtcctactgaccatcttcccctccacctccaggcacaacccgtccgcgatctcccggatcttgtagatgtcggagaacatctcatcgtggctgatgaggtccccgtagataatcatgatggcgactgaagggagacgacgacggcgctagctttacacgagcctgaaanctcgagcgagc

SEQ ID NO: 3087 - DNA, 755 bp, Homo sapiens
  misc_feature (1)...(755): n = A,T,C or G
tttgagtttaaatgcattttatttttagacaacctacatgacatgtttttcttaaaaacaatgcctccactccaaataaatcacagtcaaaataaatgaagagctcaagatgacatcagtcccatttgtcttaagtcctggtgttgtgtggatgacaagcagaagccagttatgatgacaggtgatagatccaaaataattgccacatttgttactggtagttcctgaagttagccaggatgtgcttgatttgttctgcagcccctgtcataaaaggttttactctgtctggtctctgttcttcaagtttccctttgattgatttcatgtaatctttgatgtacttcttgtaggcttcttttgtgaaacttgtttcctgcaggtgatggtttcatgacaatatcgacaccagtgattactgtgctttcggtaccttcgccctcgggcccttcagcggaggcatttccaccaattggagcgagtcatcaatgttacctttctgtcctgctgaccatcttccacctccacctgccaggcacacgccgtccgcgatcccccctccccccgagcgccgctccggctgcnccgcgctcgctccgagtttcaggctcgtgctaagctagcgccgtcgtcgtctcccttcagtcgccatcatgattatctaccgggacctcatcancnacgatgagatgttctccgacatcnacaagatccgggagatctcgnangggtgggaattcacgcttgggatnnac

SEQ ID NO: 3088 - DNA, 676 bp, Homo sapiens
aattatggaggcttactgtggcctcacaccacattagaatttggtctggaaatcaaactttagaaacaagagattgtaagccattttatactatcgacctaaattccagtctaacagttcctttacaaagttgcgtaaagcccccttatatgctagttgtaggaaatatagttattaaaccagactcccagactataacctgtgaaaattgtagattgcttagttgcattgattcaacttttaattggcaacaccgtattctgctggtgagagcaagagagggcgtgtggatccctgtgtccatggaccgaccatgggaggcctcaccatccgtccatagttttggctgaagtattaaaaggtgttttaaatagatccaaaagattcatttttactttgaattgcagtgattatgggattaattgcagtcacagctacggctgctgtagcaggagttgcattgcactcttctgttcagtcagtaaactttgttaatgattggcaaaagaattctacaagattgtggaattcacaatctagtattgatcaaaaattggcaaatcaaattaatgatcttagccaaactgtcatttggatggtgagacagactcatgagcttagaacatcgtttccagttacaatgtgactggaatacgacagatttttgtattacacc

SEQ ID NO: 3089 - DNA, 1137 bp, Homo sapiens
tttctggcttctcgagggtgttcagagtctcccaagtgcaccaggggctcgtgcccaaagggtggaggtcggcctaccctcgctcaattcacgagtggagaaggaagctagaggaccctctggaggtggcaggtttaatgtcctgcttttttatttatttatttatttatttatttatttatttatttatttattttgtaatcaactgaaagaaggcagaaggagtcgatgggcctcttaggccggaaaccttacaagcataggaccaaggcagaaaaggtccagagggttcatggtcctccgttccacctgaatccagctagagagcgagccagggggataggtgtgcccctcgtcgcccgtgcgctgaggcactgtcacgcaaagagacattcaccttccacgtcaacgcacctttaagggcgagagcggtccgccgtgcccaagaggaacgggatgacattcaactgggacttgcctcaccttggcttgggggacctcgagagcggtcccgtgggggcggtgttactcgtggtggtagaagtggagggcgtgtccgggtacttgagttcatgggcatctctcccgccgcctctcagcctatctgcaccatgtctcacacgttcagttgcagctcttaccgttttgaaggcgcacgtgggcaagaagtcctgggcagcacaagaaagtcaatcacgttgagacagagagagcaggagaggaagtgggccccagtagaagtgggcgagagagcgttgggtgggaacgtggcacgagagagagaaattatgagattgacagagagagagagagagagagagagagagagacagagaaagagagagagaaagagaaagagacagagaaaagaaactatgttgtttaaaatgccagcggaaagtccatgggggtgaaagagtccggcaatggccagggagttagcagcttggcgtagtgtcttcccactgttttgtctgtcttgagaatagcattcaacgcgactgtgttcccgcagcagacgttaggccgctgcccacgccttgagtgccggacgaggtcaacataggctttccgtcacagaatatgtttgggcaggaagatcggaacacttggggctgggccatctaccgtccccga

SEQ ID NO: 3090 - DNA, 690 bp, Homo sapiens
  misc_feature (1)...(690): n = A,T,C or G
ggcttctccgagggtgttcaggagtctcccaagtgcacaggggctcgtgcccaaagggtggaggtcggcgtacttcgctcaatccaggagtggagaaggaagctagaggaccctctggaggtggcaggtttaatgtcctgcttttttatttatttatttatttatttattttgtaatcaactgaaagaaggcagaaggagtcgatggcctcttaggccggaaaccttacaagcataggaccaaggcagaaaagggccagagggttcatggtcctccgttccacctgaatccagctagagagcgagccagggggataggtgtgcccctcgtcgcccgtgcgctgaggcactgtcacgcaaagagacattcaccttccacgtcaacgcacctttaagggcgagagcggtccgccgtgcccaagaggaacgggatgacattcaactgggacttgcctcaccttggcttgggggacctcgagagcggtcccgtggngggcggtgttactcgtggtggtagaagtggagggcgtgtccgggtacttgagttcatgggcatctctcccgccgcctctcagcctatctgcaccatgtctcacacgttcaggtaggctgagaggtggcaagagaaatgctcaagagcccaagacccggtccactccctccgtttctaccaccacccccagcccgggga

SEQ ID NO: 3091 - DNA, 501 bp, Homo sapiens
acaattcctggaactcatgcagggctgggaatagtttatgttctcagcagccagagtggaaacagagtggaaacacatggagcatcaggtagaattctcagaaaggttttgttttagtagtgcagctaattaactctagattaaaagctactctggacctacagtgtccggcatccaaaaaaactaatgtgttatgcaaagaagcaataaaatatgacttataaccaggagaaaaatcagtagaaacccagaaaagacagaggtgatggaattagtagacaaggatattaaaagagctattgtaaatataaagtagaggaaaacataagattgatgaaacctgaggtataagagatatttttactggccaaaatggaacttctagggatgaaatcaacttctgattttgttaaaatcccgagtggagagattagatacagaaaaagaagaaaaaaatcaatgaacttgaagagtaagaataaaaactaccaaagtgatata

SEQ ID NO: 3092 - DNA, 607 bp, Homo sapiens
ttgaactcaaatgtgatgtaaccccaaaaactccaactcccagcccactttaaacccgcggttggggtagaataaaaatgacctgggtaagcgtcccttcccccaggatgtatcctagggatggggaatcagagggaaggggcttgactaataccatgtcaccagggtggaatagttcctttccctcttctcagggacaggctccttgtcatgttttaagaacttgctgatatttggctaaggaggtgatgtctgcaactaagttggccgtctctcggtcaagcacaaggtcattggttaggaagggccgtccatacagcatttcgtatgggctaagtcctgctttttggggagagttgcggattctttgtaaggctataggcaacagagcaggccatgtgaggtgggtttcctgggttagcttttttagatgttgtttgagtgtttcgttcattttctcgaccttccccgaggattgtggactccaggtgcagtgtaagtgatattgtatacctgacatctgcgatagtccctgggttactgttgacttgaaagcagggccattgtcactctgtaagcctcggggaagtcgcatctgggaataatt

SEQ ID NO: 3093 - DNA, 5537 bp, Homo sapiens
atggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggttttttattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaaaaaaaaaaaa

SEQ ID NO: 3094 - DNA, 783 bp, Homo sapiens
  misc_feature (1)...(783): n = A,T,C or G
gaagatttaaanntgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtctgcacattgcataaagggtacactaaggtatgagctgaagctttaggttctccgtgcttccctcaagacctccttcttgctaacagagcagtaggcaattgctgcagtgcgttctcaccctgccaataggtctgtctgtatctcntagaaatagcctgtccctcctgcagtgcttgagcttgatgctattttatatagcgtgcaactgaccagcagtgccagccttgatctgtatctgcactatcccttacttgtcctgcactgatgctcacctgagatcacgtgtgatcacagcagctgacctggcttctccgagagaggcatgtcatttattgcaggaatgagcttcctgactcctgtgtgcttcccg

SEQ ID NO: 3095 - DNA, 847 bp, Homo sapiens
  misc_feature (1)...(847): n = A,T,C or G
gcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattntaaangntgtatanggttaagtttgcaaaatataatggcaaatgctgtatatctnttgangtgattgaaaatccacggtttgggaattttaaagnaaattattnttngtaaataantnccttgtttgtaangtaantntttttaaattgtcnncattgnnccctggnttttcctaattttncaagccaccatntccagttnntggntnggnaatgcttccatgagcctatttatgaacctgnnnttnaggcccattgnnnatttgnttaancntattnnnntttaggtngggnaatttttggnanannntgtanttttagggggaaatacccntnctaggnnnntnccantttntaccctagtttccccnaattattatntccttggnggntnnaantgtaganaanntnttccnatgnccnagtngttgtgttntnncnannnngnngnnatgnaantcccccnggggngggtggccccccntgacccccnaatttncnnncctgtgtgggtngtgnncgggtttntcnaatttctnctngcccctgngngntttncaaccngntggttncnntngggancccccttgggtgttnnccccnctnttntnctcncctntnatgngcgncccccntttttatcngntcgtnngnntcatnnncgntgtgncccntccccn

SEQ ID NO: 3096 - DNA, 521 bp, Homo sapiens
  misc_feature (1)...(521): n = A,T,C or G
agtgctctcaaagaaaaacttgatggtggaatagaaccatatcgacttcannaggtaggattatgttaacatcatcttagaagtcatattcaagttttacatgtttaagaatttaatatcggtgtgatacaatcccagtatacatctcttggaagagtatatggacataattttatgaacccagttgatgttaaaattccgataagagaaaatgaaaggttcgttaagctcataaggacatactcatctctaaatgtaatgtgctaaaatgactcatttggatatccaggtcattcagaaatgtaatgcacgttggactacagaagagcagcttctcgccgtacaaggtagggggaagttcttctaaagagtttaggaggccggctgtggtggctcacacctgtaatcccaacattttggaaggttgacgcatttgcttgagcccaggagctcaaggctgcattgatccatgatcacaccactgcattccagcctggacaacagagggagaccctgacttt

SEQ ID NO: 3097 - DNA, 508 bp, Homo sapiens
gcggccgccgccgcctccgccgccgccttctccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgagctcgttcagcgacgaggagcacggtggcggtggcatgagggtcggaccccagtaccaggcggtggtgcccgacttcgaccccgccaaactggcaagacgcactcaagaacgggacaatcttggcatgttggcctgactatgcaatcggaccacttcttatttttggccttgcccccggatttgttcactgggtctttgtctttttggccgactttccagcgtccttcttcttcttgtcgtccttaggcggcattgcgaagctcggagaatagcagcagacaccgcagcctcgtcaagatcctcgt

SEQ ID NO: 3098 - DNA, 511 bp, Homo sapiens
ttttttttttttttttttttttttttttttttttgatttaataaagttttatttttccaaatgtacagctggttggacctattcatgcatcttcaccagcagctggagcatctccacccttggtatttctggtgtaaattacttgagctctgtgctttgaaaccagtttgataagtcctttactaaggagctcctgaagggctgccctggccagggagcctcgaatcttcagtctctcagagaccacagctggggttataagtttatagttgggaacttccttacagagtttatcataggtagctttgtcaaacaagactaagttattgagcttgtcccgaactttgcccttgggaccacttcttctttttggccttgcccccggatttgttcactgggtctttgtctttcttggccgactttccagcgtccttcttcttcttgtcgtccttaggcggcattgcgacgctcggagaatagcagcagacaccgcagcctcgtcaagatgtcg

SEQ ID NO: 3099 - DNA, 480 bp, Homo sapiens
gaggttgatcaaaacaaggaaagcaaaaaggagttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaaggtagggggaagttcttctaaagagtttagtgaggccggctgtggtggctcactcctgtaatcccaacattttggtaggttgacgcatttgctgagcccaggagctcaaggttgtcat

SEQ ID NO: 3100 - DNA, 534 bp, Homo sapiens
  misc_feature (1)...(534): n = A,T,C or G
gttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtgggagacgccacttcctcaaaatggttttttattgtttttaacctataaggacgttctggatgctcacaaacctctattcaacacacaaaacaaacatggaaagggtagttaggttggggttgtaacaggcttactgggggtgggacttcattaaaaccagtgggcttttcttgttccattcttaaaggttttccctcaggatacccaccaggacccactggtttaaggtggtggcctccctttgtccacttttcaaatttttccaacgggtaccccnatttttttggtccattcntaaantatccgggtggtacnttttngggg

SEQ ID NO: 3101 - DNA, 431 bp, Homo sapiens
gattttaacaagtttactaaaacaacagtcatggccttgacaatactgaatgcaaaatactggtgtaaattacttgagctctgtgctttgaaaccagtttgataagtcctttactaaggagctcctgaagggctgccctggccagggagcctcgaatcttcagtctctcagagaccacagctggggttataagtttatagttgggaacttccttacagagtttatcataggtagctttgtcaaacaagactaagttattgagcttgtcccgaactttgcctttggaccacttcttctttttggccttgcccccggatttgttcactgggtctttgtctttcttggccgactttccagcgtccttcttcttcttgtcgtccttaggcggcattgcgaagctcggagaatagcagcagacaccgcatgctctc

SEQ ID NO: 3102 - DNA, 362 bp, Homo sapiens
  misc_feature (1)...(362): n = A,T,C or G
ttaacctataagacgttctgatgctcacaaacctctattcaacacacaaaacaaacatgaaaaggtagttagttgggttgtaacagcttactggggtggactcataaaacagtggctttctgttcatctaaagtttcctcaggataccacagaccactgttaagtgtgctcattgtcactttaaatttcaacgataccctatttttgtcattctaaatatcaggtgtactattggggtataattggcacacccaaaaataggnccaaacagtggcttacgggttaactgggggtcccctggctttttatggtggaggcttagggggnagggtgggggggccccacttncccacgggggggtc

SEQ ID NO: 3103 - DNA, 359 bp, Homo sapiens
  misc_feature (1)...(359): n = A,T,C or G
ggggggggaangtaccccccccaggggtagnccctaccgncctggccccnaggtgcccttttaggnccgccctaaaaaattttccnagattttaaaaggatggtataagggttaagtttgccnaatataatgggaaatgcctgtatatccttttgaagtgatgaaatccccacgttggaattttaaagnaaatatgttgtaataatgcctgttgtaagtaatattttaatgtcctctttgccctgttttnctatttcagcacattcattgtggtgaatgttcatagcattataactgcttagccattgaatgataacatttgttagtggaaattggnaaatttatttgtgaaattctgc

SEQ ID NO: 3104 - DNA, 223 bp, Homo sapiens
gcatgggtactacatggaacaagctcttgcgatgctctcctggcatatacatcatatcgaaaagtcattggctgatttgcacaactttacccctttcccagatgagtggactgtgggacgtacagtcttatttgagcaagcctttagttatcatggggaaaccttgggtagcatccaacgaatgcctgcagatacatctatagcgagtctggtcaaattttac

SEQ ID NO: 3105 - DNA, 593 bp, Homo sapiens
  misc_feature (1)...(593): n = A,T,C or G
acaaggtctggctctgttgcccaggttggangtgtaggagggcgatctcggctcactgtaacatcaacctcccgggctcaagcaatcctctcacttcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctgggagaggcctcagaatcatggtgggaaggcaaaggaaggagcaaaaaggtatgtcttccctggcagcaggcaagagagcacgtgcaggggaaactgccctttataaaaccatcagatttagtgagatgtattcactatcacgagaacagtatgggaaaaacctgcccccatgattcgatta

SEQ ID NO: 3106 - DNA, 384 bp, Homo sapiens
agacagggccttgctctgttgcccaggctggagtgcagtagcatgatagttacaggaaaggggtcccaatctagaccccaagagagggttcttggatcttgtgcaagaaagaattcagggtgatgccacagtgtgaagtgaaagcaagtttattaagaaagtaaaggatgaggggcaccgtggctcactcctgtgatcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattac

SEQ ID NO: 3107 - DNA, 455 bp, Homo sapiens
tgagacagggtcactctgtcacccaggctggagtgcagtgacgtgatcttggctcactgcaacttctggttgaggtgagtgagggaaagagtggttgtgagaggtgacagcgtgctggcagttcctcacagccctcgctcgctctcggcgcctcctctgagtaagccctactgagggtttacctttagaacagaacaagacagtagcagggcgcagatgtattaagtaataggatgaaggaggaggggagcctggcaaatcctaattaggtaggaggaaacataggaacccctgaaagtggccctgatgccttcaatttggtcatttaaacattggcagacactctgaggttttcattggcgttacagttcagcatgacagaaaggcgagcttttctagcattcagggaagcaagcacaacgcaaccttcctaagtggcagcacctcttaagacc

SEQ ID NO: 3108 - DNA, 1254 bp, Homo sapiens
  misc_feature (1)...(1254): n = A,T,C or G
cagtatctcatcagagcnnaggtgatctcaggnnctagtaacagttttggaaaagaaggaaaagacacaggaaaaatctttaaggaacttataacttttatgggatccagtcctaaagtagattagaccgatgtagaattctgtctggagacgttctccccttcaattcaatgggaaggctcttttctggcatgaactctccgatgtctaatgagctctgagcaccatccataagctttcccacattctttacatataaaaggtttctctccactgtgaattctccgatgctgacttagatatgagctttgactaaaggccttcccacactcattacactcatagggcttctctcctgagtgaatcctctgatgctgaacaagatgagcaccccatctgaaggccttcccacattcattacattcgaagggtttctctcctgtatgaattctctgatgctgaccgaggtttgagctctgtttgaaagttttcccacagtcactacacttatagggtttctctccagaatgaactctctggtggacaacaagatgtgagttataaatgaaggttttaccacattcactacattcatggtctttcttccctgtgggaatttccttatggatgacaaccatctgcctgaaactttcctcctgggcaggggaccacctcagtctctccgctttgggatttctctgctgcagttctaaggtaccctcagaggtagcttcaaatgtagaggtgtcagtagcaagtttttctgagaacacctgtgattccacttcagtaatgggtggttgtggcaatgatcctttgtccttgggctctgggccatcttctgtaacaactgacagaaaatgtaaatatacctgttctggatgtatgaagaaatgacacttagattaaaatgtatatttctggaatgaaaacaaatgcttaaaaacaactatatatatgacaaacattcgaagaatatttactggatattgccaacagttatctcttggtgatgggactatacagaggagagggtttcttctttttaatttctcccatttatctgctttttttcccctaatttctccataatgaaacactaaagaagttttattgaaaaaatgaaagcaattacaatgcatggtctttttaggatttttcatattttcaaggaatcagggaatgatgttgtgaagaaagggaaaaacatgaaaagaatcattagggttaaggaaaagggaggtttctnanngc

SEQ ID NO: 3109 - DNA, 366 bp, Homo sapiens
  misc_feature (1)...(366): n = A,T,C or G
cagtagcaagtttttctgagaacacctgtgattccacttcagtaatgggtggttgtggcaatgatcctttgtccttgggctctgggccatcttctgtaacaactgacagaaaatgtaaatatacctgttcactctttgggaaaggctgggtctccttaggctggagctggatgctcagtgcttcctgggctgctcccagagattccttcttctcccatggctcttcctgtgcaggtccatgtgcaggncctgggacaagactgttcctcttcctttggtcccatcatcatcatcttctcttgtccctgtgtaccctgaagggccagagtttcagctgctgttagtgatacagccatcctagtctgc

SEQ ID NO: 3110 - DNA, 208 bp, Homo sapiens
agaccccttagtggtagagtggtccccaggtagccgtggtgtaatactcaaaagagtgtcctctcctttgggcccataataatacctctcttgtcccctgtgtaccctgaagggccagagtttcagctgctgttagtgatacagccatcctagtctgactagtctgcagaaggctaataccagctggaatcttgaagggccccctaac

SEQ ID NO: 3111 - DNA, 483 bp, Homo sapiens
aagaaagaatagaattaaaagggagaaacaggttttagacaacctagataaaatattaaaatatgaacaattttatgaaaaaaatgtgaaaatctagatgaaatagatatttctgagacagaaaatgttaaaattgacagaaaaaaatcaaaggcttggatacaactgtcctttttaaagtgcccagccaggctactgcccatgtcctggagaggtaggaggcagggctcagacacctgaccaaattgaggactaactaaaacaggtaggtcaggggtggaagccattttcgataagacatacccaccaatatgtcatgtcagtttaccattgccatggcaacacccagaagttaccgcccctttccacagcaacaacctgatgacttaagagttgccacccttttcctagaaatttctgcataaactgccccttaattcgcatatagttaaaagtgggtataaatatgagtgcagacctgtc

SEQ ID NO: 3112 - DNA, 575 bp, Homo sapiens
ttttttttttttttttttggttttttgcctttgtgtgcggtatttatttcaaatgttttttaaaacagcactgttatttctcaggacaagagcaaaaatcaccccctgcagaagcttgggaactatgtacagaactttacagaatagaggcaatactttagcttaagcctgtctgctgaccagagaatggaattctgcgtggactcaaggaacaaaaggaaactaggcagggaaggggaagaaaagtgcccatctgaatcaaacttcagctgccatcagggcacatcttgtggtggtcacagattgtaggctgttttttggaagattcgggttcagcacaggattccatttgtctacttggctacacccctggctgaggtgccatgaggtcaatgtcactcaagttcctggccagccaaactcccgcagcaaagagtcccaaatttagtatcaagttcctccggaagtcattcctatcagtggcaaagcggtagacgccccgaagccaatctcccacgttgtccggtatttcgggagtttcattagccgagccagcagcgctcaccgggacagtg

SEQ ID NO: 3113 - DNA, 491 bp, Homo sapiens
tttgcctttgtgtgcggtatttatttcaaatgttttttaaaacagcactgttatttctcaggacaagagcaaaaatcaccccctgcagaagcttgggaactatgtacagaactttacagaatagaggcaatactttagcttaagcctgtctgctgaccagagaatggaattctgcgtggactcaaggaacaaaaggaaactaggcagggaaggggaagaaaagtgcccatctgaatcaaacttcagctgccatcagggcacatcttgtggtggtcacagattgtaggctgttttttggaagattcgggttcagcacaggattccatttgtctgcaatcagatgataagacgacaggtggcattagaactacttggctacacccctggctgaggtgccatgaggtcaatgtcactcaagttcctggccagccaaactcccgcagcaaagagtcccaatttagtatccagttcccccggaagtcattcctttt

SEQ ID NO: 3114 - DNA, 512 bp, Homo sapiens
tgtatattataaattttttgcctttgtgtgcggtatttatttcaaatgttttttaaaacagcactgttatttctcaggacaagagcaaaaatcaccccctgcagaagcttgggaactatgtacagaactttacagaatagaggcaatactttagcttaagcctgtctgctgaccagagaatggaattctgcgtggactcaaggaacaaaaggaaactagggcagggaaggggaagaaaagtgcccatctgaatcaaacttcagctgccatcagggcacatcttgtgggtggtcacagattgtaggctgttttttggaagattcgggttcagcacaggattccatttgtctgcaatcagatgataagacgacaggtggcattagaactgtaaaagtatggggaggggaaccggtaagggatacttaaatccctttcaacatctgaaaacacatttaactaggaatagttaagggttttacatcacattcttttgtacatttcatgaatacttg

SEQ ID NO: 3115 - DNA, 372 bp, Homo sapiens
  misc_feature (1)...(372): n = A,T,C or G
gaagattcgggttcagcacaggattccatttgtctacttggctacacccctggctgaggtgccatgaggtcaatgtcactcaagttcctggccagccaaactcccgcagcaaagagtcccaaatttagtatcaagttcctccggaagtcattcctatcagtgggcaaaacggtaggacgccccgaagccaatctcccacgttgtcctcgtgccgaattcctggcagcccgggggatccacttagttctaggagcggccgccacnggttgggagcttccactttttgtttcctttagttaggggttaatttcgaacttngggttaattaatgggncataagctgttttcctgttgttgnaattntttattccc

SEQ ID NO: 3116 - DNA, 684 bp, Homo sapiens
  misc_feature (1)...(684): n = A,T,C or G
ggagatggatcttgcagtgggctnagatcgcgccactgcactccagcgcnggcaacacagtgagactctgtctcaaaaagnaaaaaaaaaaagaaaattgtcaaaacacaaccaatagataatgttaacatgcattctaacatgcaatttattggatttagcgaatagaatgtgagtggaagttacttttggtagaactgttgggaaaagggcttgtggagtgcctgcataaactggccataaaaatatgggacaataagttgtggaaagccacaagaggcctctgaggaggaaagcctcctaattgccatcacgttcctatgaccagagtgtgacctgctctcttatctataaacactgtgctcaaggagaaagacactcctttgaagcattggaatgtggccagatatgctggcttctagttaggcccactccccacagctgctctctgataagtaaaagaataaatcagtagttaagtttatgctgcttcagcacaaagaaaatgtacctaaactgccattgcccccctttcactgtttcacccctgaacatctgcttcttagatctaagtgattgtactcaataaatagtgtggagaccagagcttggcgcctttgcagcttttgatttgctctggccccttggctcccacctttatgaactcttaaaaaaaaaaaaaaa

SEQ ID NO: 3117 - DNA, 751 bp, Homo sapiens
  misc_feature (1)...(751): n = A,T,C or G
atntgaacccaaacagggaaatcaaaacccaaaaaattgaangaacacgcaactgcaacagggaagctctttccctttcatcanaaatgaatccccagaggctgangattggaaaaattaanacaagggtcgttccccagtgacccccacgctcaggaacccccacggtgcacagccagcagcatcccacacctgcagggccccaggaggcggggaccagtgtnantcacgccctggcactgcggaagcagacatcagcgttantcacgccctggcacctgcagggagcaggaggcagagaccagtgttantcacgcctgcttggtatctgttgggggaaaggcttatggggtgcctgtattaactggccataaaaatatgggacaagaagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccagaaaaaaaaa

SEQ ID NO: 3118 - DNA, 490 bp, Homo sapiens
agggcctcgctctgttgcccaggatggagtgcagtggtgcaatcatggctcactgcagcctcaacctcctggactcaagcaatcctcccacctcagcctcctgagtagctgggactacaggcatgtgttgggaaaaaggcttatggggtgcctgcatagactagccataaaaatatgggacaataagttgtggaaagccacaaaaggcctctcagaaggaaagcctcctaattgccatcatgttgccctgctcagagcaagacacactctcttatttgtaaacactgttcaaggagaaagacactcctttgaaacactggaaggtgaacagatgtgcaggctcctagttaagccactcccactagctactctctgataagttaaagatatgctgtttgagcacaaaggagattcatttaaaccgctattactatagattacgtctatgacgcatagcctccctttcactgtttcgccctgaacatctgct

SEQ ID NO: 3119 - DNA, 367 bp, Homo sapiens
aacatgtgcaaaataaaatgcattttatattacttgaattaaaagtttagtcctctgaggtactggtgtgttaggataccactataattttaaataggttaggacattgttgggaaaaaggactgtggggtgcctgtataaacttgccctaaaaatatgggacaataagttgtggaaagccacaagaggcctctgaggaggaaagcctcctaattgccatcatgttcccatgctcagagtgagatccgctctcttatctgtaaacacagtgttcaagaaaaaaagacactcctttaaaacattaaaatgtggacagatgtacaggctcctagttaagcccgctcccactaactactctctgataagt

SEQ ID NO: 3120 - DNA, 1364 bp, Homo sapiens
  misc_feature (1)...(1364): n = A,T,C or G
ccangtttaaaancccgggtgcttggggnccaaacccccnaatttccgnaaggncgggtcnaccccagntggtttccancaggtccagngggttcccaattttttcccagatgcaggctgcccttaaaccccgggnaacacacctttatatcccaggtaggactggccaaaattaaactagggctggccaaaaccgtgcctttcctcactttaatctcactaaagtggttaagactcaagttattttgttcttgcaatggcattgacaaatgtttgcaccaaaaaccatgttgaagttcattaaggaaactgtgatccaagatccaaggtcaaaaaaacaaattcatcaattcagcacaccaccaactcacaggctaagcatcttactgctaattcattgatgctgccatttgtcaagtgccaaattgaattattgatttgtcaataatttccttccgttggttacttatatagtatattgcaattcttgttgctgaagtcagctacactttttctatttgaaaaacaatttcttgcatttgggatttcaggtatagtgattgttacaaatatgaaggacttgaattaacagcaagttttcaagtaaaactttacttatgtataactgaatgagttcttaaagacatttactaacaattttccacaaactaaaaatttataaaacaataaataaaatagactttaaaaaaaagcgtgtcacacagctgcttgttttttgtttgtttctttgtttgttttttagtagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactggcccttttgtggcctcgtgaaatcaaccactttctctgtgaaatccttgctgtcctcaagctgggctgtgctgatacctggctcaaccaggtggtcatc

SEQ ID NO: 3121 - DNA, 887 bp, Homo sapiens
  misc_feature (1)...(887): n = A,T,C or G
tttttttttaatttctaaagaaaagaagtttaattggctcacagttccacatggctggagaggcctcaggaaaggtacaatcatggcggaagccacaggggaagcaaggcacgtcttaccatggcacagcaggagagagagagcaaagggagaagtgctgcacttttaaaccatcagatttcgtgagaactcgttcactatcaacagaacagcaagggggaaatccctccccatgatccaatcacctcccaccaggtccctcccctgacatgcggggattacaatttgacatgagatttgggtggggacacagagccaaactatatcatttggttaaagaagtaagtggcctgtatttaacttttgggactgggaaaatgaattaaaataattctttattttacagatattaaagtaattgtgaaataaaagaaaaaattgtctgataaaaccacatctcatagaaacccaatgaatgcaacacatctaaaattttatctgcaaaaaacgagagaagacttgcccttctgtcagtaaagcacagataaagagaagtaaacttttctggattgaggcaataattgggcatcaagagtccacgtgacaactgaggctggcagttcaaatgtcacacctcttaggaatgactttccttgcacagtgctctcctcagggcacccttgacctctacattcctcaggttgtaaatcagggggtttagcatcgggttgaaagaactgtaaaatagaaaaaggaccttctgctgctcctcaggatggcgggacttaggggccatgtacatgacgatgcgctgccaaagaagagtcccactacgcagagagaaggaagcggaggagaggcagcgagcggaggaactgtgccgaant

SEQ ID NO: 3122 - DNA, 432 bp, Homo sapiens
gcagagcatggtcattcaacatttattcaaccaaaaatactaagtcagctctatacaaactaatggaaggatacagctatgcaaatatagaacactaaagtgttacatgacagatgtatgagaagtaccttttgcctcccactgtgattctgaggcctccccagccatgtgcaactaactgggaagaaaggaccctgaaaagttagctggttccaagtgaccctccaaggggaagagtgctggattcagagcccacctcaggggaagacaggaccctctccaagatggtttccctagaagctactacctctccctggagggtggagatatttgctggtcaaagcaagaaggccctctgcagatgctgacaccttgatattggacttcccagattccagaactctgagaaataaatttctattttaaataaaa

SEQ ID NO: 3123 - DNA, 338 bp, Homo sapiens
  misc_feature (1)...(338): n = A,T,C or G
gtcattcaacatttattcaaccaaaaatactaagtcagctctatacaaactaatggaaggntacagctatgcaaatatagaacactaaagtnttacatgacagatgtatgagtagtgaaatggtgaaaaatcagacaatggtcacagagttcctcctactgggatttntcctgggcccaaggattcanatgctcctntttgggctcttctccctgttctatgtcttcaccctgctggggaatgggaccatcctgggggctcatctcactggactccagactccacacccccatgtacttcttcctctcacaactgggccgtcgtcaacatcggctatg

SEQ ID NO: 3124 - DNA, 265 bp, Homo sapiens
  misc_feature (1)...(265): n = A,T,C or G
ggaagtttcaggtcattcaacatttattcaaccaaaaatactaagtcagctctatacaaactaatggaaggatacagctatgcaaatatagaacactaaagtgttacatgacagatgtatgagatattaaagtaattgtgaaataaaagaaaaaattgtctgataaanccacatctcatagaancccaatgaatgcaacacatctaaaattttatctgcaaaaaacgagagangacttgcccttctgtcagtaaagcacagataa

SEQ ID NO: 3125 - DNA, 995 bp, Homo sapiens
  misc_feature (1)...(995): n = A,T,C or G
ccaaaacccaaacccaanaaaaacccaaaccccgggattaccggggatggggagtcccaggtgtcccaattcaacttggttacacatcaatataaaccccacagtgtcctggcaaacaaccatgctttcattttctgtctcatcctagagctcgaatcctgattcatttcagcagagactccacaggcaacaggaaagattgtggcattaaaatattcatttatacttttgtggtagttcaaaacagtggtcttatttctgggcaagcttacagaccatacaaggtcagaagcataacttaaatgggagctaagactcaaatgaaaaaaataagaagaagaaagaaaaacaaaaagaaaatcaaaaccaaaaaaacaaacaaaaaaacccctctgggaatagctagggcatttaaaggaaccataaaaatgccaacagtatttaaacccccttttttaaaaagggaatttttttttggcttaaaatatttcactcaatgaattatgtcagctgtcaatgaaagaatgtcactaatacactgtggacaccttttgcaatgtaaatccatgccccctttttttacatgttgaacttcaacctagcaattattacaacaaatgttatagtctaaagctcaaacacattttagcaattttgaaattgaactgcgtacaaaccaaataaaatttacatcataacaaacatttccccctaagactgtggggacacttgggccttcctcattgatctcagggccttttcacgcaggtgcttttctaaatcatcaaggttatcttcagcttcactttcagtctccttcttcggctctgcgctgccactggctcttcctgtgctaatgtggttgtggcagctgcaatggctgcaggggtcacagcagctgcagcagctgcagccacagccttttccttcttgtgttttttgtgcttcttgtgcttcttatcctttttgtgtttcttgtccttctttttcttctt

SEQ ID NO: 3126 - DNA, 742 bp, Homo sapiens
tttttttttttctttttttctccccccccttttttttttttttttttttttttttttttaaatttagaaatttattctgtttaatccacaagctttatatagctttagtttaaaaaaaatcaaaacaaaaaaaaaaatcaaaacaaaaacagtgaaaccaagacactattccaaagtctgggcccttccagccttccaaatacaagaggctctgaaagttgtatataccaattggaagaacaagacaaaaatatgaacagagccatgacatttcattaaacaaattgtatgtaactgaaggatcctttctgggactagctcattgcctttacaaaagaaaaaaaacaaaacaaaaaaaacaaaaccagaataacagaatgagagtccagtgttccaaatcaacttgttacacatcaatataaacccacagtgtcctggcaaacaacatgctttcattttctgtctcatcctagagctcgaatcctgattcatttcagcagagactccacaggcaacaggaaagattgtggcattaaaatattcatttatacttttgtggtagttcaaaacagtggtcttatttctgggcaagcttacagaccatacaaggtcagaagcataacttaaatgggagctaagactcaaatgaaaaaaataagaagaagaaagaaaaacaaaaagaaaatcaaaaccaaaaaaacaaacaaaaaaacccctctgggaatagctagggcatttaaag

SEQ ID NO: 3127 - DNA, 424 bp, Homo sapiens
tttttttttttttttttttcatgacaagatacatctaagttttattctaagagttttacaggcacttttaggtcttacatttaggtctttgatccattgtgagttaatttttgtatatggtgtgaaacccttaagtctttaaatcatcttgaaatgttttttgtgtatctactcctaggtgatcatctatctgcaggggacacccaaatctttgggtgtaagatagaaattcaatttcattttttcctcatggttaacccatcattccagtaccataaatgggagttcctcttttcccacaaatcagtcacagaaaatctgtttctgggctctgggtagtctatttgtctgtcaccatcccaatttcacattatcctagttacttgagctttatagaaagtctggatttatataggacaagtat

SEQ ID NO: 3128 - DNA, 1094 bp, Homo sapiens
ccatgcagaatgaaaatcaaagaccacacgtcatggtttcacacttgacatgtcatcagcatcaaattcatgcaaagctagcaatactgttacactactttatcacaggcaaactgagattcaatcacacggccccatattaagtccaaataacatatagatgtttaattagtctgttctcacactgctataaagatactacctgagacctggtttactttataaacaagaagtttaattgactcagttccacatggccggggaggcctcgggaaacttacaatcatggcagagggagaaacaagcaccttcttcacaaggcagcaggagagagacagtgacagcaggggaaactgctgtctttaaaaccagcagatcttgtgagaactccctctctattatgataacaacataggggaaaccacccccatgatcccatcacctcccatcaggtccctcccttgacacatggggattacaatttgagatgcaatttgggtggggacacaaagccaaaccatatcagatggtgaaaatgttatactaaaaatgcacagtctctacaaactccctggtttcttttctgtcagtgaagtcaaatatctacacaacggccctggacaatgctacagggaggacacattaccttaatcatctttctgtcccacttctcagccacaaaggcccgagaggggcatgaacttggctggtgagctctgcacctcaacattctcttcccaggcttgtctaatcaaagataactgttccaattacattttgaattggtaactttcagaaatgcacaattaggcatgctatccagatacaatgcacaatcagtattcccttattgaacacctatttttaaatatctgggtctctaaccacctgtcattcttaaactacaggtccacatttgacaggaaccaagagccactgggcaggagctattttataaagtggatattgcaaagtaacagtatgcctgtcctaacagaactgggagcattgtgttcccaagcacctaaatcaacagaacaccaggacattaggaaagacacgcttctccatggagtgttgacttcagggcttcc

SEQ ID NO: 3129 - DNA, 897 bp, Homo sapiens
  misc_feature (1)...(897): n = A,T,C or G
aagctaaaattaccctcactaaagggaataagcttctttttcttttttttctttttcttttttttaataaaattatagatatatagatgtagatataaaaacataaaacagacacaacgcaagcagacgctgtcatgtgcttactctcaggtccctgacaccaagggaagcactgacccctccccagtgtgctttcccacggcgcgagcaccgcagccaggccggggctgcggacgtggcatgccttggggtggggttctccagtttggcagggagggcctgagggctggggagggggctctgggtgtcaccagccccctgtggcagcatcacccccgtgcctgctcccgcctgcccccccgtcgcctcccacaagagcataaagcaaaggttaaggctttgatgaaagggacagcggcggccggagcactgacacatcagacacggcgcggcagcacagcacacagacacgggacacatggagccgggcccccggccaacagctggctggctggccgtctgtccacctatccaccaccacccagagcaggccagggcagaagcatcagccttgccaagctacaagcttccagcggggtccgtgaaaggcaacgcgttagttaggagtagcctggcgggggacactcggtccgggagcccacaggctgtgtcagaaggacggtgggggccctgggtgcctctgtccatctctgggacctgtccgtaaggggaccattgggggctggctggcggtgatctggggtgctgggtgatggcagtggccaagcctggctgagagagggtgccccaaagaggctgactgggccccctcactgccccagccatggacaggcccagacacagacccaanccagtggcccttgtcccagtgagccg

SEQ ID NO: 3130 - DNA, 9781 bp, Homo sapiens
ggatcctctagttgcctgaattacaaagttggtcccttggttaaagcattccttcactggctcagcttgctggaaagacttttaagagaaagaagaggagacagaccccaaggtacagaaacccgacctaccacggcttgctccttccctttcctcgcagaggttttctctccagccctggactcctgtaggatctcagctctgagctccccacagctccggcctccttaagtttccaggcagggggtggggtcggtggccccggctgggcgggtttctgtgtggcgggaggatgctcagtggacagggccatgagggagctgaggcaggcctgtttttataaagcagggggaggaagttcacggtggaagcagcacagcccatcctggcttcgggccaggctgattattcacagccgtgatgtcattgaatcgcaggaatttggaagtgggatgggaccttaagaatcatcttcctttagagtcctagtgtcccaggcttaaaagggactttcaggaccctgtgatgacaagaagtgtttataattctaaaggcagcaggttggggctgggagtggggtgtcttctggaatctgtggctgtagctctggcctctcaggacatgagaggttaaaaggactggaggatgcacaaggattggaacactttgtgtggtgcgggagctcaggggggtagccactgagaaggcaggaccagccttgggctcacctgcggtaggaggtgcccccatgggggtttgctccggtaggcatctttggccctgttctgtaattttagggagaatctttctcttctttgtaaagtgcagggctgcagtaggtggcctccggggactttccggctccagcatccccttgagtgggcccagggaatatacacagggccttggggccaacatgcctgaaattcgatcaaagccatcagcccttaagcccaccgaagcctttcagtatttgcttgtaaaatgcccctggaaatagacaagccatttcccttgctgacaccttttcagatgactgagaaataaaagccctgtcgtgtaggggaaagtcttaggtttaaatccggctgtgccagtaactgggatatgacctcaatcaagattttcaactatgctgagctctggcttttgcatctgcaggtcacgtgaggatcagagagaagccacgcatgtcagggccctggcacatcacagggctcagcaggagcatctatcatcattggttcatgtctggctgagaccagaccttgtaaaaatgagagagaggtgaaagaaagaacgcagggagggaagagaagtttggcagaggaaattgtgggatgaccgactattcaggagaggccagatttcatacattctgatcctaaatatactcatatttgtcaaaccatgagtgctgagtttgaagttgaaaggcacctaactgcttttcacattgctttcaaactgtttttcacatttttatgaagctgcagccctgctgatggtcattgtagaaaaggggcactggggtgggttgcctgctgagcacgggaggtagacctcccatgagcagcagcagctgtgggcctgtctggtgggcatggggctgctttcctgcaatgtggtctaagatggtgaggatggaggcttttttggggggtggggcattgccgttcagcagggagtgctggtcatgaggactctcatttgaactcttgagaggatggttttccactgaatggttgcacttaaatcctggatcctgaacctctatggaaaacaatatggagatttcccaaactaaaaatagaacatccatttgacccggcaatcccactactgagtatctattcaaagaaaaagaaatcattacatcaaaaagacacctgcactcacacgtttatcacacacaattcacaacagcacaattcacaatagcaaaggcacagaattaacctaagtgtccatcaatggaggactggataaagaaaatgcacatatacaccgaggaatacgacaaagccgtaaaaaacaatgaagtctgtcttttggagcaacatggatgaaactggagaccattatcctaactgaaataactcagaaacagaaagtgaacaaccacatgcactcacttataaataggggctaaacaacgggagactgagaggagagggtttgcagatcattagcaggggccctgagctttgctgaaatatacccgaatgattaagacccagcaatatcctgcagccctagaaactggggcctctgtgttccttctgaattgagattggtttccctcggacagattctggggaagcctgagaatgcagaattaggcatgggcaggctgataaggtgacaatgggagccttgattttagtcaagggatcacttcgaggaaaagaaaagaacagaaaaaaaggaaaaaaatcttggtgacctcacatcctgtgaacatttcatcaaagcccttcattttcaaaaaagagaaataaatccaggcctagataacacggagacaaagtgggcacagagaaactggacggggaattgctgcagggcttttcccagccagcctggctgtttctgcagtgggcgcctcccccacagaatgcatgagtcatggaggtggcgggggcagagaacaggggctgctccaacccttctcactggggcaggtggcaggatgggtattcgaacgagagccatgctgggactctgctcagctgggtaagaaatgatgtgatgtctctggaaactcagagaaaggaagagtgggcaagaaacttgtttttttttttttattttcttttttttttttttgagacagagtcttgctctgtcgcccaggctagagtgcagtggtgtgatctcggctcactgcaacctccaccaggttcaagcaattctcctgcctcagcctcctgagtagctgagattacaggtgcccgccaccacgcccagctaatttttttgtatttttagtagagacggggtttcaccatgttggtcaggctggtctcaaacccccgacctcgtgatccacctgcctcagcctcccaaagtgctgggattataggtgtgagccaccgcgcccagccaagaaacttatgacaaggatgttttggaccagaagacggacattctgtgtctaaactaagatttaattttggtagccatctggctttgcaggggatggggtaaatgtcatgatggatctaaaatcggtgttattgtcgcacgccttgtctaggtctccatctagactgggaatccccggccctggggccatgggctggtatctgtccgtggcctgttaggaaccaggctgcgcagcaggaggtgagtggctggagagccagtgaagcttcatctgtgtttacagccgctccccatcactcgcattactgcctgagctgcacctccggttggatcagcagtggcactagattctcataggagtgcaaaccctattgtgaactgtacatgcgagggattgaggttgtgcactccttataagaatctaatgcctgatgatctgtcgctgtctcccataacccccagatgggaccatctagttataagaaaacaagctcagggttcccactgattctacattatgctgagtcataccattatttcattatataatacaatgtaatagtaatataaataaagtgcacaataaatgtaatcctcttgaatcatcccgaaactatctcccctccctctgtccgtggaaaagctatctttacaaaactggtccctggtgcaaaaaagactgaggaccactgatccagactagacgcccatggtggtaacagcaccagttgtgtgaattccacacaaacaatgagaaacatcaaaacaggacaagctgaaggcatgggaaggactcttacaaatcttattcttgttaagagctgttcaccaaactgtaggaggaggtctttattcttgcaactctttggtaagtttgaaattatttcaaaatattaagttaaaaattggattattttcttggagcagtaatttttgaatatttagcctgctgacatgcattttttaaatccccatacaagataatgataagtattcaacattgttttgactgtctaaatactgaaaataacttagatgtcaaaacataggggcctagtagactaggacatgttagaatactgcaatattgtgtagccattgagatgactgataacataattataccgacataccaaaataaatcataaaattgccttgcccaaaagaagaagaaaataaatttgtacatgagctgtgatataaataatgtagatcaggcatggtgtctcacacccataatcccagccctttgggagaccgaggcaggcaaatcacttgagatcaggagttcgagaccagcctggccaacatggtgaaaccccatctctactaaaaacacaaaaattagtcaggcatggtggcgggcacctgtaatccccgctactcgggaagctgaggcaagagaatcacttgaacctgggaggtggaggttgcagtgagccaagatcgtgcaacaagagtgagactccatctcaaaaaataataataatataaacactacatagatgtatggatagagattagaagataaaactaggtgttggagtactgtcattattggtgaattgtttttcagttcctttagtgatgcttctaaatgactttcataaaagtagatgtactggctccacactgggtgtgcccagcccaacactctctctctggcactggaaggacctggttgttcatggaagcgtgtcagaagaataggaattttccttaataacttatgatggagtatccatgagtttattcaagttatttttgaacacatctaattttcaatcaattcctttgtggagtgagttgagtttctcaggttggtttgctgattctccgacacagaactttctttctctgctcctaaatctacctcttttgagcctcctaacacatcgccagctatcaatcttcaaatacacccccgtggtgaatgtgcaggctactggaatgagcctggggttggaagtcagaaagtttcctttctctcctctgaggtcagttgcacgactctggtccagtccatttacctttgataagctataggttccttgcgtttcagataagagaagtaaagatggaaagaactttgcaagggaaagcctcgtactgttttctcaaagatgaagaaaggaactttaaagagcccctgactcaaattttttccaactgcctcctaagctatgttagtgttacacacatgaacaagaaccaaggctaccaagttaaaaattgaagtactctcttagagcagtactttttttgaatatttagttgatatggtttggctctgtgtccccacccaaatcttacctttaattttaatccccataatccctacaggtcaagggcagaaacaggtggaggtaattgcatcacgaaggcggttttccccaagctgtgagtctcatgagatctgatggttttattatcgtctagcatttcccctccttgtgctcattctgtcttctgccgccatgtgaagaggtgccttcctccatgattgtaagtttcctgaggctctgccagccatggggaactgtgagtccattaaatctcttttctttataaattacccagtcttgggcatttctttacagcaccatgagaacggactaatacattagcccagtgaaatacattttttaaattcccatacaagataatgataggtctacaactttgttttgactatctaaaaactgaaaaacaatagtagtttaaaaaaaaaacaatatcactggactaagtacaagataataacaggggaaactgcggagggaagagaagggataataatatgggaactctgtgcttcctgctcaatttttctgtaaacctgaaactgctctaaggaatgtctattaatttaaaaaatattgacaggaggcagtggctaacatctataatcccagcactttgggaagccaagacagggggatcgcttgaacccaggagtttgagaccagtctgggcaacagagcaagaccctgactctgagaaaatatttttaaaaagccattcagggcttgaacctgggaggtggaggttgctgtgagctgagatcgcgccactgcactccagcctgggcaacaagagtgaaactccgtctcaaaaaaaagaaaaaaccattcaggaggctggggcaggcagatcacgtcagcccaggagtccagggctgcagtgagctatcatcatgccactgcagtacagcttgggcaacagagcaagacccccaactctaaaaataaaaagaagaaagtacttgcaaatgaaaaatatgatcatttctgatattataaaattatatctagaatatatttatgtatgcatattttacataagaatttaattttatttgcagaaatatttggtctgtaagaatattcactgccatctgcttatttatccaacatatcatagctaatgaatatctgtaggaattctatcacagtcgtataattttaagggtgtctctggtcaatctgtttaggaaaattgcgctactctttatttaacttaattaattaattttttgagacaggatctcactctattgctcaggctgaagtgcagtggcatgatcttggctcactgcaacctccacctccccagttcaagtgattctctcacctcagcctcctgagtagctgggactacaggcacacaccaccacgcctggctaatttttatatattttttttatagagacggggtttcaccatgttggccaggctggtctcgaactcctgaactcaaggtatccgcctgccttggcctcctaaagtgctgagattacaggcatgagccactgtgcccagcctactccttattttaaatgtgcaaactctgcaaagtggctgtgctgaggcacttccaaatgccacccaggtggtgctcaagctctggtttctgctctatgagcccttcttcttctggacctggtgccaccaacccttgcagcctcctatggaggatggtgcgtgtttcctttcagcctttctggtcatttcttttcttgttttaaaataacaacaccaggccaggtgaggtggctcactcctgtaatcctaacactttgggaggccaaggtgggaggattccttgagcccagaagtttgagaccagcctgggcaacatggcgagaccctatctctacaaataattaaaaaattagtcaggtgtggtggcacatgcatgtagtcccagctacttaggaggctgaggtggaaggatcccttgaacctgaaaatttgaggttgcagtgaactgtgatcccatcactgcactccagcctgggagacagagtaaaagcctgtctctaaaaataaaaaataaataaacacataaataacactgacaataaccaaaaccaagtgaatacagataattccttctgaccccagggtgaccccagagtcccaggccatggctgtgtctggggcgggctcctttgggagagcggccaaagccctattcacctcggcaatgagatcactcagacctggggggaggcgcgttctgggagagcgtggtgacttccacagcaggggctcttgcatcagttctggttacccacgggagactgcatgtgctcagggtgacaggaacaccactgtttacatgggacccacctcccgccatggcatcacaggactcgccgctccggcctccttcctgagtcaagcatttttgtccagtgaatacagctttggtgtagctttccatagctcctctctcctccccgccaggaagtgatgcatattttatagagatgttctttcacttcactctaactgtacattttttcctctgtgaggagtttgcgccaatcgaaatgaacttgagatcattttccccccaggctttctttatctaaggggcacagggcttcctgtctgattttagtcaccgattggattgatgggcttaatcacatcccaaatgttcgttgtcctatctccctgtgtgtgcaggactggctcagtctgcagcttttattagaaatcaacggaagccaccagaacacagagccctgaatgaacactgtggacctggatcatccgacctgaactccaatgtagaagaaagcccctctgtacgcacctgctgacctgcctgtcaccaccctcacagctgtgccgggacaatggcacagacccacccattctaaagttaccatctgatatgtgtgggctcatacagaaaacatgctgtaatgtgaagacataaatcagatggaagaacacattgatgccaactttttttttttttttgagacagagtcttgctctgtcaccctgcctggagtgcagtgatgcgatctcggctcaatgcaacctctgcctcctgggttcaagtgattctcctgcctcaccctcccgagtagctgggattacaggtgcccaccaccatgcccagctaatttttgtatttttagtagagacggggttttgccatgttggccaggctggtctcgaactcctgacctcaggtgatccacctgcctcggcctcccaaagtgctgggatacaggcttcagccactgtgcccaatgccaactttttaaaaatgcacactctttcaaagggttaacagcacaggagaggttgttgctgaaggtttgcaaggcaattgctctgaaatcatattggaaaccaaagcagtaggtgtgcttccccagtagagcgtgttgacagggccttggggtttagaataagaagggaagagtttccagcatgtcaacgggcatcgtggtaatggttcacaatgggtcattgagtctaggctgacagggcaaagggctgaaagacagggaggattggcgctgaggagccatggagactccaggagcaggaggcagggagctgggagggccatcacacatggtcatcccccttaaccacaaggatgtgttccaagatcccaatggatgcctgaatctgtgggtagtaccgagcactatatatacgatgctcttccctacacatccatacctatgatcaaggttaatgtggccaggcatggtggctcatgcctgtaatcccagcactttgggaggccgaggcaggtggatcacttgaggtcagccgttggagaccagcctgggcaacatgatgaaaccctgtctctactaaaaatacaaaaaacttagccgggtgtggtggtgtgtgcctgtagtcccagctactcggaaggctgaggcatgagaatagcttgaatccaggaggcgaagactgaagtgagccgagatcgtgccactgcactccagcctaggtgacagagtgagaccgtgtctcaaaaacaaaacaaaacaaaacaaaacaaagttaatgtataaattaggcacagcaagagactaacaacaataaccaatagtaaaatagaacaatcataacaaggtactgtaataaaagttatgtgactgtggtctctctatatatacctctctctcaacttattacagaagtgagctgggcaaggtggctcacacctgtaatcccagcactttaggagttcaaggtgagggattgcttgaagccaggagttcaagatcagcctgggcaacagagtgagacccacctcatctttacaaaaaaatacagaaaattagccaggcatggtggtttgctcctgtggtccagctacttgggaggctgagataagaggatcc

SEQ ID NO: 3131 - DNA, 2703 bp, Homo sapiens
ataaagagtgggatacagcatctataacaaaaccttttttttttttttggaaaaactgtgaaaaatatatctgaatttattaagtacagtataaaacagggttgtggcaacagaaagtaaaaactaacatggattgctataaatatgctgaagcctagttgttcaaatgatacaattctctcatgctactctaaagtttataaagaaaaaggatttacactttacacactgtacacaaaaggaataccttctgagagccagggagtggggaaaggggaaggagacttgacgtcaagggtgcttttgaggaacatgacgggccagccagcctgccccaactttgaggccctgctgggctcttgtgactataaatatactgtctatttctaatgcaatccgtctttcctgaaagatcttgttatcttttactattgagacatgctttcatttttgtggtcctgtttccaaagctgctcacggtgacaggtcaggaggttgggctttagctgaaaacagggtggcatggccactttctgcccagggaggaggcattcctggagaggctagtgtgcattcatgtcttcccatctgacagagtatcctgaaatcagaccaagtcctgaaaacttccaaaatgggaagtatctgggaaaatgcactcttccctctcctgtagggtctcgtcccgcttctgcggtgtggtgggtctggagaagtctgtagagaagcactgcgcctttgcagtgtcttctgaagaagaagaggcgggatctcatttgcttttgaggagtcgggtgttcctggtcacggtcgcatgttgtcacgaatccagtctaggtagttggtaaccttggtgtacacacccgggacatccttctgtccacagcccaggccccagctgatgatgcccaccaaagtcatgcggccatcgttcagacacaccagggggcctcccgaatcgccctggcaggcgtcgtgcaagtttgcctggggcccgccgctccgagtgtctccagcacacagcatgttgtcggtgactgttctgttaagtaaatgttgtgatgtgcagcggctggatgggtacagtctgacatgagcctccttcagccgctccgaatagaaaggagacaaggcctcatgcttgccgtagccggagagctcacactccgtccagtccggcagctgcaggtccgccgggggaaggcacacagtgcggaccacgctgctctcctgggcacagcgggacgaatccgatttcagctgcagcagcgcaatgtcattgtcgtaagtgtcatcatcgaattccttatggacaatgtatttttcgacttcaaatttctgctcctcctcgccagggaccacccggtatgttctgcccaagatcaccgtcaggtggtggggcggaaacctctcctggaagcagtgggcggcagagagaatccagcaggagctgatgagtatgcccccgcacaggaaccgctctccgggcgacctcctgtgcttggcaaagatggcagcctgccaggggtgggaggcgatgtcggcgaagagccctcctttgatgcgaaactgaggctggctgtactgtctcaggccgcaggtggagcaggagggcacatcacagtactcccacgtcagcctgcggttcttcagcacgtggcaccagggcttggcatccccatcaggattccggcagtaattatgtttgcccaggcccagtgcctgggcactggggttctgtgctgtgtaaaccttgcctatcaggatcatggaattccacgggaggcaggaggcacccgactcggtgaggctgtgcgtgccacggtaggctgacccattcccaaagtagcagtcactgtttccctcagagcaggcaggggtgctgcagaactctgagctgtacttccccgccttaaagacgtagcaccagggctttgagtctcgatctgggtttctgcagtagttgtggttccccaggcccagcctgatggcgtctggcctccgcccgctgtagggcttctgggccaacgcgctgctgttccagttggtgcactcggcgccactctccgctgtgctccacgtgcccctgtagctgatgccctggtcctcgtagcacgtggccctggtatctatttcacagcacttcccagcaaatccttcggggcactggcacacgaaatctgagaagtacagggcctgctggcaggtgcccccgttgaaacaccttggctcgctgcaacttttgacaggcactgagtggcactgtgccctgccactgttgcaccagcaatattccacccggttgcttctgagcacagggcgcagccatgactgatgttgctggtatatcatctgcgttttttcatctctgcagatcacttggtaagatctggctcctcttctgaatcgggcatggatttcctggctgggcgaaacgaagactgctccacacagcagcagcacacagcagagccctctcttcattgcatccatgattgcttcacagcgtcccttaaattcacggcttgctccttccctttcctcgcagaggttttctctccagccctggctcagaaaggatctcagctctgagctccccacagctccggcctcctttaagtttccaggcagggggtggggtcggtggccccggctgggcgggtttctgtgtggcgggaggatgctcagtggacagggccatcc

SEQ ID NO: 3132 - DNA, 2459 bp, Homo sapiens
ggaaaaactgtgaaaaatatatctgaatttattaagtacagtataaaacagggttgtggcaacagaaagtaaaaactaacatggattgctataaatatgctgaagcctagttgttcaaatgatacaattctctcatgctactctaaagtttataaagaaaaaggatttacactttacacactgtacacaaaaggaataccttctgagagccagggagtggggaaaggggaaggagacttgacgtcaagggtgcttttgaggaacatgacgggccagccagcctgccccaactttgagccctgctgggctcttgtgactataaatatactgtctatttctaatgcaatccgtctttcctgaaagatcttgttatcttttactattgagacatgctttcatttttgtggtcctgtttccaaagctgctcacggtgacaggtcaggaggttgggctttagcgaaaacagggtggcatggccacttctgcccagggaggaggcattcctggagaggctagtgtgcattcatgtcttcccatctgacagagtatcctgaaatcagaccaagtcctgaaaacttccaaaatgggaagtatcagggaaaatgcactcttccctctcctgtagggtctcgtcccgcttctgcggtgtggtgggtctggagaagtctgtagagaagcactgcgcctttgcagtgtcttctgaagaagaagaggcgggatctcatttgcttttgaggagtcgggtgttcctggtcacggtcgcatgttgtcacgaatccagtctaggtagttggtaaccttggtgtacacacccgggacatccttctgtccacagcccaggccccagctgatgatgcccaccaaagtcatgcggccatcgttcagacacaccagggggcctcccgaatcgccctggcaggcgtcgtgcaagtttgcctggggcccgccgctccgagtgtctccagcacacagcatgttgtcggtgactgttctgttaagtaaatgttgtgatgtgcagcggctggatgggtacagtctgacatgagcctccttcagccgctccgaatagaaaggagacaaggcctcatgcttgccgtagccggagagctcacactccgtccagtccggcagctgcaggtcctccgggggaaggcacacagtgcggaccacgctgctctcctgggcacagcgggacgaatccgatttcagctgcagcagcgcaatgtcattgtcgtaagtgtcatcatcgaattccttatggacaatgtatttttcgacttcaaatttctgctcctcctcgccagggaccacccggtatgttctgcccaagatcaccgtcaggtggtggggcggaaacctctcctggaagcagtgggcggcagagagaatccagcaggagctgatgagtatgcccccgcacaggaaccgctctccgggcgacctcctgtgcttggcaaagatggcagcctgccaggggtgggaggcgatgtcggcgaagagccctcctttgatgcgaaactgaggctggctgtactgtctcaggccgcaggtggagcaggagggcacatcacagtactcccacgtcagcctgcggttcttcagcacgtggcaccagggcttggcatccccatcaggattccggcagtaattatgtttgcccaggcccagtgcctgggcactggggttctgtgctgtgtaaaccttgcctatcaggatcatggaattccacgggaggcaggaggcacccgactcggtgaggctgtgcgtgccacggtaggctgacccattcccaaagtagcagtcactgtttccctcagagcaggcaggggtgctgcagaactctgagctgtacttccccgccttaaagacgtagcaccagggctttgagtctcgatctgggtttctgcagtagttgtggttccccaggcccagcctgatggcgtctggcctccgcccactgtagggcttctgggccaacgcgctgctgttccagttggtgcactcggcgccactctccgctgtgctccacgtgcccctgtagctgatgccctggtcctcgtagcacgtggccctggtatctatttcacagcacttcccagcaaatccttcggggcactggcacacgaaatctgagaagtacagggcctgctggcaggtgcccccgttgaaacaccttggctcgctgcaaccttggtaagatctggctcctcttctgaatcgggcatggatttcctggctgggcgaaacgaagactgctccacacagcagcagcacacagcagagccctctcttcattgcatccatgattgcttcacagcgtcccttaaattcacggcttgctccttccctttcctcgcagaggttttctctccagccctggactcctgtaggatctcagctctgagctccccacagctccggcctcctttaagtttccaggcagggggtggggtcggtgg

SEQ ID NO: 3133 - DNA, 2061 bp, Homo sapiens
cgtttttttttttttttttttttggaaaaactgtgaaaaatatatctgaatttattaagtacagtataaaacagggttgtggcaacagaaagtaaaaactaacatggattgctataaatatgctgaagcctagttgttcaaatgatacaattctctcatgctactctaaagtttataaagaaaaaggatttacactttacacactgtacacaaaaggaataccttctgagagccagggagtggggaaaggggaaggagacttgacgtcaagggtgcttttgaggaacatgacgggccagccagcctgccccaactttgaggccctgctgggctcttgtgactataaatatgctgtctatttctaatgcaatccgtctttcctgaaagatcttgttatcttttactattgagacatgctttcatttttgtggtcctgtttccaaagctgctcacggtgacaggtcaggaggttgggctttagctgaaaacagggtggcatggccatttctgcccagggaggaggcattcctggagaggctagtgtgcattcatgtcttcccatctgacagagtgtcctgaaatcagaccaagtcctgaaaacttccaaaatgggaagtatctgggaaaatgcactcttccctctcctgtagggtctcgtcccgcttctgcggtgtggtgggtctggagaagtctgtagagaagcactgcgcctttgcagtgtcttctgaagaagaagaggcgggatctcatttgcttttgaggagtcgggtgttcctggtcacggtcgcatgttgtcacgaatccagtctaggtagttggtaaccttggtgtacacacccgggacatccttctgtccacagcccaggccccagctgatgatgcccaccaaagtcatgcggccatcgttcagacacaccagggggcctcccgaatcgccctggcaggcgtcgtgcaagtttgcctggggcccgccgctccgagtgtctccagcacacagcatgttgtcggtgactgttctgttaagtaaatgttgtgatgtgcagcggctggatgggtacagtctgacatgagcctccttcagccgctccgaatagaaaggggacaaggcctcatgcttgccgtagccggagagctcacactccgtccagtccggcagtaattatgtttgcccaggcccagtgcctgggcactggggttctgtgctgtgtaaaccttgcctatcaggatcatggaattccacgggaggcaggaggcacccgactcggtgaggctgtgcgtgccacggtaggctgacccattcccaaagtagcagtcactgtttccctcagagcaggcaggggtgctgcagaactctgagctgtacttccccgccttaaagacgtagcaccagggctttgagtctcgatctgggtttctgcagtagttgtggttccccaggcccagcctgatggcgtctggcctccgcccgctgtaggcgttctgggccaacgcgctgctgttccagttggtgcactcggcgccactctccgctgtgctccacgtgcccctgtagctgatgccctggtcctcgtagcacgtggccctggtatctatttcacagcacttcccagcaaatccttcggggcactggcacacgaaatctgagaagtacagggcctgctggcaggtgcccccgttgaaacaccttggctcgctgcaacttttgacaggcactgagtggcactgtgccctgccactgttgcaccagcaatattccacccggttgcttctgagcacagggcgcagccatgactgatgttgctggtatatcatctgcgttttttcatctctgcagatcacttggtaagatctggctcctcttctgaatcgggcatggatttcctggctgggcgaaacgaagactgctccacacagcagcagcacacagcagagccctctcttcattgcatccatgattgcttcacagcgtcccttaaattcacggcttgctccttccctttcctcgcagggattttctctccagccctggactcctgtaggatctcagctctgagctccccg

SEQ ID NO: 3134 - DNA, 1536 bp, Homo sapiens
tatttattattttttttttttttatttttttttttttttttttttttttttccttgaatgaaaaccatgaatttaatgtgacattgggggagcctcatccttccctttttaccacccacccatccagcctgttgtgagttgggtgagggctgcccccagtctccgtcctgcggctctgggtgccatcctgttcctttgagctcagtcagcctcctgggctcgtctctctgtgaatctccttcttgcgtattcatatagtgcttgcttgcgctcctgcaggctctcctgccgggcccaggaagacttggcaaatgttagggctgttggctgaggggtcaccgggccagagctgggaaacttggaggcagaggctgtgggtagggactgagttcccttggtgatgtcttcaggcatgaaagctacggccccctcaagcagattagtgatagtcaagtctacacagccagtcttggccaggtctctctggatgacacccaatggcacatggggcaaaacttccttgactctctgagccagagttgccagttgcacatcaggagaaggaccaggggagggagggaaagaagactgggctgactgggggcgcaatctggggtgtctttgtcgcttcatgtgctctgctttgtcagctggagtgagccgtgtccctgtctggcccaattccttggccaccagctgttgtacacggagtgcaaactcctcattcgcttcccctagttggcgatgaacaggacgaagccaccttacttgatacaccgtgaaagggacgaaaagtgaccacagcagttctgagacccaggaggcatctgacaccgtcacagagaccaggggtctctgaacttgcagggtaagaggttgtaccacatcttggatagaaaatggccaggaactgaagcgcaggagcccctcccggccattggtggcctcttcctcagggaatagcagcagaggagtggggggaagcctcgtggaagcacagaatctcttgagtgactccaccaactccccccgcccattcatctccatgaagccccgagaccagcacacaaagctggggggactattgagtagaggggtgctacaggtggtaagcaaattgactatgttgtggtcgaaaggtgtcacatggttggaaatgaggaccctgacactgtgatcccggagtccggagtcctcctgccgggccacgagccctagcaccgcacacatggtccgcactacgaatctgcgaaggacgctgtctggcagcgcgcagctgaccaggaagacgtggatcccgagaaagaggcgcaggacgaggaggcagaacccgactggcgcgtagagcagcagcacgagcagtaggaagcagtcacccggaagccggtgcgagtcaaagagccgctccggccccggccctgagggaagctccataactgctgcttcaggagcgcccggccgtcgccgccgccgccattttcgcgcccggccgcaggggctcttcggggggggggggggattaatttaattaaggat

SEQ ID NO: 3135 - DNA, 1664 bp, Homo sapiens
tttttttttttttttttttgaatgaaaaccatgaatttaatgtgacattgggggagcctcatccttccctttttaccacccacccatccagcctgttgtgagttgggtgagggctgcccccagtctccgtcctgcggctctgggtgccatcctgttcctttgagctcagtcagcctcctgggctcgtctctctgtgaatctccttcttgcgtattcatatagtgcttgcttgcgctcctgcaggctctcctgccgggcccaggaagacttggcaaatgttagggctgttggctgaggggtcaccgggccagagctgggaaacttggaggcagaggctgtgggtagggactgagttcccttggtgatgtcttcaggcatgaaagctacggccccctcaagcagattagtgatagtcaagtctacacagccagtcttggccaggtctctctggatgacacccaatggcacatggggcaaaacttccttgactctctgagccagagttgccagttgcacatcaggagaaggaccaggggagggagggaaagaagactgggctgactgggggcgcaatctggggtgtctttgtcgcttcatgtgctctgctttgtcagctggagtgagccgtgtccctgtctggcccaattccttggccaccagctgttgtacacggagtgcaaactcctcattcgcttcccctagttggcgatgaacaggacgaagccaccttacttgatacaccgtgaaagggacgaaaagtgaccacagcagttctgagacccaggaggcatctgacaccgtcacagagaccaggggtctctgaacttgcagggtaagaggttgtaccacatcttggatagaaaatggccaggaactgaagcgcaggagcccctcccggccattggtggcctcttcctcagggaatagcagcagaggagtggggggaagcctcgtggaagcacagaatctcttgagtgactccaccaactccccccgcccattcatctccatgaagccccgagaccagcacacaaagctggggggactattgagtagaggctgggaaccaggagaagagaaagcaagaagaaaaatattgaggaaaatgaaaaaaaaaaactgacatgttgggtagaggatcggggttaggggtaaggcctcagtatcctccatgcggaacgcgagtggggacaggggggccttcagctgggccccagggaaccgccccgtggcgctctcggcctcgctctcactcacggtgctacaggtggtaagcaaattgactatgttgtggtcgaaaggtgtcacatggttggaaatgaggaccctgacactgtgatcccggagtccggagtcctcctgccgggccacgagccctagcaccgcacacatggtccgcactacgaatctgcgaaggacgctgtctggcagcgcgcagctgaccaggaagacgtggatcccgagaaagaggcgcaggacgaggaggcagaacccgactggcgcgtagagcagcagcacgagcagtaggaagcagtcacccggaagccggtgcgagtcaaagagccgctccggccccggccctgagggaagctccataactgctgcttcaggagcgcccggccgtcgccgccgccgccattttcgcgcccaggcgcaggggctct

SEQ ID NO: 3136 - DNA, 1506 bp, Homo sapiens
aagaagaagaggcgggatctcatttgcttttgaggagtcgggtgttcctggtcacggtcgcatgttgtcacgaatccagtctaggtagttggtaaccttggtgtacacacccgggacatccttctgtccacagcccaggccccagctgatgatgcccaccaaagtcatgcggccatcgttcagacacaccagggggcctcccgaatcgccctggcaggcgtcgtgcaagtttgcctggggcccgccgctccgagtgtctccagcacacagcatgttgtcggtgactgttctgttaagtaaatgttgtgatgtgcagcggctggatgggtacagtctgacatgagcctccttcagccgctccgaatagaaaggagacaaggcctcatgcttgccgtagccggagagctcacactccgtccagtccggcagctgcaggtccgccgggggaaggcacacagtgcggaccacgctgctctcctgggcacagcgggacgaatccgatttcagctgcagcagcgcaatgtcattgtcgtaagtgtcatcatcgaattccttatggacaatgtatttttcgacttcaaatttctgctcctcctcgccagggaccacccggtatgttctgcccaagatcaccgtcaggtggtggggcggaaacctctcctggaagcagtgggcggcagagagaatccagcaggagctgatgagtatgcccccgcacaggaaccgctctccgggcgacctcctgtgcttggcaaagatggcagcctgccaggggtgggaggcgatgtcggcgaagagccctcctttgatgcgaaactgaggctggctgtactgtctcaggccgcaggtggagcaggagggcacatcacagtactcccacgtcagcctgcggttcttcagcacgtggcaccagggcttggcatccccatcaggattccggcagtaattatgtttgcccaggcccagtgcctgggcactggggttctgtgctgtgtaaaccttgcctatcaggatcatggaattccacgggaggcaggaggcacccgactcggtgaggctgtgcgtgccacggtaggctgacccattcccaaagtagcagtcactgtttccctcagagcaggcaggggtgctgcagaactctgagctgtacttccccgccttaaagacgtagcaccagggctttgagtctcgatctgggtttctgcagtagttgtggttccccaggcccagcctgatggcatctggcctccgcccgctgtagggcttctgggccaacgcgctgctgttccagttggtgcactcggcgccactctccgctgtgctccacgtgcccctgtagctgatgccctggtcctcgtagcacgtggccctggtatcttggtaagatctggctcctcttctgaatcgggcatggatttcctggctgggcgaaacgaagactgctccacacagcagcagcacacagcagagccctctcttcattgcatccatgattgcttcacagcg

SEQ ID NO: 3137 - DNA, 837 bp, Homo sapiens
tgaaaaccatgaatttaatgtgacattgggggagcctcatccttccctttttaccacccacccatccagcctgttgtgagttgggtgagggctgcccccagtctccgtcctgcggctctgggtgccatcctgttcctttgagctcagtcagcctcctgggctcgtctctctgtgaatctccttcttgcgtattcatatagtgcttgcttgcgctcctgcaggctctcctgccgggcccaggaagacttggcaaatgttagggctgttggctgaggggtcaccgggccagagctgggaaacttggaggcagaggctgtgggtagggactgagttcccttggtgatgtcttcaggcatgaaagctacggccccctcaagcagattagtgatagtcaagtctacacagccagtcttggccaggtctctctggatgacacccaatggcacatggggcaaaacttccttgactctctgagccagagttgccagttgcacatcaggagaaggaccaggggagggagggaaagaagactgggctgactgggggcgcaatcttgcgtgtctttgtcgcttcatgtgctctgctttgtcagctggagtgagccgtgtccctgtctggcccaattccttggccaccagctagggagaattggaagactggaagtgtcaagatctcaaagcttcctccctcttctcctaagcagggaccccgccttcaccctgtctgtgcacccgaccacctgtggtacacggagtgcaaactcctcattcgctttccctaggttgcgatgaaccagacgaagccaccttacttgatacaccgtgaaagggacgaaaa

SEQ ID NO: 3138 - DNA, 757 bp, Homo sapiens
tcccttggttaaagcattccttcactggctcagcttgctggaaagacttttaagagaaagaagaggagacagaccccaaggtacagaaacccgacctaccacggcttgctccttccctttcctcgcagaggttttctctccagccctggactcctgtaggatctcagctctgagctccccacagctccggcctcctttaagtttccaggcagggggtggggtcggtggccccggctgggcgggtttctgtgtggcgggaggatgctcagtggacagggccatgagggagctgaggcaggcctgtttttataaagcagggggaggaagttcacggtggaagcagcacagcccaccctggcttcgggccaggctgattattcacaaccgtagtgtcattgaatcgcagaaatttggaagtgggatgggaccttaagaatcatcttcctttagagtcctagtgtcccaggcttaaaagggactttcaggaccctgtgatgacaagaagtgtttataattctaaaggcagcaggttggggctgggagtggggtgtcttctggaatctgtggctgtagctctggcctctcaggacatgagaggttaaaaggactggaggatgcacaaggattggaacactttgtgtggtggcgggagctcaggggggtagccactgagaaggcaggaccagccttgggctcacctgcggtaggaggtgcccccatgggggtttgctccggtaggcatctttggcatgaattc

SEQ ID NO: 3139 - DNA, 1089 bp, Homo sapiens
ttttttttttttttttcattgaatgaaaaccatgaatttaatgtgacattgggggagcctcatccttccctttttaccacccacccatccagcctgttgtgagttgggtgagggctgcccccagtctccgtcctgcggctctgggtgccatcctgttcctttgagctcagtcagcctcctgggctcgtctctctgtgaatctccttcttgcgtattcatatagtgcttgcttgcgctcctgcaggctctcctgccgggcccaggaagacttggcaaatgttagggctgttggctgaggggtcaccgggccagagctgggaaactgaggtgatcacaatgtcagagggcttgcggagtcatcatcattaaacacgcatcgaatgccttggaggcagaggctgtgggtagggactgagttcccttggtgatgtcttcaggcatgaaagctacggccccctcaagcagattagtgatagtcaagtctacacagccagtcttggccaggtctctctggatgacacccaatggcacatggggcaaaatctttcttgactctctgagccagagttgccagttgcacatcatgagaaggaccattggagggagggaaagaatacttggctgacttggggcgcaatctggggtgtctttgtccgctcaatgtctctgctttgccagctggactgaaccgtgtccctgcctggcccaattccttggccaccagctgttgtacacggagtgcaaactcctcattcgcttcccctagttggcgatgaacaggacgaagccacctgcaaagaaacaatccagggctatgttgtgggcacccagggtagcagtgtcgccattccccactttggtacctctttgcatggtgggtgggaaaatagtaaatactgtaaatactttgtgttgcctctgtggtagaaccttgatatacagatctacaaatggacagggcagaggccactaattccttgaccttgaggtgagcctctccccagcgaccaaaatgtgaggacagttaataccttacttgatacaccgcgaaaggtcgaccggccgctaatttagtagtagtaggcggca

SEQ ID NO: 3140 - DNA, 1164 bp, Homo sapiens
  misc_feature (1)...(1164): n = A,T,C or G
tcacggtcgcatgttgtcacgaatccagtctaggtagttggtaaccttggtgtacacacccgggacatccttctgtccacagcccaggccccagctgatgatgcccaccaaagtcatgcggccatcgttcagacacaccagggggcctcccgaatcgccctggcaggcgtcgtgcaagtttgcctggggcccgccgctccgagtgtctccagcacacagcatgttgtcggtgactgttctgttaagtaaatgttgtgatgtgcagcggctggatgggtacagtctgacatgagcctccttcagccgctccgaatagaaaggagacaaggcctcatgcttgccgtagccggagagctcacactccgtccagtccggcagctgcaggtccgccgggggaaggcacacagtgcggaccacgctgctctcctgggcacagcgggacgaatccgatttcagctgcagcagcgcaatgtcattgtcgtaagtgtcatcatcgaattccttatggacaatgtatttttcgacttcaaatttctgctcctcctcgccagggaccacccggtatgttctgcccaagatcaccgtcaggtggtggggcggaaacctctcctggaagcagtgggcggcagagagaatccagcaggagctgatgagtatgcccccgcacaggaaccgctctccgggcgacctcctgtgcttggcaaagatggcagcctgccaggggtgggaggcgatgtcggcgaagagccctcctttgatgcgaaactgaggctggctgtactgtctcaggccgcaggtggatatttcacagnacttcccagcaaatccttcggggcactggcacacgaaatctgagaagtacagggcctgctggcaggtgcccccgttgaaacaccttggctcgctgcaacttttgacaggcactgagtggcactgtgccctgccactgttgcaccagcaatattccacccggttgcttctgagcacagggcgcagccatgactgatgttgctggtatatcatctgcgttttttcatctctgcagatcacttggtaagatctggctcctcttctgaatcgggcatggatttcctggctgggcgaaacgaagactgctccacacagcagcagcacacagcagagccctctcttcattgcatccat

SEQ ID NO: 3141 - DNA, 733 bp, Homo sapiens
  misc_feature (1)...(733): n = A,T,C or G
ggaaaaactgtgaaaaatatatctgaatttattaagtacagtataaaacagggttgtggcaacagaaagtaaaaactaacatggattgctataaatatgctgaagcctagttgttcaaatgatacaattctctcatgctactctaaagtttataaagaaaaaggatttacactttacacactgtacacaaaaggaataccttctgagagccagggagtggggaaaggggaaggagacttgacgtcaagggtgcttttgaggaacatgacgggccagccagcctgccccaactttgaggccctgctgggctcttgtgactataaatatactgtctatttctaatgcaatccgtctttcctgaaagatcttgttatcttttactattgagacatgctttcatttttgtggtcctgtttccaaagctgctcacggtgacaggtcaggacgttgggctttagctgaaaacagggtggcatggccactttctgcccagggagaggcattcctggagagctagtgtgcattcatgtcttcccatctgacagagtatcctgaaacagacccagtcctgaaaacttccaaaatggaggatctgggaaaaggcactcttccctttcctggagggctcggcccctttttggcgggggggggggtgggaaaaattgttnagaaacccttgccctttggcggcttttgagaaaaaaaagcgcgaactctaatgcctttggagaag

SEQ ID NO: 3142 - DNA, 709 bp, Homo sapiens
  misc_feature (1)...(709): n = A,T,C or G
ggaaaaactgtgaaaaatatatctgaatttattaagtacagtataaaacagggttgtggcaacagaaagtaaaaactaacatggattgctataaatatgctgaagcctagttgttcaaatgatacaattctctcatgctactctaaagtttataaagaaaaaggatttacactacacactgtacacaaaaggaataccttctgagagccagggagtggggaaaggggaaggagacttgacgtcaagggtgcttttgaggaacatgacgggccagccagcctgccccaactttgaggccctgctgggctcttgtgactataaatatactgtctatttctaatgcaatccgtctttcctgaaagatcttgttatcttttactattgagacatgctttcatttttgtggtcctgtttccaaagctgctcacggtgacaggtcaggaggttgggctttagctgaaaacagggtggcatggccactttctgcccagggaggaggcattcctggagaggctagtgtgcattcatgtcttcccatctgacagagtatcctgaaatcagaccaagtcctgaaaacttcannaanggaagtattctggaaaatgcactcttccctctcctgttaggtctcgtcccgcttctgccgtgtggcgcttttgagagtctgtanaaagcacttgcccttgagttgtctctgagaagaagaggc

SEQ ID NO: 3143 - DNA, 503 bp, Homo sapiens
ttttgcctttaattgaaacctgtgatttaaatgtgactttggggagcctcaacctttcccttttaacaaccaacccatcaagcctgttgtaatttggttaagggctgccccaagtctccgtcctgcggctctgggtgcaatcctgttcctttgagctcagtaagcctcctgggctcgtctctctgtgaatctccttcttgcgtattcatatagtgcttgcttgcgctcctgcaggctctcctgccgggaaacttggaggcagaggctgtgggtagggactgagttcccttggtgatgtcttcaggcatgaaagctacggccccctcaagcagattagtgatagtcaagtctacacagccagtcttggccaggtctctctggatgacacccaatggcacatggggcaaaacttccttgactctctgagccagagttgccagttgcacatcaggagaaggaccaggggagggagggaaagaagactgggctgactgggggcgcaa

SEQ ID NO: 3144 - DNA, 562 bp, Homo sapiens
  misc_feature (1)...(562): n = A,T,C or G
ttgaaaaccatgaatttaatgtgacattgggggagcctcatccttccctttttaccacccacccatccagcctgttgtgagttgggtgagggctgcccccagtctccgtcctgcggctctgggtgccatcctgttcctttgagctcagtcagcctcctgggctcgtctctctgtgaatctccttcttgcgtattcatatagtgcttgcttgcgctcctgcaggctctcctgccgggcccaggaagacttggcaaatgttagggctgttggctgaggggtcaccgggccagagctgggaaacttggaggcagaggctgtgggtagggactgagttcccttggtgatgtcttcaggcatgaaagctacggccccctcaagcagattagtgatagtcaagtctacacagccagtcttggctggggagaaaagagaaaggagtccactccctacttactntcttcctcacaacccacttttncctcctgtgcccatnctccagtgtggggccaccctttcccataccccagtctctctggatgacacccaatggcacatggngcaa

SEQ ID NO: 3145 - DNA, 854 bp, Homo sapiens
gaatgaaaaccatgaatttaatgtgacattgggggagcctcatccttccctttttaccacccacccatccagcctgttgtgagttgggtgagggctgcccccagtctccgtcctgcggctctgggtgccatcctgttcctttgagctcagtcagcctcctgggctcgtctctctgtgaatctcctttcttgccttaattcaataataagtcgccttgcgttgcgcttcctgcaggcctctcctgccgggccccaaggaaggacttggcaaaatgttagggcttgttggctgaaggggtcaccgggccaggaacttgggaaactgagggtgaatcacaatgtcaggaggggcttgcggagtcattcatcattaaacacgcatcgaatgcctactttgcaagagaggcactatgctaagggtctcaggatcaaaaaagaaaggtcagggataagggagtacatagcctgcccccaactcaccccaacacttggatctgaccatttcctgggtctcaccttggaggcagaggctgtgggtagggactgagttcccttggtgatgtcttcaggcatgaaagctacggccccctcaagcagattagtgatagtcaagtctacacagccagtcttggctggggagaaaagagaagggagtccaaccccctacttactttcttccttcacaacccacttttcctccctgtgcccatctcccagtgtggggccaccctttcccatacccaggtctctctggatgacacccaatggcacatggggcaaaacttccttgactctctgagccagagttgccagttgcacatcaggagaaggaccaggggagggagggaaagaaga

SEQ ID NO: 3146 - DNA, 514 bp, Homo sapiens
  misc_feature (1)...(514): n = A,T,C or G
tncgttttagnncctnataaggcccctgaaacacctttatatatcagnctgtggtnagtcgggnncccnctgnnancagtctccgtcctgnggntctgggtgccatcctgttcctttgagctcagtcagcctcctgggctcgtctctctgtgaatctcctnctngcgtattcatatagtgcttggtngcgctcctgnaggctctcctgccgggcccaggaagacttggcaaatnttagngttgttggctgaggggtcaccgggccagagctgggaaactgaggtgatcacaatgtcagaggggttgcggagtcatcatcattaaacacgcatcgaatgccttggaggcagaggctgtgggtagggactgagttcccttggtgatgtcttcaggcatgaaagctacggcccctcaagcagattagtgatagtcaagtctacacagccagtctnggccaggtctctctggatgacanccaatggcacatgggggaaacttcccttggattctctgg

SEQ ID NO: 3147 - DNA, 499 bp, Homo sapiens
  misc_feature (1)...(499): n = A,T,C or G
atctctttgagtgacttcaaccaacttccccccgcccattcatctccatgaanccccgagaccagcaacacaaaagcttggggggactattgattagaagggttgcttacaaggtggtaaaccaaattgactatgttgtggtcgaaaggtgtcacattggttggaaatganggacccttgacacttgtgattcccggagtccggagtccttcttgncggccacgagcccttagcaccgcacacatggtccgcactacgaatctgcgaaggacgctgtctggcagcgcgcagctgaccaggaagacgtggatcccgagaaagaggcgcaggacgaggaggcagaacccgactggcgcgtagagcagcagcacgagcagtaggaagcagtcacccggaagccggtgcgagtcaaagaccgcttccgccccggccctgagggaagctccataactgctgcttcaggagcgnncngccgtcgccgccgccgcccctcgtgccg

SEQ ID NO: 3148 - DNA, 450 bp, Homo sapiens
  misc_feature (1)...(450): n = A,T,C or G
ttttttttttgccttgaatgaaaaccatgaatttaatgtgacattgggggagcctcatccttccctttttaccacccacccatccagcctgttgtgagttgggtgagggctgagttcccttggtgatgtcttcaggcatgaaagctacggccccctcaagcagattagtgatagtcaagtctacacagccagtcttggccaggtctctctggatgacacccaatggcacatggggcaaaacttccttgactctctgagccagagttgccagttgcacatcaggagaaggaccaggggagggagggaaagaagactgggctgactgggggcgcaatctggggtgtctttgtcgcttcatgtgctctgctttgtcagctggagtgagcccgtgtcccctgtctggcccaattccttggcaccagctgntgtacacnggagtgcaaactcctc

SEQ ID NO: 3149 - DNA, 480 bp, Homo sapiens
  misc_feature (1)...(480): n = A,T,C or G
ccaccaantcccccngcccattcatctccatgaanccccgagaccagcacacaaagttgggggacttattgagtagagggttntacaggtggtaagcaaattgactatgttgtngtcagaaaggtgtcacatggttgaaatgagaccctgacactgtgatcccggagtccggagtcctcttgccggccacgagccctagnaccgcacacatggtccgcactacgnatctgngaaggacgctgtctggcatngcgcagctgaccagaagacgtgatcccgagnaagaggcgcaggacgaggaggcagaacccgactggcgcgtagagcagcagcacgagcagtaggaagcagtcaccnggaagccggtgcgagtcaaatgatccgctccgccccggcctgaggaagctccataactgctgcttcaggaaccgcncngccgtcgccgccgccgccattttcgcgcccaggcgcaggggctct

SEQ ID NO: 3150 - DNA, 376 bp, Homo sapiens
ttttttgaatgaaaaccatgaatttaatgtgacattgggggagcctcatccttccctttttaccacccacccatccagcctgttgtgagttgggtgagggctgcccccagtctccgtcctgcggctctggcacatggggcaaaacttccttgactctctgagccagagttgccagttgcacatcaggagaaggaccaggggagggagggaaagaagactgggctgactgggggcgcaatctggggtgtctttgtcgcttcatgtgctctgctttgtcagctggagtgagccgtgtccctgtctgggaaacttggaggcagaggctgtgggtagggactgagttcccttggtgatgtcttcaggcatgaaagctacg

SEQ ID NO: 3151 - DNA, 476 bp, Homo sapiens
gaatgaaaaccatgaatttaatgtgacattgggggagcctcatccttcactttttaccacccacccatccagcctgttgtgagttgggtgagggctgcccccagtctccgtcctgcggctctgagccagagttgccagttgcacatcaggagaaggaccaggggagggagggaaagaagactgggctgactgggggcgcaatctggggtgtctttgtcgcttcatgtgctctgctttgtcagctagagtgagccgtgtcactgtctggcccaattccttggccaccagctgttgtaaaaggagtgaaaaatctcattcggcttcccctagttggcggatgaacaaggacggaagccacccttacttgatacaccgtgaaagggacgaaaagtgaccacagcagttctgagacccaggaggcatctgacaccgtcgacagagaccaggggtctctgaacttgcagggtaagaggttg

SEQ ID NO: 3152 - DNA, 589 bp, Homo sapiens
  misc_feature (1)...(589): n = A,T,C or G
attgaaattgaanccttnttcccctggtcntgacccnaaattcccttggncaaccnatctgnttgtaacacggagtncaaaactcnctcattcgcttccacctagttgncgatgaaaaggacgnaagccaccccagactgggctgactgggggcgcaatctggggtgtctttgtcgcttcatgtgctctgctttgtcagctggagtgagccgtgtccctgtctggccnaattccttggccaccagctgttgtacacggagtgcaaactcctcattcgcttcccctagttggcgatgaacaggacgaagccaccttacttgatacaccgtgaaagggacgaaaagtgaccacagcagttctgagacccaggaggcatctgacaccgtacacagagaccaggggtctctgaacttgcagggtaagaggttgtaccacatcttggatagaaaatggccaggaactagaagaggaaggagaaagtaggatgggaatccagccagcctagtcagnngctcanacctgccttataacnggcaactgtcaaactctacaagcacataattgaagaatgaagggattcagctgtgcc

SEQ ID NO: 3153 - DNA, 492 bp, Homo sapiens
  misc_feature (1)...(492): n = A,T,C or G
ggcttggaaaaggaaaaagaaaaagaattctggtaagtagagactagaggagaggctaactanacagaataggggagaatcacagtagccgaaaaaaaaaaccccaaaagctgtaatgtatagagaccacatacctgactgggggcgcaatctggggtgtctttgtcgcttcatgtntctgctttgtcagctggagtgagccgtgtccctgtctggcccaattccttggccaccagctagggagaattggaagactggaagtgtcaagatctcaagctttcctccctctcctcctaagcagggaccccgcctccaccctgtctgtgcacccgaccacctgttgtacacggagtgcaaactcctcattcgcttcccctagttggcgatgaacaggacgaagccacctgcaaagaaacaatccagggctatgttgtgggcacccagggtagaggctgtcaccattccccactttggtacctctttgcatggtgg

SEQ ID NO: 3154 - DNA, 433 bp, Homo sapiens
  misc_feature (1)...(433): n = A,T,C or G
tattgagacatgctttcatttttgtggtcctgtttccaaagctgctcacggtgacaggtcaggaggttgggctttatgttgtggtcggaaaggtgtcacatggttggaaattgaggacccttgacacttgtgatcccggagtccggagtccntcttgccggccacgagccctagcaccgcacacatggtccgcactacgaatctgcgaaggacgctgtctggcagcgcgcagctgaccaggaagacgtggatcccgagaaagaggcgcaggacgaggaggcagaacccgactggcgcgtagagcagcagcacgagcagtaggaagcagtcacccggaagccggtgcgagtcaaagaccgctccgccccggccctgagggaagctccataactgctgcttcaggnagagcgcnccgtcgccgccgccgnnattt

SEQ ID NO: 3155 - DNA, 220 bp, Homo sapiens
ggggcgggacacagggatcctgcacaccaacctggctgggcgaaacgaagactgctccacacagcagcagcacacagcagagccctctcttcattgcatccatgattgcttcacagcgtcccttaaattctggaaggagagaaaaaacagcttgatcacggggtgcgagaggtccatgatggcaacagaggaggataagccgcaatgttgtcctgtctgg

SEQ ID NO: 3156 - DNA, 216 bp, Homo sapiens
  misc_feature (1)...(216): n = A,T,C or G
caacncccangaaaacccccaaaaccaacaacaacaaaactggggggaactaatnaataaaagggtgccaacaggtggtaagcaaatgaactatgttgtggtcgaaaggtgtcacatggttggaaatgaggaccctgacactgtgaatcccggagtccggagtcctcctgncggccacgagccctagcaccgcacacatggtccgcactacgaatc

SEQ ID NO: 3157 - DNA, 209 bp, Homo sapiens
  misc_feature (1)...(209): n = A,T,C or G
actatgttgtggtcgaaaggtgtcacatggttggaaatgaggancctgacactgtgatcccggagtccggagtcctcctgccgggccacgagccctagcaccgcanacatggtccgcactacgaatctgcganaggangctgtctggcagcgcgcagctgaccaggaanacgtggatcccgaaaaanaggcgcaggacgaggangcaga

SEQ ID NO: 3158 - DNA, 156 bp, Homo sapiens
  misc_feature (1)...(156): n = A,T,C or G
tgtctccagcacacagcatgttgtcggtgactgttctgttaagtaaatgttgtgatgtgcagcggctggatgggtacagtctgacatgagcctccttcagccgctccgaatanaaaggggacaaggcctcatgcttgccgtagccggagagctcac

SEQ ID NO: 3159 - DNA, 12 bp, Homo sapiens
gggagggagaaa

SEQ ID NO: 3160 - DNA, 590 bp, Homo sapiens
ttttctttctttcttttctttctttctttctttctctctttctttctttctttccttttttcttttttttctttcttttctttctttctctctctttctttcctctttctttctttccttccttccatctttccttctttctctctttctctctctttttctctttcttccttgaaagctgttgatagaaagacgtaataatgacagagagacagattcttgtcatttgatgattctggcctgcatgtctctctaggaggcatcgttacaataaagtcaagttacaatgtgagtgacatactctaaagttggcaaaaggtacatagacagagtttgaaaacacagaagaaagaaggaaaaccaatagaatttcaggttcctgaagaagaaggaggggctagaattcagaatgtaggagttaagatattggagaagtgaaaatacaggaaatagttactattctcttgtaactagtgaaaatataggtatagattcaagttcatttgcaggtttggagataagaacatatgagaaatgtggtctgatcaacttcattttctatgtaagtctctactataagtgaggaggac

SEQ ID NO: 3161 - DNA, 573 bp, Homo sapiens
tttgagatggctttttcgctcttgttgcccaggctggagtgcaggggcgcaatctaggctcactgcaacctccacctcctgggttcaactgattattctgcctcagcctcccaagtagctgggattacaggcatgtgccaccacacccagctaactttttgtatttggtagagacagggtttcaccaagttagtccggctggtctttaacacctgacctcaggtgatccacccacctcggcatcccaaagtgctgggattacaggcatgagccactgcacccagccctattcaattttttagaagaactcccaacaggttaagacagtgactttgttgtagaaaatacaatgaagagagaatccaggtaagaatttagaggataagagtattaaattttgcttatattatctaagcttttaagttctactctatttctttattttgaatgacaaacttcaattcctaatttttatagacgactcaaagcaactctataaaaggaaaaagatatagaaagaagtcaaaagactaagatgtaattaacatatattgctgtcacaattctcagaca

SEQ ID NO: 3162 - DNA, 872 bp, Homo sapiens
  misc_feature (1)...(872): n = A,T,C or G
aaatataaacatgagtataatgtgtcaccaagaaagtagagcaaaacaatgaatgaaagaattatagaacagctggcatcggtatatgactgggggagagagggaatgtcactttagactccgaatttataacctggaatgaaatacatttggatacaaaatttaaatacaaagttttaaaaaaaactacggaagagggtaactattagacatgatttttggtttaaaatatgaggaaggtgacaggggctttaatttttattatttattagtatgaattccctgatgacgaatgagatccgagccactactaaaagccttcccacattccttacagttatagggcttttcaccagtgtgaattctcagatgtcgagtaaggtttgagcatttattaaaggcctttccacattcattacattcatatggtttttcatctgtatgaattctctgatgctggaaaaggttgtgagttctgagtaaaggccttcccacattcaagacattcaaagggtttctcaccagcgtgaattctctgatgttgaccaagctgtgagctctgagtaaaagcctttccacattccttacaatcatagggtttctcaccagtgtgaattctctgatgattagtaagtgctgagccactactaaaggctttgcacattccttgcactcatagggtttctcaccagtatgaattctctgatgttgaacaagctttgagctctgggtaaaggctttgcaacattccttacattcatagggtttctcacctgtatgaattcgtgcatgctgaaaaagttgtgagctcttagtagaggcttccacatacttacattcataaggttttcacagtgtgantcgctgatggt

SEQ ID NO: 3163 - DNA, 728 bp, Homo sapiens
aataaaatatttattttgctttttctctgctcaaggggatcattggcatcccctctctcttttgttttttcctcaagaatgacacagaaaggggaaaaaggaaaaaatatttaatggaatggaaggtggtcaatgtgtctacctaaacgagtcagagcatcgtcaccataaggggaaatgtacaattaggacagcattggtccaatattagaaaaaagtaatggggacatgtttactattgtattgcttaccaatcacacagcaggtgtgtgtgtgtgtgtgtatatatatacacacacacacaccatattatattatacacacacatacacacatatatatacacacacacacacaacttggcacatttaaaaaccatcttttctcttataagaacatctaaaacatatatgcatatgtatgtctgaaaagacaacaaagctttttaaattttatttttaaagagacagtatagtctgttaacttctggtcaagagagtaggaaggaaggagacaccctggatatacctcctgatgtcattcaggagggtgagggaagatgggctaggggtgaacgaggaatatactggcctctttaagaaagggaccattgaaaactgtacaattaagaaaacaagagtagtgttttcaattgataatctatactcacaacaaatactctgataggtgaatactgctgaacatgtttatgtagtgacttttgttgc

SEQ ID NO: 3164 - DNA, 395 bp, Homo sapiens
tttctttctttctttctttctttctttctttctttctttctttctttctttctttctttctgtctttctttctttctttcccatctcatcttcccctttgatgcctcctgtaaatggaattcaatagaaggcatcactatcatttaattcctcattacaagtcagttcttctctgtttggtacgggttgatacttgtttagagccatcagtggagtggaggtggttctgttaacgatggattctgtgattgattggatgtttctgatgaagaggccaaattttaagatgtcttggactcccaagtgccagttccttcctgggtgttaagccactgtgttaatcctctgcggaggcctgctacctgcttctctggtgagggattccaccggggcaa

SEQ ID NO: 3165 - DNA, 379 bp, Homo sapiens
ttttttctttctttctctttctttctttctttctttctttctttctttctttctttctttctttctttctttctttctttctttctttctgtctttctttctttctttcccatctcatcttcccctttgatgcctcctgtaaatggaattcaatagaaggcatcactatcatttaattcctcattacaagtcagttcttctctgtttggtacgggttgatacttgtttagagccatcagtggagtggaggtggttctgttaacgatggattctgtgattgattggatgtttctgatgaggaggcctaagaggcaagggaacattaagcaaccttttaatatagccaacactacccctaatgttttaaaaccaccaaagg

SEQ ID NO: 3166 - DNA, 1767 bp, Homo sapiens
  misc_feature (1)...(1767): n = A,T,C or G
ttttatgctttttgttcttgattttattttacataattgcatgtataaactttctgatggattgatttttcctttctgtcccgattatctagcctctgatgtgctcaagagctggatctgctgacttatcaaaaaagtgacatttggccaggcacggtggctcagcctcacctaatggtttcttagcaaacttcagtagaatgtttagaacgcggccctgataaacttgagtgctggtaggaggtgctacctcgctcaatctgtgagcaaccagccctgtgccctggatgcttggcgggtggagagaaagacagtgttatgtgggcaagcctccaactcaccagttgcagtagagcatctggctctctgtctgctgctatagccctgtgagtcagccagacgtgtggtccccaagccagcttcccacctagcacccttgttctgctacagctcccccacctgccctcctgcattgcctaggatcccacgccccgctttcagtctgctctgggacatctgtcttcttctttgcaggggactaagtatatgacttaatgaatcctaaaaggaaaaaaagatgtcaggaaaaaaaagtgcacacatggaaatgttgcaacatctcatccttagcaactttgtttggttagtactgcataactcacagcagattccaaggcacctgccttgaacattgctacatgctctaggcattatcaggaacgcagccagggtgcctgcaaagttgtctccagtttctgggtaagaggaccatcatccatattgtctgtggctttgtgtctgagttgggctactgagcctgtgacttcagaccccttgtctgcctgatggatacattctgtataatacgttaccatcacaatttcatgaatgtaactaatgaagatctagcccttccatgcctcctgctgaactatgtcacctgtgataataaaacctctacacatagcattttatacaaagcaagtcaaacagcaatgatagtggcaagtgatgtatttggcttaaagaagcttgtgttactgaagttaacgcagaagtctggcctccgtttgtgggattattaaatatatatcctacgggatcagagtcatctattagaaacagtgatagccctgggtataaataaacatttctttagagtttggcgtcagtttttcaatgtccatcctcaaatcagacagtctgtttgaggggtcagttttcagggtgcatctgcaccgagaggcttgaggcagcaatgacccctgggctgcagttcggttgcaggcgctggtggcgggcagtccaggttggagggtggagatgggccaaggtcacagatgctgcagggcttcctgtccttgctctgtgtaaccgtcatcgcggtgggtgtttgcccactgtccaaaggactcctggatgtgcacgtttctctgtgtgttggccaggcgcttcttatctcgggagaagaagctaaacagtcgcttgatgcccgactccggctggggggacgtcctcgggtgggcgatgggtgggggttggggtattcggttttcctcttccatttcttcactcttatagtaagccaagctcctcctgcagcaagaacaccttggacttgagctcgttcctctcgtgcagcacgtcccgcagctcctgcagggtgaaccgggggcggttggggtccttgagatccatggccaccttctctgcngtcggagatgctctcctctccnaccggctccgtctcaggctcctcctccnnat

SEQ ID NO: 3167 - DNA, 518 bp, Homo sapiens
tgtagtggcaagtgatgtatttggcttaaagaagcttgtgttactgaagttaacgcagaagtctggcctccgtttgtgggattattaaatatatatcctacgggatcagagtcatctattagaaacagtgatagccctgggtataaataaacatttctttagagtttggcgtcagtttttcaatgtccatcctcaaatcagacagtctgtttgaggggtcagttttcagggtgcatctgcaccgagaggcttgaggcagcaatgacccctgggctgcagttcggttgcaggcgctggtggcgggcagtccaggttggagggtggagatgggccaaggtcacagatgctgcagggcttcctgtccttgctctgtgtaaccgtcatcgcgggggggggttgggcacttgtccaaagggacccggggatgcgcacgttccttctgtgtgtgggccaggcgcttcttatctcgcaggctgcccatctcctgctccttggtctgcaggtctgcctccagctcc

SEQ ID NO: 3168 - DNA, 371 bp, Homo sapiens
  misc_feature (1)...(371): n = A,T,C or G
tgggctgcagttcggttgcagccgctgttgncgggcagtccaggttgnaggttggagatgggccaaggtcacagatgctgcagggcttcctgtccttgctctgtgtaaccgtcatcgcggtgggtgtttgcccactgtccaaaggactcctggatgtgcacgtttctctgtgtgttggccaggcgcttcttatctcgggagaagaagctaaacctttggaagggaaagcaaacacagaaatgagagctgaccctttgctgtgcaagtcacgttttttgcaatgccggagacatatagcagcaaacttagaagggagcaaatcaattcaaggtgtgagggacaaagttgggggtgcaggtcaaagttattcc

SEQ ID NO: 3169 - DNA, 203 bp, Homo sapiens
gatctaggctcactgcaacctctgcctcctaggttcaaggaattctcccgtctcggcctcctgagcagctgggatagcaggcgtgacgactgtgcccagcctcacctaatggtttcttagcaaacttcagtagaatgtttagaacgcggccctgataaacttgagtgctggtaggaggtgctacctcgctcaatctgtgagca

SEQ ID NO: 3170 - DNA, 572 bp, Homo sapiens
ctgtctctctcttcctcttcctgtctttttctttctttctttctttctttctttctttctttctttctttctttctttctctctctccctccctctttctttctctcttctttccctaagatattaataaagctaactagttttggctcagatttcaatattcacaaaatatatattctaattaataagagtgtcacaaatcatttggaaaatagttgcacctctcaatttgcaaatccttagatcaacagcttaattagtgttgccagactttaaaaaatgtttccaaaaattctgctccttctcattttcagatatttctccaaatgtgaccccttttgaccctttccctctattcccaaatgtatttttttctcatctctcttataaactgtagcctaataccttctttctctttctccattctccttttctatttgagtggagggagagaaggcaaggattgggctctgttttataaactccagtttctctgttttaattcctccactgatttgtctgtctttctatcttttctaataataaatactggtaatttattttttctctat

SEQ ID NO: 3171 - DNA, 2101 bp, Homo sapiens
tttttttttttttttttttttttttttttttttgatgttactaatgttttatatccctagaaacatcataagttgggctaatgagaagttgtcagacacacaacaaagaccacacacaaatgggcaacagctgccacaaggaggaggcttgccttttgtacaaagtttttatgtatatatatatgtatatatatttatgtacacagacacaagggtataaaatccagtgagaagggctcacacatgcccaggtaagggatgggagtagctataattgccagggttgaggccacagtagaggcacacaggaagtggtagagtagcagcctccctccatcctcctacctcgggccaaagggaggaaatgggaggaaggacaagtatacaaaggaagatggaagatactggaaaggcatactccaccttttactaaattcctgaaagcccctaaatgcctcacaggacagatcactctcacacctcctggcaggacagatcactctgaggcctcctggcaggatagatcacttccatgcctcctagcaagatgctgaggctacagtaggtctggcctcaagctgcttcaagctaaggtctgaggctggcttctcaatgcacgtccatgctatctcccagggcccttgtagcagaaagagcaccttcaaggttcacccacaaactcagtcctcttgattcagaggtcctaagggttttccttgacagactaaaggttaaaggtacaggaaaaggagagaggtcagttccttcagttaatgccctatggccttcccaatgggggagaaattgaggaatcactaaggtgttggaaagggcaagaaggtaatctcagagacgatacacatggagaaacaggtattcaatgcaggtgtggattctgttctcttcaactggtggctttgctcagcagagtccatttccagtgggaccatgggcaggagcttttcttggtatcttaagggtggccccaatttcctcagagacaatgtccatgccctcaggatggcttggtccacaaaatggagaaatggggccatggaagagtagatgtgaagtggcaggatccagaggcacaaggaggcagtatactgtgccactgatttacatggtctggggggtaaagaggctggagagctgcaaacactgggaggcaaggttcagggctggactcagagcagtcagagctgctggattcagggcccccaagggaactgctccattcagttgcaaggcagcagcctgggcggcggcggcggcagcagcagcagcagcagtgcttggcagttggattccagcgccttctgccagttttgccatgagctgaaaacgtccacctgctgatcccagatccagctcctggtccccatcaggaaaagtgatgtctgtgccaccatccagtcgctcagtcaacatggccaaccctcataggtcgacccagcaagctcaaacccattcaactgttccaaggccgccgggcaacactcagaatcagagaacgtgatgaaaccataacctttagagcggcctgtatctgagtccttcatcaggacaatattatcaattttaccaaagggctcaaagatgccccggagcatgtcttcagtgatattgaagtgcagggaacccacatagaggcgcattggtccaccattgcccttttgcaggttgttggccatggctgccagtcggtttttctctgcctgtgaagcctgtacaatgataggcactcccagcaaccgctgcccagtcagcccaatggccagtggcacagactggatttcacagaattccacgtagcaatgcccttagaacgacgtgagttccgatctgagatgatacgtacatcgcgaaccttgcctacagcagagaaaaagtcctccagatctcgaggccgaattcgggcagctaactgcatacagaaaactgtgcgggcatcacgctcctcaggactcagattatcaactggctccctgaagagtgaaatgtgttgagaccagccctcccaatacctggtcattgttctccagctaaccctcaagtattacacattcctgtaatttggctcaaataaccttttattcat

SEQ ID NO: 3172 - DNA, 631 bp, Homo sapiens
  misc_feature (1)...(631): n = A,T,C or G
catagaaagnctgggtaccgcgtatatgcttgggcccttcgagggcatatctctagaaagcggccgcccgtttattttttttatttttgccttttgtacaagagatttttatatatatatatatatgtattattatatttattgtacacccagacacaagggtatataaatccatgtgagaagggcctcacactattgcccaggtaatgggatgggagtagctataattgccagggttgaggccacagtagaggcacacaggaagtggtagagtagcagcctccctccatcctcctacctcgggccaaagggaggaaatgggaggaaggacatgtatacaaaggaagatggaagatactggaaaggcatactccaccttttactaaattcctgaaagcccctaaatgcctcacaggacagatcactctgaggcctcctggcaggatagatcacttccatgcctcctagcaagatgctgaggctacagtaggtctggcctcaagctgcttcaagctaaggtctgaggctggcttctcaatgcacgtccatgctatctcccagggcccttgtagcagaaagagcaccttcaaggttcacccacaaactcagtcctcttgattcagaggtccta

SEQ ID NO: 3173 - DNA, 651 bp, Homo sapiens
gttactaatgttttatatccctagaaacatcataagttgggctaatgagaagttgtcagacacacaacaaagaccacacacaaatgggcaacagctgccacaaggaggaggcttgccttttgtacaaagtttttatgtatatatatatgtatatatatttatgtacacagacacaagggtataaaatccagtgagaagggctcacacatgcccaggtaagggatgggagtagctataattgccagggttgaggccacagtagaggcacacaggaagtggtagagtagcagcctccctccatcctcctacctcgggccaaagggaggaaatgggaggaaggacaagtatacaaaggaagatggaagatactggaaaggcatactccaccttttactaaattcctgaaagcccctaaatgcctcacagggacagatcactctcaccactcctccttgccagggacggatcgctcctggaggcctcctgggcaggattaggtcacttcccaggcctcctcaaccaggatgctggggcctaccgtaggtccggccccaaggctgcttcaaggccgagggtctggagcttgctttctcaatggacgtgccaggctaagtcccacggggcccctgttgccatgaggggccccttcag

SEQ ID NO: 3174 - DNA, 572 bp, Homo sapiens
ccgaattcgggctgctaactgcatacagaaaactgtgcgggcatcacgctcctcaggactcagattatcaactggctccccagtggcaagtggaggactcctgtaatgcacacgatcctcacgacgatggtcccgacttcgcgactcactaccatgtcgacgatcccagctacggctacggtgacgacactgccgacctggacttcggctccgactatttctccgtctataccgatcccgatctcgactacgattgcttgtctccccgatggtgctgcttccactggtctcattgccactgttgctggtgctgctggtggtattgctaggataatcctttttaacttctttcctttgttgctcatcctcttcttttttatagggagcttccagcatggcctcaatcactatgtcaaagtcatcagatgccatcctgtcagatcagttccgggtccccgcagggggggtcccggttctctccgttcctttgagtatgttgtggggagtggagctcggatagttcctagagtctaggcaagaaaagcagcactgcaggtacagcgcctcctctt

SEQ ID NO: 3175 - DNA, 505 bp, Homo sapiens
  misc_feature (1)...(505): n = A,T,C or G
tctnnttttattcnctttaagaccatgggncncgagcaattcttggtatcttaagggtccccccaatccccagcagagaacaatgtccatgccctcaggatggcttggcccacaaaatggagaaatggggacanaggagtgtagatgtgaagtggcaggatccagaggcacaaggaggcagtatnttgtnccactgatttacctgtggaaagaagagnttttttnnaagccaaaggaaagagaataatcaaaggctagaatgagctagaccctgagactcacatggtctggggggtaaagaggctggagagctggaaacactgggaggcaaggttcagggctggnctcagagctagaacaaagacaggcagagtgagtgagcaagcaccgcgcactccttctttccagacccccaaacctncccttcctttcccatgtccaagactaccagtcagagctgttggattcagcggnattcancttggcttaccaggtgatcaaannn

SEQ ID NO: 3176 - DNA, 505 bp, Homo sapiens
tttttttttgtacaaagtttttatgtatatatatatgtatatatatttatgtacacagacacaagggtataaaatccagtgagaagggctcacacatgcccaggtaagggatgggagtagctataattgccagggttgaggccacagtagaggcacacaggaagtggtagagtagcagcctccctccatcctcctacctcgggccaaagggaggaaatgggaggaaggacaagtatacaaaggaagatggaagatactggaaaggcatactccaccttttactaaattcctgaaaggcccctaatgcctcacaggacagatcactctcacacctcctgggcaggacagattcacttctgaggcctcctgggcagggattaggttcactttccatggcctccttggccacggttgcttgaggcttccagttagggttttgggcctgcaagttggttttcaagcttagggttttgagggttggtttttcattgcacgtccttgtttt

SEQ ID NO: 3177 - DNA, 833 bp, Homo sapiens
  misc_feature (1)...(833): n = A,T,C or G
actcccagcaaccgctgcccagtcagcccaatggccagtggcacagactggatttcacagaaanccacgtaggcaatncccttagaacgacgtgagttccgatctgaaatgatacgtacancgcgaaccttacctacagcagagaaaaaagtcctccagatctcgaggccgaattcgggcagctaactgcatacagaaaactgtgcgggcatcacgctcctcaggactcagattatcaactggctccctgactgggctcttctctctgaaatgaggactcttactgtgtccatacctataaccagtggcaagtggaggactcctgtaatgcacacgatcctcacgacgatggtcccgacttcgcgactcactaccatgtcgacgatcccagctacggctacggtgacgacactgccgacctggacttcggctccgactatttctccgtctataccgatcccgatctcgactacgactgcgctttctatccctgcttttattatggctccgactcctcttcttcttgcttgtctccccgatggtgctgcttccactggtctcattgccactgttgctggtgctgctggtggtattgctaggataatcctttttaacttctttcctttgttgctcatcctcttcttttttatagggagcttccagcatggcctcaatcactatgtcaaagtcatcagatgccatcctgtcagatcagttccgggtccccgcaggggggtcccggttctctccgttcctttgagtatgttgtggggagtggagctcggatagttcctagagtctaggcaagaaaagcagcactgcaggtacagcgc

SEQ ID NO: 3178 - DNA, 524 bp, Homo sapiens
  misc_feature (1)...(524): n = A,T,C or G
taaggtcccggaattcgggaactaaataaccaagtcgaaggaacccaaactaaggctaagggtgaaggaaaatgccngaacccgggaacttcgggctccngaactaatttctcccgtcctaaaacngaaccccgaatctcgaactaacgaactgcgcctttcctaatcccctgccttttaattatggctcccgactccctccttccttcttgccttgtctccccgatggtgcctgcttcccactggtctcattgcccactgttgctggtgctgctggtggtattgcctaggataatcctttttaacttctttcctttgttgctcatcctcttcttttttatagggagcttccagcatggcctcaatcactatgtcaaagtcatcagatgccatcctgtcagatcagtntcgggntccgcaggggggtcccggttctctccgttcctttgagtatgttgtggggagtggagctcggatagttcctagagtctaagcaagaaaagcagcactgcaggtacagcgcc

SEQ ID NO: 3179 - DNA, 459 bp, Homo sapiens
ccgaggctcactacagccttgacctcccaggctcaagtgaccctcccacctcagcctctcgactagttgggactataggcgtgcaccaccacattggctaatttttgtattttttaatctttcttaacctggcctattatttgatttgtgtctaacttatttgtccaccaagcacatgaacagagatggagccaaactttcacagcatagactcatatgcccactatgacgtatgcagcaggttaatcacggccaggcacaacagagaagtacactcaaacactcaccctccccacttcttccaattcccttcagagggtttctctcacttctactcactttaccaaagggctcaaagatgccccggagcatgtcttcagtgatattgaagtgcagggaacccacatagaggcgcattggtccaccattgcccttttgcaggttgttggccatggctgc

SEQ ID NO: 3180 - DNA, 346 bp, Homo sapiens
  misc_feature (1)...(346): n = A,T,C or G
acaatgtccatgccctcagnatggcttggtcccacaaaatggaagaaatggggcccatggaagagtagatgtgaaagtggcaggatccagaggcacaaggaggcagtaatactgtgccactnatttacatggtctggggggtaaagaggctggagagctggaaacactgggaggcaaggttcagggctggactcagattatcaactggctccctgactgggctcttctctctgaaatgaggactcttactgtgtccatatctataaccagtggcaagtggaggactcctgtaatgcacacgaacctcacgacgatggtcccgacttcgcgactcactaccatgtcg

SEQ ID NO: 3181 - DNA, 742 bp, Homo sapiens
  misc_feature (1)...(742): n = A,T,C or G
actctaagaaaccgctgcacagtcagcccaatggccagtggcacagacntggatttcacagaattccacgtagncaatgcccttagaacgncgtgagttccgatctgagatgatacgtacatcgcgaaccttgcctacagcagagaaaaagtcctccagatctcgaggccgaattcgggcagctaactgcatacagaaaactgtncgggcatcacgctcctcaggactcagattatnaactggctccctgactgggctcttctctctgaaatgaggactcttactgtgtccatacctataaccagtggcaagtggaggactcctgtaatgcacacgatcctcacgacgatggtcccgacttcgcgactcactaccatgtcgacgatcccagctacggctacggtgacgacactgccgacctggacttcggctccgactatttctccgtctataccgatcccgatctcgactacgattgcttgtctccccgatggtgctgcttccactggtctcattgccactgttgctggtgctgctggtggtattgctaggataatcctttttaacttcttacctttgttgctcancctcttcttttttatagggagcttccagcatggcctcaancactatgtcaaagtcatcagatgccaacctgtcagattgggtttagtgtctntctagatgtgctaaaagcaataaggtagcaaacactatgcattttcaggctggtagttttttc

SEQ ID NO: 3182 - DNA, 326 bp, Homo sapiens
ttcttttttgttttttttttgtatttttagtagagacggggtttcgccgtgttagccaggatggtcgcgatctcctgacctcgtgatccgcccgcctcggcctcccaaagtgctgggattacaggcgtgacgactgcacccggcccaggttggtagttttcaaacgctctcttcatgtcccaacttatgggtcaaggtccactcaatctcatccacatagagtatgttttcttccatccagttccgggtccccgcaggagtacccggttctctccgttcctttgagtatgttgtggggagtggagctcggatagttcctagagtct

SEQ ID NO: 3183 - DNA, 233 bp, Homo sapiens
  misc_feature (1)...(233): n = A,T,C or G
gtcgacgaggcttgtaaacttnacttaaggtacaagcctctacaaataaacctctacgtaaaaagttttcactcagaaacaaatatatccgtttaagcaaagccatatacaacacaatattttgaaacttgcaagctcactgggtttagtgtctttctagatgtgctaaaagcaataaggtagcaaacactatgcattttcaggctggtagttttttcttttttctgtcgacg

SEQ ID NO: 3184 - DNA, 3426 bp, Homo sapiens
tttataatcatgttagaacataatcagttcttgaatatttatttcctttaagagaatatcaaactgatgtcaccaaatctaaacccacttgaagaccaatagctattacagttgtactacagaataggtcaaagtcaccgttagaaatattacactttattgaattctggagcagctaatctaccctcccctattgaccaatgacaagaatggaagaaaatatacaatggttaaagaaagagtctataaccactgtttgtttaaaatgttgaaacaactttcactgtactggtgaaacagttttaataccctaacatacacagtaatgattcattcttgtttaaaacaagaggtgatttcgacttgggattgggatttttattttttgagatggagttttgttcttgttgcccaggctggagtgcaatggcacaatcctggctcactgcaacctccgcctcctgggttcaagcaattctcctgcctcagcctcctgagtagatgatgggattacaggcatgcaccaccacgcccaggtaattttgtatttttagtagagatggggtttctccatgttggtaaggctggtctcgaactcccgacctcaggtgatccgcctgtctcggcctcccaaagtgctgggattacaggcgtgagccgccgtgcctggccttgacttgagattctgaagtggatttattcacactgattgtgccctctactttagtaaggttctggcttacagagccctcttcccatcctctgatgttcaattttaatatacagcaatcaactcttagaggacaaagaaatctggaattgggtagcatgagccacagctatatagcccacactaatgcatgttctgtagtataagaaggcagttcttccctttcttttctgggggcttgttcctttgtccacttgcagctaaattctttctatagatttatcacagataagaaggaggttgtttttggataacaaataagcatttgtgctattaaacaaacaaaaggtaataaggatactgtcttttccctcaaaatagaatcctgccctaaagcaacgcaagtagagcatacttctgtgcaaagccagtgatagagaagcagccttgccagagtcactgaggatgaattaaaggcttataaaagaaaacttgaccttaacagagactacatttgatcatggaaataatacatttctccactgatatacaataccatgtaatgcactggaaaagttggaccttggagtaatagcacaatttgtaacattacagatcacctcttcccactctttgttccactctgagactctttccttttcctcgtgtatccagatacactgacatacggatgattttaaaagtgtcacaagccacagtggagccatatacatgcagttcagcctgattttacccttattttcttctaatacagactccattacaattttggaccatctgcagagagtacagatacacaaaaccaaaacaagtatctatgataataaaatcttcagaaacttttcagacgtacctttcatggagccccctccctcccccgagtagaaccctaacagggacctcgtttgttcctgtgagtcctgccaggacttgtttaatgggtgcttggggttttggttttcctccttattcttcctcctcctcctcctcttcatcatcatcttcgtcatggcagtgtgtaatttcctggggggccagtgggaagaggttgggaggtttaatctcactaattgaccgtgtcagctggtgccgcttgtagtcagtgtctttgaaatccactgatgtgcggttccgggtggcaagaggagactccatctcattgatatctacgtgtgtgtgctccaccgttgattcatgaggcatcaagacatgggcagccctgaagaggtagctgaaagggtaatacagcaggttgatgaaagatgctgcatagaggtcagcataacgcatcacttgactggcaaaaagggtctgccgggagccactgcgaaacaggcttcccatcatcccatagcacatgtccatgtcatgagttactttcttaatacgtctctggatggaactgatgtctggacgctcattgctactgctgtcaagatgcttgtagagttcagccaagaaaatatccaagctctgaagttcttcgaaaagtgaactcttgtcagtccagacatgtagctcctgtgcgagttcaggaatcaccaaaaaagttcgccacccttgccgtttctttgattttaaaatgtccccaaaaatgtgatctccaatatacaaaatgtcttttcccttggctcccaacaggtcacagatcgtatcagaagaacctcctgagtagacgataccatgctgtaggggccctgtgtaggtaccaattttcagcttgccagttttagtatccacctgacgcagtactgtgccttctccaaaaaagagtggtttccgtgcatccaccaagatcaagtcaaagtaggactgccatggtcgatgggagctcccaggcttggggccatgtgggaagtcaaacaggtaagtcataattttatctgtatatttatagtcactgttggtagcaagaaatactttccctacttccttcatccggctcagaagcaaaggcagttttccatctttgactacatacttctcaagattttcaactgtcttttccttaagggagcccttgtaatgaacccagtcaacagcatctcttacatcctggaacatactccggtaggacatgaagaggtccccatctttaaatcctgtttcacaactggtatatctgggacaattagtaaaaaaatctactaggcaggccaacaggtaggtctctggtaggttgaatagtgtgttcagaatgtaaaatctttcagtatcatctcgctggataaatttatttggatactgttctctagtttctggtccccttataaagttaaatccatgtgcacagaccaagaggtttccataggcatcgactttcaaaagatttccatacagtgtgtcaaagacaagtcccctggtagggaatgtagaatcataagcaaagctgagcaactcctggggatagccaatagaaactaatctctccacagtaagctcaaaaccaagggactcatactctggggacttgtacacagcaagggtataatccatatcaaaaccaaaacactttatcttttccattgctaaacttcggttcacaaacacccgatgataggcttctcgacgatactttttcagggcatgcttatccatgttagcaggcatatctgctgcattctgtaaccgatcactccaggaggtcgacattttattttaactgtattttgtattcggctccagcgcaccgcaacaatcccagcgcgcaactgctgcagccgcctcaacgcgcg

SEQ ID NO: 3185 - DNA, 429 bp, Homo sapiens
ttttatatataatgtttttattgttctaaaagcacacatatactttattttaaacacggggcatggtggctcacacttgcaatcccagcaccctggaagacaaggcaggaggatcacttgagaacaagagttcaagatcaacctgggcaacacagcaagactttgtctcgatgataggcttctcgacgatactttttcagggcatgcttatccatgttagcaggcatatctgctgcattctgtaaccgatcactccaggaggttgacattttattttaactgtattttgtattcaattatgccacaataagactttttcagccagtggaggtggctcacacttgtaatcccagaactttgggaggccgaggcgaatggatcacttgacgtcaggagatcacatcactgtactccagcctgggcagcaga

SEQ ID NO: 3186 - DNA, 408 bp, Homo sapiens
  misc_feature (1)...(408): n = A,T,C or G
tntannttacactttattgaattctggagcagctaatctaccctcccctattgaccaatgacaagaatggaagaaaatatacaatggttaaagaaagagtctataaccactgtttgtttaaaatgttgaaacaactttcactgtactggngaaacagttttaataccctaacatacacagtaatgattcattcttgtttaaaacaagaggtgatttcgacttgggattgggatttttattttttgagatggagttttgttcttgttgcccgggctggagttgtcaaatactgggatttctgtccacaacagggaatggggggaaccttttaaggggttaggccgatttcagaattttgccacttaaaagcccacattatcactataaatggaataaagggattaacct

SEQ ID NO: 3187 - DNA, 454 bp, Homo sapiens
ttttttcaccgttagaaatattacactttattgaattctggagcagctaatctaccctcccctattgaccaatgacaagaatggaagaaaatatacaatggttaaagaaagagtctataaccactgtttgtttaaaatgttgaaacaactttcactgtactggtgaaacagttttaataccctaacatacacagtaatgattcattcttgtttaaaacaagaggtgatttcgacttgggattgggatttttattttttgagatggagttttgttcttgttgcccaggctggagtgcaatggctattcacaggcgcgatcccactactgatcagcacgggagttttgacctgctccgtttccgacctgggccggttcacccctccttaggcaacctggtggtcccccgctcccgggaggtacaccatattgatgccgaacttagtgcggacaccc

SEQ ID NO: 3188 - DNA, 478 bp, Homo sapiens
ttttttttttttttttttcaccgttagaaatattacactttattgaattctggagcagctaatctaccctcccctattgaccaatgacaagaatggaagaaaatatacaatggttaaagaaagagtctataaccactgtttgtttaaaatgttgaaacaactttcactgtactggtgaaacagttttaataccctaacatacacagtaatgattcattcttgtttaaaacaagaagtgatttcgacttgggattgggatttttattttttgagatggagttttgttcttgttgcccaggctggagtgcaatggcacaatcctggctcactgcactccagcctggagtctttaaaaaaaaaaaaacaaaaaacaaacaaacaaaaaaaaaacaaaacacaaaaccacaccaaaaaaccaaaaactactacgccatgaaaaacaagtctagactcattgatttagagcaacaggcaaact

SEQ ID NO: 3189 - DNA, 430 bp, Homo sapiens
ttagaaatattacactttattgaattctggagcagctaatctaccctcccctattgaccaatgacaagaatggaagaaaatatacaatggttaaagaaagagtctataaccactgtttgtttaaaatgttgaaacaactttcactgtactggtgaaacagttttaataccctaacatacacagtaatgattcattcttgtttaaaacaagaggtgatttcgacttgggattgggaattttattttttgagatggagttttgttcttgttgcccaggctgggggtgacagggttcatgaataatgtcacaccagtgaacttccactgtatcttctaagaacgcattacaatgatgggtaaaatgcagggcgagctgtatcgggggctgtgtactttccagggagaataaacagcctgtacaaatgcatatg

SEQ ID NO: 3190 - DNA, 485 bp, Homo sapiens
gatactgttctctagtttctggtccccttataaagttaaatccatgtgcacagaccaagaggtttccataggcatcgactttcaaaagatttccatacagtgtgtcaaagacaagtcccctggtagggaatgtagaatcataagcaaagctgagcaactcctggggatagccaatagaaactaatctctccacagtaagctcaaaaccaaggactcatactctgggacttgtacaatgaggcagatgcagatgcagtgtgtgtcactccagtcttgaaggagttacactggctctccgatgataggcttctcgacgatactttttcagggcatgcttatccatgttagcaggcatatctgctgcattctgtaaccgatcactccaggaggttgacattttattttaactgtattttgtattcggctccagcgcacggcaacaatccctagcgcgcaactgccgcagccgcctcaacgcgcgccct

SEQ ID NO: 3191 - DNA, 430 bp, Homo sapiens
tttttgtccccaaaaatgtgatctccaatatacaaaatgtcttttcccttggctcccaacaggtcacagatcgtatcagaagaacctcctgagtagacgataccatgctgtaggggccctgtgtaggtaccaattttcagcttgccagttttagtatccacctgacgcagtactgtgccttctccaaaaaagagtggtttccgtgcatccaccaagatcaagtcaaacaggtaagtcataattttatctgtatatttatagtcactgttggtagcaagaaatactttccctacttccttcatccggctcagaagcaaaggcagttttccatctttgactacatacttctcaagattttcaactgtcttttccttaagggagcccttgtaatgaacccagtcaacagcatctcttacatcctggaacatac

SEQ ID NO: 3192 - DNA, 422 bp, Homo sapiens
  misc_feature (1)...(422): n = A,T,C or G
gcagctaatctaccctcccctattgaccaatgacaagaatggaagaaaatatacaatggttaaagaaagagtctataaccactgtttgtttaaaatgttgaaacaactttcactgtactggtgaaacagttttaataccctaacatacacagtaatgattcattcttgtttaaaacaagaggtgatttcgacttgggattgggatttttattttttgagatggagttttgttcttgttncccaggctggagtgcaatggccaatcctggctcactgcaacctccgcctcctggggttcaagcaattctcctgcctcagcctcctgagtagatgatgttcaattttaatatacagcaatcaactcttagagggacaaaganatctgggattaggtagcatgngccccagctttnatagcccac

SEQ ID NO: 3193 - DNA, 384 bp, Homo sapiens
accagtatatgtggcactctgctgagagattaccaaagctctcactgtgaggtctgagcaaagacattaaataaagggaagtctgtgacttacctcctgagtagacgataccatgctgtaggggccctgtgtaggtaccaattttcagcttgccagtcttctgtatgaagaatatggattttgtaatactttatcatcctatcacaatcctcccctcaccccacaaccctcccatcccaccccccaccaccagtgctacttggccagacagccaaatgaatggcacttactcttttcaattagtgggtttgtttgactgtttcagttaagaccaaaactcttaatttcaaaagagagatacggctaattaaaaaaaaaaaaaaa

SEQ ID NO: 3194 - DNA, 353 bp, Homo sapiens
  misc_feature (1)...(353): n = A,T,C or G
gcacatgtccatgtcatngcgttactttcttaatacggtcgtctggatggaactgatgtctggacggntcattgctactgctgtcaagatgcttgtagagttcagccaagaaaatatccaagctctgaagttcttcggaaaagtgaactcttgtcagtccagacatgtagctcctgtgngagttcaggaatcaccaaaaaagttcgccacccttgccgtttctttgttttaaaatgccccaaaaatgcatctccaatatacaaaatncttttcccttgntccacagtccaacnacaganctcataagtaagaccggataccnatngcttngtaanggggggccaccttggtng

SEQ ID NO: 3195 - DNA, 338 bp, Homo sapiens
tttgagacggagtttcactcttgtcgcccaggctggagtgcaatggtgcaatctcagctcactgcaacctccatttccccggttcaaacgattctcctgcctcagcctcccaaatagctgggattactggcctggaaagaacatttcttatatctaagtgattcctgaataagtttttgggaaagaaatttttagaaaacttacttgtagagttcagccaagaaaatatccaagctctgaagttcttcgaaaagtgctagttaaggtttggaaggaaaatgaagacattttaaataaataagcacctagttcttaactgctgctaaactaaaaggttg

SEQ ID NO: 3196 - DNA, 1776 bp, Homo sapiens
tttttttttttttttttacgtatcaacaaaggatccttttcctttattgaccagagcaggaccgtggcatttttatatatatatatatatatatatatatatatatataaaagtttgaagatctggcaggcagtgatcctattgtccgcccaccacccccagcactgatttcctgctccctgcacggggaagggggaggatgactgctccacccaggccacagggccacactcccctgcaaacagaggaagaaaggggcttttctgtagccaccccctgcacatcagaaatcaacaagtattctctcaaagaaaaaaaaatacagaaattgaaacatttaaatatgaaaaaccaaagggaagtgagtgggaagaggcaagagaggaaaggaactggagtttcttgggaagggactcccatgtctcccttcccatttatgggcttggggtctggggtacgaggctcacacagtgagtttgcagtgacacagctccttgtagatctgccgacgaagtttgggcatgtcctgctgggtgaagctgaatggctgagacagggccagatgcttgcagtactgcaacacaaaagcaccacagtcactgtcattattctgcctggccacattcattttgaagtaacctttccagccctggtggaaatccagtcggtctttctttaccgcctctgcctgtagatacttggcaatatgcttagggcagcggcggtttagggtacgctgcgagtcaaaataggtgatggtgcgtcgcctcacatcaacagagatgagggaccaatgcacctccaggtggatggggattagcagtagctccttattgaagatgtccacgtttttggtccaccttttcaccccatcataacccttggtacggagtttatcatagaagaaactattgaagaaatgcaccttttcagggactgtgtccatgaccaggtctccatacatgttcatcacctggtcattgagccagttctgtccatacaaggtccccaagtcatccatggtcagcacgtgccgcttataagccactcggaagcccctcaccatggcattgcctggcatccgctggtaagactggatcagctgcaacaccaggcccttcctggaaggggtggaaaactcctgctggaaaatgtcctccagcttctctactacctcatcagtgctgaggggtatgaggctgccatacgtttgaaggaattcgtccaagatgctctgtacgcaggtcacatgctcctctcgcagggggctgtgctggccggctttctccccaggcctctctgcctcttctgccatgcccaaatctgagccctgaaaaagctcctgggccacatggtccccgatgctgcacacattgctgatgaggatgctggcatcagggggtgccaagctgcgctccccttctggcccagattgtcccccaaaaccgttgggcagagtacatgaaaggaggcccgagtcagggtccagaggagactttggagtccacctgagtccatcttcctccatggggggcccagagggcactggtggagaccctctcaccccatcctcagccatgagagcacctagcagacccagccggggtggaggtggcccccggggggagtcaaaacgacaacagggggatggcacctgtggcgtcgcacccccttgctggggtgaaagatggttcttggggtgtgcgaggccccgccgccggccccggtggcgcccccaaagcttccagtggaatgtcagcgaggtgcttttccacg

SEQ ID NO: 3197 - DNA, 444 bp, Homo sapiens
ttttttttaaatcttgttttacaatagttacaataggaacccatcccaatccttggggctggccatagcgaaaaacactaaatactggcagaaaggaaaacaactgataaatccagagcccaagattacggatttgaaattaatacactaccactaccacctctctccctgaaacagagaccctctctgtgtaaaatgaaagagatgaaaggagcttaaaaagctgcttaaaactgcagaagttcctctgggtactgacctatctggttgggcctaccttttcagggactgtgtccatgaccaggtctccatacatgttcatcacctggtcattgagccagttctgtccatacaaggtccccaagtcatccatgggtcagcacgtgccgcttataagccactcggaagcccctcaccatggcattgctggcatccgctggtaag

SEQ ID NO: 3198 - DNA, 435 bp, Homo sapiens
cacagctccttgtagatctgccgacgaagtttgggcatgtcctgctgggtgaagctgaatggctgagacagggccagatgcttgcagtactgggtgttaacaaagcaagccatgagaaaccccccgtgtcaggacctgtgctacacatttcatatgagatgtgtctccatccttcagagaacatccccaaagggagccagggtcccacagcctggggttcaaaaacagcctgactctaaagctagtgttcttacttgatagaatgttttagatggagaaaatacactgagttggaggttagcagggagctctatgaacgcagaggcccaagactagagacccagtcccaatgtgggatggagaagtccagaagagaaccagtgaagccagtgttttggtgttctaaaacagattacttcctgctccacaactgac

SEQ ID NO: 3199 - DNA, 444 bp, Homo sapiens
cctctctgcctcttctgccatgcccaaatctgagccctgaaaaagctcctgggccacatggtccccgatgctgcacacattgctgatgaggatgctggcatcagggggtgccaacgtgcgctccccttctggcccagattgtcccccaaaaccgttgggcagagtacatgaaaggaggcccgagtcagggtctggcccaaaccctccacctgacttgagtcggggtttgggaggtgggggccaacgaagaccgtcccgcctgggacttgagtaagctgggggtatgccgggtccaggaggctcaggcccccaggacccggtcccttgtatagtctctttcatcttccagtacccgggagcggggaagccgggcggacggcgccgaaggcgggcgtctccggcctcaagcttcccggctcatctctccggcgacggcggcggccc

SEQ ID NO: 3200 - DNA, 852 bp, Homo sapiens
ttttttttttttttttttttttttttttttttttttttttttttacgtaaaaacaaaggatcctttattgaccagagcaggaccgtggcatttttatatatatatatatatatatatatatatatatatatatatataaaagtttgaagatctggcaggcagtgatcctattgtccgcccaccacccccagcactgatttcctgctccctgcacggggaagggggaggatgactgctccacccaggccacagggccacactcccctgcaaacagaggaagaaaggggcttttctgtagccatcccctgcacatcagaaatcaacaagtattctctcaaagaaaaaaaaatacagaaattgaaacatttaaatatgaaaaaccaaagggaagtgagtgggaagaggcaagagaggaaaggaactggagtttcttgggaagggactcccatgtctcccttcccatttatgggcttggggtctggggtacgaggctcacacagtgagtttgccagtgacacagctccttgtagatctgccgacgaagtttgggcatgtcctgctgggtgaagctgaatggctgagacagggccagatgcttgcagtacaatttttgaagtaacctttccaggccctggtggaaatccagtcggtctttctttaccgcctctgccttggtagatacttggcaatatgcttagggcagcggcggtttagggtacgctgcgagtcaaaataggtgattgggtgcgtcgcctccaacatcaacagagatgagggaccaatgcacctccaggtggatggggattagcagtagctccttattgaagatgtccacgtttttggtccaccttg

SEQ ID NO: 3201 - DNA, 441 bp, Homo sapiens
atcaacaaaggatcctttattgaccatgagcaggaccgtggcatttatatattgatatttatatatatatatatatatatacatatatatatatatatatatatatatatatatatatatataaaagtttgaagatctggcaggcagtgatcctattgctccgcccaccacccccagcactgatttcctgctccctgcacggggaagggggaggatgactgctccacccaggccacagggccacactcccctgcaaacagaggaagaaaggggcttttctgtagccaccccctgcacatcagaaatcaacaagtattctctcaaaagaaaaaaaaatacagaaattgaaacatttaaatatgaaaaaccaaagggaagtgagtgggaagcgcctgctggggaatggcccccggcttccctgcgaccgcaccagtgctgagg

SEQ ID NO: 3202 - DNA, 686 bp, Homo sapiens
  misc_feature (1)...(686): n = A,T,C or G
tttttttttatcaacaaaggatcctttattgaccagagcaggaccgtggcatttatatatttatatatatatatatatatataaaagtttgaagatctggcaggcagtgatcctattgtccgcccaccacccccagcactgatttcctgctccctgcacggggaagggggaggatgactgctccacccaggccacagggccacactcccctgcaaacagaggaagcgccgcagcttttctgtagccactcggaagcccctcaccatggcattgcctggcatccgctggtaagactggatcagctgcaacaccaggcccttcctggaaggggtggaaaactcctgctggaaaatgtcctccagcttctctactacctcatcagtgctgaggggtatgaggctgccatacgtttgaaggaattcgtccaagatgctctgtacgcaggtcacatgctcctctcgcagggggctgtgctggccggctttctccccaggcctctctgcctcttctgccatgcccaaatctgagccctgaaaaagctcctgggccacatggtccccgatgctgcacacattgctgatgaggangctggcatcagggggtgccaantgcgctccccttctggcccaaagtctcctctggaccctgactcgggcctcctttcatgtactctgcccaacggtttc

SEQ ID NO: 3203 - DNA, 402 bp, Homo sapiens
  misc_feature (1)...(402): n = A,T,C or G
ggggtcctggggtaacnaggccnaacaacaatgaatttgcaagtgaaaacanctcccttgtaagatctgcccgaacgaaatttgggcaatgtccctgctgggtgaaagctgaaatggctgaagacagggccagatgcttgcagtacattttgaagtaacctttcccagcccctggtggaaatccagtcggtctttctttaccgcctctgcctgtagatacttggcaatatgcttagggcagcggcggtttagggtacgctgcgagtcaaaataggtgatggtgcgtcgcctcacatcaacagagatgagggaccaatgcacctccaggtggatggggattagcagtagctccttattgaagatgtccacgtttttggtccaccttttcaccccatcataacc

SEQ ID NO: 3204 - DNA, 360 bp, Homo sapiens
tttacgtatcaacaaaggatcctttattgaccagagcaggaccgtggcatttatatatttatatatatatatatatatatatatatatatatataaaagtttgaagatctggcaggcagtgatcctattgtccgcccaccacccccagcactgatttcctgctccctgcacggggaagggggaggatgactgctccacccaggccacagggccacactcccctgcaaacagaggaagaaaggggcttttctgtagtctctttcatcttccagtacccgggagcggggaagccgggcggacgggcccgaaggcgggcgtctccggcctcaagcttcccggctcatctctccggcgacggcg

SEQ ID NO: 3205 - DNA, 435 bp, Homo sapiens
  misc_feature (1)...(435): n = A,T,C or G
tttacgtatcaacaaaggatcctttattgaccagagcaggaccgtggcatttatatatttttatatatatatatatatatatatatatatatatatatgtatgtcgatctggctggcagtgatcctattgtccgcccaccacccccagcacagagttcctgcncccnnnnnnngggagggagcggcggcgtgccggcggtggccggtggcgccgncgncgncgnacngancgncgncgggnccgngcngacgcccccgctgcacatcagaagtcagcgagtgttctctccaaagaaaaaaaatacaggaattgtgacatttaaatattgaaacccaaagggaagtgagtgggaagaggcaagagaggaaaggaactggagtttcttggngagggactccatgtctccttcccatttatggcttggggtctggggt

SEQ ID NO: 3206 - DNA, 512 bp, Homo sapiens
tcaacaaaggatcctttattgaccagagcaggaccgtatatatatatataaaagtttgaagatctggcaggcagtgatcctattgtccgcccaccacccccagcactgatttcctgctccctgcacggggaagggggaggatgactgctccacccaggccacagggccacactcccctgcaaacagaggaagaaaggggcttttctgtagccaccccctgcacatcagaaatcaacaagtattctctcaaaaagaaaaaaaaaattacagaaattgaaacatttaaatatgaaaaaccaaggggaagtgagtgggaagaggcaagagaggaaaggaacttgagtttcttgggaagggactcccatagtctcccttcccatttatggcttgtgggtctggggtacgaggctcacacagtgagttttgcagtgacacagctccttgagtacttctagagcggccggcccatccgattttccaccccggtgggtacaggtaagtgtaccaattcg

SEQ ID NO: 3207 - DNA, 440 bp, Homo sapiens
  misc_feature (1)...(440): n = A,T,C or G
ttttttacgtatcaacaaaggatcctttattgaccagagcaggaccgtggcatttttatttatatatatatatatatatatatatatatatataaatataagtgtgaagatctggcaggcagtgatcctattgtccgcccaacacccccagaacagaaaacctggaccctgcgcggggaagggggaggatgactgcgctactcaggccactaancannnnncgggaggggggggggggggggggggggaattatttatcttaccgctcgcacacacnaccnacgangngnncncncnangcnanananacaggggaatcggaacatttcaacttgagaaaccaaggggatgtgagttgggagggggcaagagaggaaggaactggagtctcttgggaagggaccccatgtctcccttcccttgatgggcttggggtctgg

SEQ ID NO: 3208 - DNA, 215 bp, Homo sapiens
ccccgatgctgcacacattgctgatgaggatgctggcatcagggggtgccaactgcgctccccttctggcccagattgtcccccaaaaccgttgggcagagtacatgaaaggaggcctatagggcaggggaaatggaatgggcatgagagactggcctggggaaagcacaatgggatgcacacagttgactcatgcatgcaaacctgtgccgaat

SEQ ID NO: 3209 - DNA, 586 bp, Homo sapiens
tcatttctttctttctttcgtggtgggtttctttctttctttctttgctttctttctttctctttctttcttttttctttctttctctttctttttttctttctttctctctctttctttctttttctttcttctttctttctttccttcagacagagtgagactccatctcaaaaaaaaagaaagaaaaaaagaagcacatgtttttcatagggggtattatatgggggaccttaaactgctggtgaaaatggatagaaagccaagtagctcccttagtctgggtttgattgcagcctttttatcgttttgctaattatagcaatatttattgagcacctgccatgtgactgtcactgttctagatattttacatgtaatatacagataaaagaatagtactttatatatattacaatgatacaatgattacattaacaatacaatattttgcttgtcatatgctaagaataattgggtagagtgacattactgtgccttcgattaaaataagtacttttttgcgtgttaaattcatgttttcaataaataataaatgcatatagttgaaaaatcagtaaatata

SEQ ID NO: 3210 - DNA, 477 bp, Homo sapiens
atgatcgctttggagtcgattcgacttttttttttttttttttttttttttaagagacagagtcccaatcagtcacccaggctagagtgcagtggtataagcatggcacattgtaacctccaactcctggcctcaactgatcctcttgcctcaggctcctgagtagctgggactataggcacatacgatcatgcctggctaatttttaatttttttagagatgggatctcgctatgttgcccaggctggtctcaaactcctggcccggagcagtcatcctgcctcagcctcccaaagtgctaggattacaggcccaagccactgtgcctggtcaggtgtctttgagagtggtgctatcccactgaactggtgagaaagttgagtagaaccaaagaaagaaaacttgatagaagcaagaattatgattgcgaatcactagcccttctgtcgtcttctcgcagccgtatagtagtagta

SEQ ID NO: 3211 - DNA, 631 bp, Homo sapiens
tttcctttttttttcagaatacaaggcaaagttgctttctttcagagataaacaaatggaaatacatagatctcttcttaaaagggctcttcctgtcctagtacatacaccatattgtactatgattttgttgttcgtttctccattttcattacttctttggatactactgagtttaaagttaaacactttctgtagtagtccattttcatactgctataaagaactgcctgagaataggcaggaagaggtttaattgactcacagttctgaatggctggggagacctcaggaaacttacaatcatggcagaaggcaaaggagaagcaagtaccttcttcacaaggcagtagggagagagaggggaaaagggggaagccccaggacacttacccaaaaaaccagatctcatgaggaactccctcactatcctggcaaacagcatgggggaaactgcccctatgattcagtcacctcccatcaggtccctcccttgacacatggggattacaattggagatgagatttgggtggagacacagagtcaaaccatatcattctacccctggcccctccaaaatctcatgtccttctcacatttcaaaaccaaatacgccttcccaacagaacc

SEQ ID NO: 3212 - DNA, 1578 bp, Homo sapiens
  misc_feature (1)...(1578): n = A,T,C or G
attttatnccgcctcactnttggggnatttgccctcgaggccaagaattcggnacgaggggcccnccattttttttttttttttttctaatatattttactgacaagcccttgagagctgctttgctacttgcatgcaggcctctgtgtgaccaggcacacagactacatgtgctccatcttgtctctccgctgctccaggggccttgctcaaaaaccccctatattactggaaactgctggttttacctatgtgcttcttcctaaggcatgcaaaaaaaaatatgtgaaattcagaaaacatttacagttcaggcagctgaggcactgaagtcctaagagacatcacctaaatatcagtggctgtgactcccctgtcccccaaaccaattatgaaggtcaggcatgggacacacttgtaattcccctctgctttatggtccagcttaaaacgatgccattagaaggaattctaactcaggtattgcaattatttgaaattcccaatcctcaggagccacacaagcccagggccagcaacaacactttggggagcggggggatgagtttcctgaagtttgtggctgaaaagcaggccttccttggcaaggcttgtgggagcgctgggtgctggagactgaccccacaagtgatcagccaccaggcctaagactaaccagctgcaggacgcccccttccacagtgaggtgaagcctcgccagggggcctgagcagcaggcttgctcttgtccctacattaggacacccgaatggtgtgacaggagagctaaagaaccacccacaaggggaaaagctgatgtcaacttaagagccacacacctctggaaagcaacaagcctctccttcagtttagtccagaagggaaatcccctcatttgtgaacacatcattcatctcaacccaagctgctggctctgtggactgggcctgggcaaggctgtgctgctcctcccaggacttggcccacggccagtacggccagctccttcagggaaacgggcctagcaggggaggcaggcactccactggggaagatggctctcgtggagcagcatctgaggcttgaggcctgtcgtgcctcgcctcccagacacggccacagttcaggcagccagggttccttctaagtcccagtagctcctctgtgtaatcctaatgcttctccccaacctcaagagcccaaaggagatcctgttatcagaaacccagagctcctggactgccagttgcacacgtagacgggcaggccccatctgctcatccttgagtattcccccgacccccaaaatcaatggtgcaggtgatgctcttcagcgctatacagggaataaagacaacatgcactcaagccagcccacacaggccaaggagaacaaagacagccccttaagggagaggcctccagcagagctgaggttaagacacccgttcgtccatctccaaggtggacattctgcaggacgtacgggcccagccttcctctagggcttcagctcaaagaggtcatgatactcctgctgttccagctcctggttatacttctcaatttcccggttgg

SEQ ID NO: 3213 - DNA, 337 bp, Homo sapiens
tttttttttttttttttttttttttttttttttttttttttttttttttttttttttttttttttctttgttttttttttttttttttttctttttttttattttgttttttttttgttttattggccttgctcaaaaaggggggtattactggaaactgaagaaaaaaccaaagagcaaaacctaaggcatgcaaaaaaaaaatgtgaaacccagaaggggggggcggggaaggcaataaggcactgaagtcctaagagacatcacctaaatatcaggggctgtgactcccctgtcccccaaaccaattatgaaggtcaggcatgggacacacttg

SEQ ID NO: 3214 - DNA, 1318 bp, Homo sapiens
tttttttttttttttttttttttttttttttttttcagtttcaaaacaacctttattctgtttgaagatctaatacaatgcattaaagcaacttaaaacaagacatagctccattgaatctataacttgaacgaaatgtcaaggaggcacactacccccaccccccaccccagttgccttgtgaaggcaaagttacaactgaccgtgacatcctccctctcgtcaaaagaccaactttattttaacaatgtcatataaacagatttttaaaaacattgaacagattgtagctttaaaaaatacacaggtataaatgagtttttttttgttttgatttttttaaatacatatatatatgtgcatatatatacatatatgtatatacatatatatatacacatatatatatatatacacacacacatatatatatatatatatatatatatatatatacacacacacacacacacacacacacatatatatatatatatatatatatatagcagcatcctgggcagctaatgctatctcatggtgacaagtttcatgttaagttggatagtctttccaattgactcaattctatttcctccccacccataataccagtattttatagaactagctttttaaaaaataagaatttggcattttggaactttgtcccatgtgagacattgtgctttaaactgcccctttctaaaaatgaccctaaactcaaacagatctcagtgtctgcgtttcaactaacttggataccatacatagcaaaagcacagttgttaaaaccagcagattttttcttccaaaggaacatcagtaggacttcccaaacatgttactagttcataaccagctatatgacaaagcaattggttccccacagtgacagctcacataaacacattttgactcgacacactgaaaacaaggatttccaagctaagcaagtcatcagaccagctccctaaaaggagtaacttttaaaaacacaaaaaagccaaagaaatatgaacttctcacttcacttacaaacaattttcacctttgtaagacaaaacaaagcaacctcaaagggaaaaatcccatacacataagtaagaattgtactagacgttcgcttgttatgtactttatgtacttgaactcaacaactactgtggatctgttttggctgaaaggtgtactggaaacacagtccatgcacatatacatatatacatttatcaaaggccatgaagttatcagatgttgcaaacacatgctttttgccttttcacatggttatgatctctcgtgtgtgtaatgtgag

SEQ ID NO: 3215 - DNA, 456 bp, Homo sapiens
tcttttttttttttatttttaagtattcacttcaagttttattctgcctctggcatggtcttttacagtatgtatattcacatatatatatatatacacacacacacatatatatatatatatatatatatatatatacacacacacacacacacatatatatatatatatatatatagcagcatcctgggcagctaatgctatctcatggtgacaagtttcatgttaagttggatagtctttccaattgactcaattctatttcctccccacccataataccagtattttatagaactagctttttaaaaaataagaatttggcattttggaactttgtcccatgtgagacattgtgctttaaactgcccctttctaaaaatgaccctaaactcaaacagatctcagtgtctgcgtttcaactaacttggataccatacatagcaaaagcacagt

SEQ ID NO: 3216 - DNA, 409 bp, Homo sapiens
ttttttttttttttttttcagtttcaaaacaacctttattctgtttgaagatctaatacaatgcattaaagcaacttaaaacaagacatagctccattgaatctataacttgaacgaaatgtcaaggaggcacactacccccacccataataccagtattttatagaactagctttttaaaaaataagaatttggcattttggaactttgtcccatgtgagacattgtgctttaaactgcccctttctaaaaatgaccctaaactcaaacagatctcagtgtctgcgtttcaactaacttggataccatacatagcaaaagcacagttgttaaaaccagcagattttttcttccaaaggaacatcagtaggacttcccaaacatgttactagttcataaccagctatat

SEQ ID NO: 3217 - DNA, 496 bp, Homo sapiens
gtcagtttcaaaacaacctttattctgtttgaagatctaatacaatgcattaaagcaacttaaaacaagacatagctccattgaatctataacttgaacgaaatgtcaaggaggcacactacccccaccccccaccccagttgccttgtgaaggcaaagttacaactgaccgtgacatcctccctctcgtcaaaagaccaactttattttaacaatgtcatataaacagatttttaaaaacattgaacagattgtagctttaaaaaatacacaggtataaatgagtttttttttgttttgatttttttaaatacatatatatatgtgcgtatatatacatatatgtatatacatatatatatacacatatatatatatatacacacacacacacatatatatatatatatatatatatatatatatatatatatatatatacacacacacacacacacacacacatatatatatatatatatatatatatatatag

SEQ ID NO: 3218 - DNA, 510 bp, Homo sapiens
  misc_feature (1)...(510): n = A,T,C or G
ctcaggnctgcttgtcctaagggtagccctttttttattccctttactttcttaataaatttgctttcacttcatgaacttgcactgaattctttcttgccgtgagatccaagaaccctctctcggggtctggattgggacccctttcctgtaacatctttctggtgaccatggaaagaaccatagtgtggaaacccttgactcaaaggtttactttggttaagtgatggggtcctgtaacatctttctggcgaccacagaagtgactatagtgtggaaaccccagacccaaagagtaactttgggtaagtggtagggtctggtaacgtctttctggtgaatcatggaagggacgatactgaggagacccctcaacccaaaagaagtagactgcaccactggttggctgactttgaataagtggtggggtacctgngtaaaggatgggattgggttagaggcccaacgtaggggagttagagtctgtcctaagacacagtgggttagagg

SEQ ID NO: 3219 - DNA, 1633 bp, Homo sapiens
tttttttttttttttttttttttttttttttttttttttttttttttttttttttttttttagaaagatattttattttttaggaaaagagccataattatcttaaatgtgaaaaaccacatccaataaactgatataaagttttaggaacaagggaatatcttattgtcacgcattcacagtgaaacccattttaatgcaggtccagagccaactgcagtcctgtccaatcccataggtacaagggcctggctcctcttcctgtgtactgcccgacttcctcatcttactgggtccagcataaagcagatgtccactgtcttcctcacatgctgtgatcttggcttagaggtaggcacagtgccgctccagcagcgaggggttcgcgttacttaggaacagcagctcttttttcccttcttctgtaggagctttctcatgttgaagccaattgttttccaaataatactgaatacaactttcaaattcctttgggttatagttggaaaccaggatgggaataaagggatccagggcatcaaatccttcctttcccagcaactcctggggcagataggctttccggggcttaaagagagacccagtctggctcaaagccgacacaatggcgcctccatgccaatcatttttcatcattttcctcaagttgtgaacaagtgctaattcctcgggggcaatcgggcttttatcttctcttttcagagtggttcttccccaaagagcattgattccatccacggccactaggaggtgaaacatacccaaagaactttgcctctttagctctttcagcacaattccaactgcatctgtggcgttcctcacccgtgttatgccctgttcaaccacttctcccagaggactccctttctcagtgctttctctcttattccagacatacttctcttgaacttttatctggttcaggaagcgctcatttgtagttttgaaattcttcagccaggttgaagcctctaaaggttgatcaaagcgctgtttgttgtagctggactgcagaagatcccgacaatttttcacccaaagatgagcatctggaatatgtagtatcagccagtcctgttttgcacagaaatgaataacatggcaaagacttagggtttttcctgttcccttctctccatacagaagatatcgtatagctggataagcaaaactggtgtttttcaggtaatgcagaagttctagggctggtttccttaccatcaggcaagcttcactgaatgtcttcacctgcatcacaaagcgaggaggaaggccatggggaaatacagtctccaaatcctggggggagatgttgtagtgctgaccctcgtgctgatccccatgcttggccgggtcattctcattggtgcgggaaatagctctcggactctcaactggaacctggttatctaggtgagcagcaatgctttggcgagcctgggtccccatgtgtaaaaaacgcccagggtccaacttatggatcctagagataagccttgttattcctttcagcatcatccttgcacgtgagtcgaggactagttctccagactaggcgaccgacacacgctgcctggggccggctccaaagcgcccgtcctgagactgc

SEQ ID NO: 3220 - DNA, 2150 bp, Homo sapiens
  misc_feature (1)...(2150): n = A,T,C or G
atttatttatttatttatttatttatttatttatttatttattttgagacggagtcttgctctgctgcccaggctggagtgcagtggtgcaattttggctcactgcaacatccgcctcccaagttgaagcaattctcctgcctcagcctcccaagtagcttggattacaggcgcatgccaccgtgcccggctaatttttgtatttttagtagagacaggttttcaccatgttgcccaggctggttgcaaactcctgaactcaagcagtctgcccgccttgggcttccaaagtgctgggattacaggcatgagccactgtgcccagccagctgtgaattttgacatgctgaattccataaagcctcaacagaaccactggaaatttctgtagaattgatctcttctgacctgcaacaagaggaatatcagagaaatgcaatttggccaatctaaagactccttccatattattaatctaacacaacactttagaaagatattttattttttaggaaaagagccataattatcttaaatgtgaaaaaccacatccaataaactgatataaagttttaggaacaagggaatatcttattgtcacgcattcacagtgaaacccattttaatgcaggtccagagccaactgcagtcctgtccaatcccataggtacaagggcctggctcctcttcctgtgtcatcccgacttcctcatcttactgggtccagcataaagcagatgtccactgtcttcctcacatgctgtgatcttggcttagaggtaggcacagtgccgctccagcagcgaggggttcgcgttacttaggaacagcagctcttttttcccttcttctgtaggagctttctcatgttgaagccaattgttttccaaataatactgaatacaactttcaaattcctttgggtatagttggaaaccaggatgggaataaagggatccagggcatcaaatccttcctttcccagcaactcctggggcagataggctttccggggcttaaagagagacccagtctggctcaaagccgacacaatggcgcctccatgccaatcatttttcatcattttcctcaagttgtgaacaagtgctaattcctcgggggcaatcgggcttttatcttctcttttcagagtggttcttccccaaagagcattgattccatccacggccactaggaggtgaaacatacccaaagaactttgcctctttagctctttcagcacaattccaactgcatctgtggcgttcctcacccgtgttatgccctgttcaaccacttctcccagaggactccctttctcagtgctttctctcttattccagacatacttctcttgaacttttatctggttcaggaagcgctcatttgtagttttgaaattcttcagccaggttgaagcctctaaaggttgatcaaagcgctgtttgttgtagctggactgcagaagatcccgactccgtcttctccccaaagatgagcatctggaatatgtagtatcagccagtcctgttttgcacagaaatgaataacatgcaaagacttagggtttttcctgttcccttctctccatacagaagatatcgtatagctggataagcaaaactggtgtttttccaggtaatgcagaagttctagggctggtttccttaccatcaggcaagcttcactgaatgtcttcacctgcatcacaaagcgaggaggaaggccatggggaaatacagtctccaaatcctggggggagatgttgtagtgctgaccctcgtgctgatccccatgcttggccgggtcattctcattggtgcgggaaatagctctcggactctcaactggaacctggttatctaggtgagcagcaatgctttggcgagcctgggtccccatgtgtaaaaaacgcccagggtccaacttatggatcctagagataagccttgttattcctttcagcatcatccttgcactcctggaggtccggagtcccgctcctttccctcagcggtacaatacccgtgtcggtccattccctcaccgtgagtcgaggactagttctccagactaggcgaccgacacacgctgcctggggccggctccaaagcgcccgtcctgagactgcaaaaaaggccgggtcantc

SEQ ID NO: 3221 - DNA, 533 bp, Homo sapiens
agaaagatattttattttttaggaaaagagccataattatcttaaatgtgaaaaaccacatccaataaactgatataaagttttaggaacaagggaatatcttattgtcacgcattcacagtgaaacccattttaatgcaggtccagagccaactgcagtcctgtccaatcccataggtacaagggcctggctcctcttcctgtgtactgcccgacttcctcatcttactgggtccagcataaagcagatgtccactgtcttcctcacatgctgtgatcttggcttagaggtaggcacagtgccgctccagcagcgaggggttcgcgttacttaggaacagcagctcttttttcccttcttctgtaggagctttctcatgttgaagccaattgttttccaaataatactgaatacaactttcaaattccctttggttatagttggaaaccaggatggggataagggatccacggcatcaaatacttccctttttacccatcctgtgggggaaagatttttttgggggtttaaa

SEQ ID NO: 3222 - DNA, 1044 bp, Homo sapiens
tgatgatcaagttaatattttaggaatccaggggaagggcatacaggaatatgatttttctctaagtctgaaattatgtcaaaatacatagattaataaaaatatttttctttaaacaggataacaatctaagtagaaacaaattttcctttgacttgacctttcccagcaactcctggggcagataggctttccggggcttaaagagagacccagtctggctcaaagccgacacaatggcgcctccatgccaatcatttttcatcattttcctcaagttgtgaaacaaagtgctaattcctcgggggcaatcgggcttttatcttctcttttcagagtgggtcttcccccaaagaggcattgatcccatccacggccactaggaggtgaaacatacccaaagaactttgcctctttagctctttcagcacaattccaactgcatctgtggcgttcctcacccgtgttatgccctggttcaggaagcgctcatttgtagttttgaaattcttcagccaggttgaagcctctaaaggctgatcaaagcgctgtttgttgtagctggactgcagaagatcccgacaaatttttcacccaaagatgagcatctggaatatgtagtatcagccagtcctgttttgcacagaaatgaataacatggcaaagacttagggtttttcctgttcccttctctccatacagaagatatcgtatagctggataagcaaaactggtgtttttcaggtaatgcagaagttctagggctggtttccttaccatcaggcaagcttcactgaatgtcttcacctgcatcacaaagcgaggaggaaggccatggggaaatacagtctccaaatcctggggggagatgttgtagtgctgaccctcgtgctgatccccatgcttggccttatggatcctagagataagccttgttattcctttcagcatcatccttgcacgtgagtcgaggactagttctccagactaggcgaccgacacacgctcctggggccggtccaaagcgcgcccgtcctgagactg

SEQ ID NO: 3223 - DNA, 712 bp, Homo sapiens
ttttaaaaaccaaggcttctaatcaaaatattgcttctatttagctcaggagtgtactatgattttgcttttgtgcagcatattaactattttcatgatattttgccaaggcaaattttaagttcatttaaaacagttatttgatgctgaaattactggaatcttcttgggctatacaaggaggaaaacatcaatattgtttaaacatgagcttaaagtaattgtactagtcacaaaaggtaatcaacacatgaatttctgtttttcagattaaatttcatctttttaaattttcttctcatttagccccacccctttgctagcagcagcttgtattctgggctccctccaattccattccctgtcttgagcacctgcatcacaaagcgaggaggaaggccatggggaaatacagtctccaaatcctggggggagatgttgtagtgctgaccctcgtgctgatccccaagccttggccgggccaattctcattggtgcggaaatagctctcggactctcaactggaacctggttatctaggtgagcagcaatgctttggcgagcctgggtccccatgtgttaaaaacgcccagggtccaacttatggatcctagagataagccttgttattcctttcagcatcatccttgcaccgctggccgcctcctgacaagcgggagggatccgcggtggacccagggaagcggaggag

SEQ ID NO: 3224 - DNA, 476 bp, Homo sapiens
agatgacagtgtgtcccagaaagcccaggattcaatcgctgagagagtgcttaggcccgaatgccggcccaaatcgttctactcaccgtgtcggaggccgagagcgatgagagtacagggaagtgaggaagagggggtggcgccactcctccgcttccctgggtccacgcggatcctcccgcttgtcaggaggcgccacggtctcaggacgggcgcttggagcggcccaggagcgtgtgtcggtcgcctaatctggagaactagtcctcgactcacgagatgaagttttaccatgttggccaggctggtctcgaattcctgacctcaagtgatctgcccaccttgacctcccaaagtgctgggattacagtgcaaggatgatgctgaaaggaataacaaggcttatctctaggatccataagttggaccctgggcgttttttacacatgggggaccaggctcgcaaaagcattgct

SEQ ID NO: 3225 - DNA, 484 bp, Homo sapiens
  misc_feature (1)...(484): n = A,T,C or G
gttttgccaacagaaangaaataaacanggcaaaagacttagggtttttccctgttccccttctctccccataacagaanaataccgtaatagctggaataancaaaaactggtgtttttccaggtaaatgccagaagttcctagggctggtttcccttaccatcaggcaagcttcactgaatgtcttcacctgcatcacaaagcgaggaggaaggccatggggaaatacagtctccaaatccctggggggagatgttgtagtgctgaccctcgtgctgatccccatgcttggccgggtcattctcattggtgcgggaaatagctctcggactctcaactggaacctggttatctaggtgagcagcaatgctttggcgagcctgggtccccatgtgtaaaaaacgcccagggtccaacgtgagtcgaggactagttctccagactaggcgaccgacacacgctcccggggcccgcccccaagcc

SEQ ID NO: 3226 - DNA, 342 bp, Homo sapiens
ccttaccatcaggcaagcttcactgaatgtcttcacctgcatcacaaagcgaggaggaaggccatggggaaatacagtctccaaatcctggggggagatgttgtagtgctgaccctcgtgctgatccccatgcttggccttatggatcctagagataagccttgttattcctttcagcatcatccttgcactcctggaggtccggagtcccgctcctttccctcagcggtacaatacccgtgtcggtccattccctcaccgtgagtcgaggactagttctccagactaggcgaccgacacacgctgctggggccggctccaaagcgcccgtccctcgtgccg

SEQ ID NO: 3227 - DNA, 949 bp, Homo sapiens
tttttttttttttttttttttttcttttttttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaaagaaggagtcggggccgggcgtggtggctcacgcctggtaatcccagcactttgggagaccaagtcaggcaatcatctgaagtcaggagttcaagaccagcctggccaacatggttgaaagcaatttggtttttcccct

SEQ ID NO: 3228 - DNA, 901 bp, Homo sapiens
  misc_feature (1)...(901): n = A,T,C or G
cccaggctggagcgcagtggtgcgatctcgactcactgcaacccccgcctcctgggttcaagcgattctcctgcccccgcacccagcctgtttctctttttccactcttcttttttctcatctcttttctgggattctgtcggctttcttatctgcctgttttgcaagcaccttctcctgtgtccttgggagccctgagacttctttctctccttgcctccacccacctccaaaggtgctgagctcacatccacaccccttgcagccgtccatgcctatcagcccaaggggccccattgccaaagcatgcctgcccaccctctctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatttnnccccngnggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaaaanctcgagggggggcccggtacccaattcgcctatagtgagtcgtattacaattcactggccgtcgttttacaacgtcgtgactgggaaaccctggngttaccaacttaatcgccttgcagcacatcccctttcgccagctgggtaatagcgagnggccgcaccgatcgccttcccaacagttgcgcnctgaatggggatggcaattgtaag

SEQ ID NO: 3229 - DNA, 435 bp, Homo sapiens
  misc_feature (1)...(435): n = A,T,C or G
ccctgggttcaaagngaattctcntggccctaagcnctccnaaagtaagctggnaggaacaggttgttgaatgccgcaacccaagncctgtntctctttttccactccttccttttttcctcatctcttttctgggttaacctgttggctttccttaatctgcctgttttgcaagcaccttctcctgtgtccttgggagccctgagacttctttctctccttgcctccacccacctccaaaggtgctgagctcacatccacaccccttgcagccgtccatgccaacnancccaaggggccccattgccaaagcatgcctgcccaccctcgctgtgccttagtcagtgtgtacgtgtgtgtgtgtgtgtgtgtgtgtgtgtntgtgtgtgtgtgtgtttggngggtgggtngtnggtagctggggattgggccctc

SEQ ID NO: 3230 - DNA, 363 bp, Homo sapiens
ttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgcgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggccatcttaaaggaagcaggggctggatgcctttcatcccaactattctctgtggtatgaaaaag

SEQ ID NO: 3231 - DNA, 425 bp, Homo sapiens
acttctctaataaacttgcttttactttattctgcggatttgccccgaattctttcttgtgtgagatgcaagaactctctcttggggtctggattgggacccctttctggtaacaaagaccccatggaccaagggcataaaaagaagggatgtctaagacttgctggttctatggcaggcagaggcagaaagagccccaccatcattcccagcaaatgggaaaagttcccagttgcagatattaggggtgggatgggcgggggggtagtcagcatccatagacttagaccctgaagaggcaaaaaaggagggccatgttctctgggtcagcagagcttctactcagcttcttcagcctctagctctttcctggtgctagtagcacattctctagtggaggcatccagatggcagggagggtccag

SEQ ID NO: 3232 - DNA, 953 bp, Homo sapiens
gtttttcccagattcaatactttcacagtattttattccaataacagtttgctcatgtttagaatggaagaatgattttccatgtacctgaaacccattaggattatttctagcataatcactagtgaaatctatatatttcaaactctttccatgcgtgccacatttatgaggtttttgtcttgaaagatactttgtactaagaagacatagttttccaaatgtagtgcattcaaagctttttgccgtacttcccagcttgtctttattttcctgatgccaatccataagatcatcaattttccagactgtgattggacaggtctgatttggaacttgggcctgcaccatacacagctcttctccttgttccaacttgaagatgatatcaggtttggtgtgttggtaccctagggacaccaggttgctatagttctccaacatcacactcctgtacaggcacttcctgtgctgggtctagcagctgccacttcctcccaggtaaaatccacaaacacatccatgaatgacaaaggtccccaggacttggtgatttttggctgctcttgggaaataaacagccactctaggactttctctattctgcgactcttctgcttctgcctgggtgttccagggagaggttgcagaccaggagtcccttggcccaagatggattcctgaccttggagctttctgatcctatcccatgaactgtttcgttcttggagaggtgggacccaaatagaagctgtccggaccctggtggccatccctacggtcagttttgtgtgcctcgctggaagtgacaggacgcgagggatgctccggctcctccaaaccctgaaggggcagcagaatagagtccagggtactgcctccacctccagatctgcagccagaagggttcgcaaccactccagactcggctggcccgttgaccacgacgggcg

SEQ ID NO: 3233 - DNA, 377 bp, Homo sapiens
tttgagattcatatttactttaatagctgtgatcctgggccttatagctgttacagctactgctgctgctgctgttgctttgcactcttctattcaaactgcaggctttgtggatagttggcagaaaaattcttctaagctttggaattcccaaagccaaatagatcaaaaattggcaaatcaaattaatgatctctgtcaaacagtaatttggatgggagattggattatgaatttggagcatagaattcaaatgcaatgtgattggaatacttctgatttttgtattactcatagctcctataatgccactgagcaccattgggcgatgattagacatcaccatgaacatgattattttctcacagtgctctctg

SEQ ID NO: 3234 - DNA, 8713 bp, Homo sapiens
  misc_feature (1)...(8713): n = A,T,C or G
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggtgagtgcacatgtgtggtgaggaggtgtttgcagtgcttcaggcgcagcaactctttcatctagtttaaaattgtgctctgaggttagattttagtagaacaaaggccttacaaagaatgtgaaaacattatgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatggtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaaggggggctgcagaagggcggagatctgttttccgtaactacttcctgctgagtttatggacgtaggccctgcctggcactggaggagtaaaaatctctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtagcaaagccaccccagggtgctgctagtcctattgccaccctgattcctgccagaattaagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttagggggaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctgggaagggagaatcctggttgcagtatgcttcccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggacgtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgcattagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacacccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttggggaggaaaggaaatttgcaggaaactgcttaaggacccaagtgtgggaggatgttcaagcttagtttcacacttcttgagggcttcaggattttgttaggggnccttgccaccatttgttccaggttccttttgggggtttggggaggttggaaacc

SEQ ID NO: 3235 - DNA, 660 bp, Homo sapiens
  misc_feature (1)...(660): n = A,T,C or G
cacgtgctgtcatggagacnctcctggtcctcagangtctctgtatgtccccgacctcagactctggacgtggcgaggagtgtatggcatccaatctacanctggttgagcactggagatcgatgctgccatgttgacctccactgcagacaccccactctgtctacagtgtagcccccctgaagtataaggtggtcccggacccctccctctcccagatggatgtgccctccatcctaccatctccaataggaaattcgtagaccatgtaagtgcattctctgaatagggagtttattaaagtgggtgggttgtggaggaacgtgaggtgggtcagagaggcctggacagggggaaggttcatcacagtcaagactcactctatggattgtaacccatcattgggtgtagatttgtcttaacatggcagagttgatatcatgggaagagcaatagggaaggaaccattagacctggatttagtgacaaatctgatgtgtgaccttaagcctcataagcctttcttaatcttagtcattccaatagtaaatgaaggaggttggatgagagtagcagtgagaaaatcatttattactaatgaaagtagaagaactgaagtttgctaatgattttctttttatattaaattgaagacaattt

SEQ ID NO: 3236 - DNA, 514 bp, Homo sapiens
  misc_feature (1)...(514): n = A,T,C or G
gctctatgtgaatggtgcccaggtggccacctctggggaacaagtgggtggcatattcagcccactgacccagaagtgcaaagtgctgggattgcaggcgtaacagacacacccggccttatttaccatctttaatccattttagtactatgggtgagtacatgggaattgaagtctggcttaaatcttcagaaagttatatatctattttattttatttttttgaggacagagtctcgctgtgttcacccgggctgggagtacagtgccacaatcttgggcttcacttgcaacctctggagtcccaggtttcaaggcgatacttcatgccttcagcctcctggagtagctggggactacaggccttgcaccaccacaccggggttaatttttttgtattttttagtaggagancggggttttcgccngtttgcccggggttggtcttttcccgaggttcagggcatcgggccacttggccttttgaaagtgctaggattncggggattagcca

SEQ ID NO: 3237 - DNA, 508 bp, Homo sapiens
  misc_feature (1)...(508): n = A,T,C or G
aaaaanaattaaaaaggtcctttgaaacctccccaaaaataaaangaaataatgaaaaaangttccaaatattccataaaataaatacccaaaaatanttaatttccattgtaactttcccgacttgccttccagtgaaaggtgtccccaggtgaggaatganggtaatccccaggtgagtgagggtgtccccnggtgaagtgagggtgtcagggtgaagtgaacgtgtcccagggtgaagtgagggtgtcccagggtgccagagtgaggtgtcccagggtgaggagtgacggtgtctggggtgagtgagggtgtcccagggtgaggagtgagggtgtcagggtgagtgagggtgtccagggtgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttac

SEQ ID NO: 3238 - DNA, 485 bp, Homo sapiens
  misc_feature (1)...(485): n = A,T,C or G
caaggctgctacctcgagctggagttcctctaccccttggtccctgagtctctgaccatttgggtgacccttgtctccactgactgggactctagtggagctgtcaatgacatcaaactgttggctgtcagtgggaagaacatctccctgggtcctcagaatgtcttctgtgatgtcccactgaccatcagactctgggacgtggggcgaggaggtgtatgggcatccaaatctacactctgggatgagcacctgggagatccgatggntgccatgtttgacctncactgcaagacaccccantctgttttacaatgttaaggcccttgaagtattaagggttggttcccgggaccttccttttccaaattggacaactntggggncttccattcttacattttcaatagggggaattngtagggacanttaaagtngcattttttttgantagggggntttttttaatnggggngggtttttgg

SEQ ID NO: 3239 - DNA, 689 bp, Homo sapiens
  misc_feature (1)...(689): n = A,T,C or G
taancaaacaaccnacatttcccanaatctggggaaactccttgaaatccnctttaaaggcctgaatctccgttggtggctaaggattctaggatttgagccaagttctttagcgttaactcatggtagcaaagccaccccagggtgctgctagtcctattgccaccctgattcctgccagaattagttttattgcttacttatttctgatattcttgggtcctaggcgttatagattgtgacccctggaggggtaagagtggccaacgttcattcatgtcagttccaagttttttagatacaagggaaagctattccttaaagaagaggtgactccttagggagttggagtggttacagggtgtgacttcttcccattcatagtcacaaacaaaaatgaacccaactagggcaccaagagaaggctgcggggtgcgatgtttatacttcattgccaggttgggtctatagagatattttccacctgttcctcatggtggtggttgaacaatctttgttttctagaagaaggtagtactgtcaccttcccagatcaggcagttgtttttcctttgtatgtntccatccgggagaaggtaccatatatggtcttttcactcacaaatggaatctcatttacctccccgtggtcttggaaacttggcaactagagttggaccagagcatcg

SEQ ID NO: 3240 - DNA, 754 bp, Homo sapiens
  misc_feature (1)...(754): n = A,T,C or G
aaaggggggggaaaggggccccagggtttaaaaaaattnaaccaaagggtgcccaaaggtaaaagggccaagccctttgtcaagcttggaaaactgtntccctacttcccaacctttggggccnancagagnacccagttgaaaagaagggcaaaagacattgcagtaagtaagcaccaggncaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaac

SEQ ID NO: 3241 - DNA, 447 bp, Homo sapiens
agaatctgcattttattatatcccttgagtcccctttaagcagccacgctggccccagccattggactctatttggaggccactgcagaggccagatgcccctctgctcggcggtttcctgtgcagaaaggctgtgttctttcttcttcctaaatactcttcctaggttaagtgtttccttctctttgcccatctagaaaatctccacctcaagcaggtcgtgttccaaaaactcctcgtgttgggcaagtggaaaacacgcagttttttctaggggtctcattctgaggcggtgctgctgaaaatcttggtgctgaacgtgtgtttttgagatttccagtctgatctaaggagcccagaggcaggacgatttcattctccgtgtcagtggacaggatgggctggaagccttgtgccagcattgtctctggaactgtggtaatctga

SEQ ID NO: 3242 - DNA, 425 bp, Homo sapiens
  misc_feature (1)...(425): n = A,T,C or G
taagcacaagntgggctccttctgcaaatacnaatgcaaccctggataccatgtnccctggaatcctctcggaagtcaaagaaacgggccttcaagactcagtgtaccccaggatggcagctggcaggagggagcttgtgttcctgtgacctgtgacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtnacacaaccacagcaagaaaatngatctat

SEQ ID NO: 3243 - DNA, 459 bp, Homo sapiens
  misc_feature (1)...(459): n = A,T,C or G
aaantaaaanaaccccctcccctaaancccttaaanggggccctgccaaaaaanggccggaaagancctgttttcccccgtaaaacctacctcccctgcctaanttttatggaccgtaagncccctccccctgccactggaggagtaaaaaancctcctggaataccctgatcctaaggaacccccagaggcaggaacgatttccattcncccgtgtccagtggacaggatgggctggaagcccttgtgcccagcattgtcctctggaactgtggtaatcctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttgngggcagtgccctggttatatctatgtaactaggtagc

SEQ ID NO: 3244 - DNA, 464 bp, Homo sapiens
  misc_feature (1)...(464): n = A,T,C or G
gtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgatcctacaaggtgactgtgcttgtcgggacccccagggcccaaggaacacagccgggaaaagacctccgggggatacagccatgggttaagggaagggacaaggaagttgttcaaaggaatttccccaacgccccaggggccccacattcccttttggtatttgattttcacagttcagcttgnttcaacgggnatggggctttttccacaccggggggattcctttgggggaaacccaaccggtcttgccttttaatttttttaccnggggggagggantttcacatttgggg

SEQ ID NO: 3245 - DNA, 417 bp, Homo sapiens
  misc_feature (1)...(417): n = A,T,C or G
gcnaaaaantaacccctcaccnaaagggaaaaaancttgcggccncctaantaaagaacntttttttttttttttttttttttttttgctgtaacagtgtttattgatgatgagtcccagggtgaggagtgagggtgtcagggtgagtgagggtgtccagggtgagtgcacatgtgtggtgaggaggtgtttgcagtgcttcaggcgcagcaactctttcatctagtttaaaattgtgctctgaggttagattttagtagaacaaaggccttacaaagaatgtgaaaacattatgcttccctgcttacaggcaattaaaaaggagaatcaagctgagggtgcctggtgtggggtggggtggagaagaccacagagactattgtgtgttttattcaacagtgtcctgggctgctttcc

SEQ ID NO: 3246 - DNA, 395 bp, Homo sapiens
tgttttttttttttttggtatttgtatccacttttaattatatgcaaatgaaggggcagtttatgcagacatttccagggtgagggtggtaacttctgggtgctgccagagccatggtgaactgacttgacacaggtcggtgtgtcctatggaaactagcatctgccctggacctattttagctagtgctcagtttggtctgagtgcctggcactggaggagtaaaaaatctctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttg

SEQ ID NO: 3247 - DNA, 397 bp, Homo sapiens
  misc_feature (1)...(397): n = A,T,C or G
ttgcnccaaagnggaaatggncctttccccaaancccccgggggancccttaagcccccaaacggggcctgccccttaaaattttnccccccccagnagggcctcanattggggncggaatgaccccaagtttcccccatgctggatgatgaaatggattccccatccccaaagtctagatggattgcatatacagtgtgcagtccccagagcctccctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaaaaa

SEQ ID NO: 3248 - DNA, 368 bp, Homo sapiens
gactgacatgaataagatcaatggtgatggctgctcccttttctgccgacaagaagtctccttcaattgtattgatgaacccagccggtgctatttccatgatggtgatggggtatgtgaggagtttgaacaaaaaaccagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatgggggacaaaagcagggagaccatcagcg

SEQ ID NO: 3249 - DNA, 510 bp, Homo sapiens
  misc_feature (1)...(510): n = A,T,C or G
ccaatctctgccagacggacttgtacttccctctttccaggcacaagatgaaggcctcttgcaatgggctggagaaatcagtcgctacaacaccccttgcagacacaggctggagctgcaagtcctgggagagacctgctctatcttctctggcaattgtggccactactagaggagctcaggcaggcaaaatctgttacaaggcagactgaatcaagccaagatcaacacacactggtacacgtggctcccaaccaattttatatgtatatatatattctacttccaacacccgcattcatcctggttcaatcaaagcctggttttggccaacaataaactcgtcatggagatcgaaggttgtagatgtctgcacgtggcttccttggaggtccagtggtgactccctcttccaaaatccattctgtacncgctggctgctctaacgggcaggacaatagcgtatgaagcctgactgcaactaggagaagtaccacacntccggnaccg

SEQ ID NO: 3250 - DNA, 615 bp, Homo sapiens
tttttttttgatttaaaagattttattttctttatgcaggtaggcagttagaaatttcaaagtctaacaatgacattcttgaagtgggcacagccttttaaactcaggctatgtatacagtaaccttgtggaactggttcagccagatcttcactttcatgaaagcacagggtctgtccttttctttccagagggctcctctcatattccatcgccagtttctaagaaagaaggtggattacaatcagtgctccattctggtctataccgcttcttgtttagggtatgaaaatacatgtgactaagacctggtcactccaagtccatcccctttatcggtacggccaagtaccgataaacggagctgggaaacttcccaatctctaataagacaactttaattctgtacttttattgaatcccatattgtacctgcgttggcaaaatgtttaaccttcatctaaaaatgacttcatgtcacagtaaacacagaagacaaaaacccagaatgaggacactaccagtaaaaatcttttaaaggatgagaagctgagcagtggggggtatggctgtagttgcagctactgaggatattgagggtgcgagtttcccgtc

SEQ ID NO: 3251 - DNA, 500 bp, Homo sapiens
tctgtttttgtgttgcttattgcataaggagtctggaagtgacaatgtcagtagcccatgcctggagaaccggccctctgcaggctccactgctgcggtcccagaagtgctggctgcagtgtctgaaaaacttgcccatctgcaccatctctgccagacggacttgtacttccctctttccaggcacaagatgaaggcctcttgccatgggctggagaaatcagtcgctacaacaccccttgcagacacaggctggagctgcaagtcctgggagagacctgctctatcttctctggcaattgtggccactactagaggagctcaggcaggcaaaatctaggaaaagaaaaagaagattgagccaatggctaatacataacagagccgggatttaaacccaagtctagctccagagcctatgtttgtttttaacatttttaaaaagcactttcggagggtgaggcaggaggatcacttgagaccaggagtttgagatcaac

SEQ ID NO: 3252 - DNA, 618 bp, Homo sapiens
  misc_feature (1)...(618): n = A,T,C or G
cctncaagcgaataagttgggtaccccccagggnttccccagccccgccgttgtaaaccgncggcccagtgaattgtaatccgcccccctatagggcgattgggtnccgggcccccccncagagaaaaaaaattttttttttgatttaaaagattttattttctttatgcaggtaggcagttagaaatttcaaagtctaacaatgacattcttgaagtgggcacagccttttaaactcaggctatgtatacagtaaccttgtggaactggttcagccagatcttcactttcatgaaagcacagggtctgtccttttctttccagagggctcctctcatattccatcgccagtttcaattttatatgtatatatatattctacttccaacacccgcattcatcctggttcaatcaaagcctggttttggccaacaataaactcgtcaggagatcgaaggttgtagatgtctgcacgtggcttccttggaggtccagtggtgactccctcttccaaaatccattctgtacccgctggctgctctaacgggcaggacaatagcgtatgaagcctgactgcaactaggagaagtaccacactccgagcaccgcgttcgtgcc

SEQ ID NO: 3253 - DNA, 567 bp, Homo sapiens
tttttttttttttgatttaaaagattttattttctttatgcaggtaggcagttagaaatttcaaagtctaacaatgacattcttgaagtgggcacagccttttaaactcaggctatgtatacagtaaccttgtggaactggttcagccagatcttcactttcatgaaagcacagggtctgtccttttctttccagagggctcctctcatattccatcgccagtttctgttacaaggcagactgaatcaagccaagatcaacacacactggtacacgtggctcccaaccaattttatatgtatatatatattctacttccaacacccgcattcatcctggttcaatcaaagcctggttttggccaacaataaactcgtcaggagatcgaaggttgtagatgtctgcacgtggcttccttggaggtccagtggtgactccctcttccaaaatccattctgtacccgctggctgctctaacgggcaggacaatagcgtatgaagcctgactgcaactaggagaagtaccacactccgagcaccgcagacgcgaaaaaaaaaaaaaaaaaa

SEQ ID NO: 3254 - DNA, 406 bp, Homo sapiens
tttttttttttttttttttgatttaaaagattttattttctttatgcaggtaggcagttagaaatttcaaagtctaacaatgacattcttgaagtgggcacagccttttaaactcaggctatgtatacagtaaccttgtggaactggttcagccagatcttcactttcatgaaagcacagggtctgtccttttctttccagagggctcctctcatattccatcgccagttttcgtcaggagatcgaaggttgtagatgtctgcacgtggcttccttggaggtccagtggtgactccctcttccaaaatccattctgtacccgctggctgctctaacgggcaggacaatagcgtatgaagcctgactgcaactaggggaagtaccacactccgagcacccctcgtgc

SEQ ID NO: 3255 - DNA, 487 bp, Homo sapiens
gatttaaaagattttattttctttatgcaggtaggcagttagaaatttcaaagtctaacaatgacattcttgaagtgggcacagccttttaaactcaggctatgtatacagtaaccttgtggaactggttcagccaagatcttcactttcatgaaagcacagggtctgtccttttctttccagagggctcctctcatattccatcgccagtttcaattttatatgtatatatatattctacttccaacacccgcattcatcctggttcaatcaaagcctggttttggccaacaataaactcgtcaggagatcgaaggttgtagatgtctgcacgtggcttccttggaggtccagtggtgactccctcttccaaaatccattctgtacccgctggctgctctaaccacacacaaaacgggaacttacgggcaggacaacagcgtatgaagcctgactgcaactaggagaagtaccacactccgacacc

SEQ ID NO: 3256 - DNA, 545 bp, Homo sapiens
  misc_feature (1)...(545): n = A,T,C or G
ntaaaagattttatttctttatgcaggtaggcantagaaatttcaaagtctaacaatgacattcttgaagtggcacagccttttaaactcaggctatgtatacagtaaccttgtggaactggttccagccaagatcttcaactttcatgaaagcaacagggtctgtccttttctttccagagggctcctctcaatattccatcgccagtttctgttacaaggcagactgaatcaagccaagatcaacacacacgtggtacacgtggctcccaaccaattttatatgtatatatatattctacttccaacacccgcattcatcctggttcaatcaaagcctggttttggccaacaataaactcgtcaggagatcgaaggttgtagatgtctgcacgtggcttccttggaggtccagtggtgactccctcttccaaaatccattctgtacgcgctggctgctctaaccacacacaaaacgggaacttacgggcaggacaatagcgtatgaagcctgactgcaactaggagaagtacngacacntncg

SEQ ID NO: 3257 - DNA, 371 bp, Homo sapiens
gatttaaaagattttattttctttatgcaggtaggcagttagaaatttcaaagtctaacaatgacattcttgaagtgggcacagccttttaaactcaggctatgtatacagtaaccttgtggaactggttcagccagatcttcactttcatgaaagcacagggtctgtccttttctttccagagggctcctctcatattccatcgccagtttctgttacaaggcagactgaatcaagccaagatcaacacacactggtacacgtggcttccttggaggtccaggtggtgactccctcttccaaaatccattctgtacccgctggctgctctaacgggcaggacattacgcgtatgaagcctgactgcaact

SEQ ID NO: 3258 - DNA, 465 bp, Homo sapiens
ttttttttttttttttttttttttttttttgatttaaaaaattttattttctttatgcaggtaggcagttagaaatttcaaagtctaacaatgacattcttgaagggggcacagccttttaaactcaggctatgtatacagtaaccttggggaactggttcagccagagtctaacaatgacattcttgaagggggcacagccttttaaactcaggctatgtatacagtaaccttggggaactggttcagccagatcttcactttcatgaaagcacagggtctgtccttttctttccagagggctcctctcatattccatcgccagttttcgtcaggagatcgaaggttgtagatgtctgcacgtggcttccttggaggtccaggggtgactccctcttccaaaatccattctgtacccgctggctgctctaaccacacacaaaacgggaacttacgggcaggaca

SEQ ID NO: 3259 - DNA, 6540 bp, Homo sapiens
tctagagatcaaaaccaagtaaaacttggcaatggattcttagataatgacaccaaaatcaccagcaatcaaagaaaaattagataaattgggcttcatcggaatgaacatttgtgtatcaaaagacagtattaataaaatgaagacaggccaggcgtggtggctcacgcctgtaatcccagcacttcgggaggctgaggtgggcggatcatgaggtcaggagtttgagaccagcctgaccaatgtggtgaaattccatctctactaaaaatacaaaaattagccaggcatggtggcgcatgctttaatcccagctactcggaggctgaggcaggagaattgcttgaacctgggaggcagaggttgcagtgagcctagatcgcaccactgcactccagcctgggtgacagaacaagactctgtctcaaaaaaaaaagtgaagacagtctacagaatgggagaaaatatttgcaaattctatatctgataaagggttgttatccagagcatatcctaactacaacaacaaaaagacaaacaattaaagcatgggcaaaggatttaaatagacatttctccaaaaaatatacataaagtgccaaaaagcacataaaagatactcaaggctggggagtgactcacacctgtaatcccagcaccttgggaggccgaggtgggtggatcacctgaggccggaagtttgagaccagtctaaccaatacgaatatggtgaaaccccatattttctaaaaatgcaaaaaattagtcaggcgtggtggcatgcatctgcagtcccagctactacttgggaggctgagacaggagaattgcttgaacctgggaggcagagtttgcagtgagctgagatcgcaccactgcactccagcctgggcaacagagcgagacgtcgtcaaaaaaaaaaaaaaaaaagtcactcaacaccattggaaaatgtcaatagggaaatttgcaaatcaataccacaatgaaacaccacttcacacctactaggaggctacaaatttgtgtgtgtgtgtgtgtgtgagagagaaatgttggcaaggatgtggaagagttagaaccctggtacattaccttgctagtaagaatgtaaaatggtgcagttgctgtagaaaacagttttatcgttcctcaaaaagctaagcatagaattgccatctgacccagcaattccacttcagggtatacacccaaagaattaaaatcagagactcagagacgtgtacaccaatgttcatagcagcattttcacagtatccaaaaggtagaagcaatccaagcgtccatccacagacaaatggataaacaaactgtgatatctacatacaatggaatattattcacgtataaaaaggaatgaagttgatacgtgctacaacatgaataaaccttgaaaacatactaagtgaaagaagccagacataaagggacaaatattacttgattccacttataataaagtatctagagaataggcaaatgcatagaagaaaaagtaggttagactttactaggggctgggagaagcaagaaatgggaagtgattgcttaatgggtacagagttcctgtttggggtgatgaaaaaattttggaaactgatagtggtgatggttgcacaacattgctggtgtaataaatgctgccgaattgtacacttcagaatggttaaaatcggaaattttatgttacaaatattttagcacaaaaaattcaagaagtaaataagtaaacttatttttattggagaaagagaaagaaagagaaggaaggaaagaaagaaagaaaaagaagagagaaaaggaaggaagaaagagaaagaaagaagactcagcagtatgttgttcaggcatagatatcaaagagtcaaaactgtatttttaaatttcttgttggaatggaaaacccaaaatgtaaaatgttacatctcaagaggaggtaggaggaaggcataagagaaagacacttaggtaattaaataaattgttaatgacccagcttttgggctgggtagtaggttcattaacgtacattatattattgtgctttatttttaataaaacacatatatgcccacacatatatgtcacatataatatattataagtatcaaataaaatattttaaaatattaaggaggagggagtcacccgaaggacatagtgagaggccccttttccatgaattggatccaacaggtgtgtgtggggatgtgagaatctacatttcaagcgtccataacttctccccagccctgcaggtatgaggcaatagactgcagctcttcagtcataagtaggagcccatttctccacccctggaatctggggttggctctgtgactatgttgaaatagtagcagatgtaacaaggatagtcttgaaacatgcttgtgaattggggtttgactgcttttacagcacccggaatctgggggctaccctgtgaatgagcccaagttattcctccattgctggagaatgaaaggtccccatagagtggaacccaggcattccagctgacagacagccagccccaaatttccagaagtcctccacagatgcatgagtgagctcctgccaagatcagctgaaactgatcctgaccaaaaccacctccagctaagcccagcccacattgctgacccacagaatcataagctaaatagaagatgactgtcctaagctacaaagcgtgaggaacactcataggtagcagatgttaaccagtagaactggtgtgtgcaatgatggaaatggagctgctctggctgaatctggggtgaaggtgttagaattctgctccctaggtccctgggttcctgcatatcctctgtcacagcttgtctttacctgtgctttgccacccaggtcttccttcaatggccagaaggagggagctacaccctacgttttccaaagagaacccgcactgtagactgtgaaggattccactaaacctggagcacttctgtcctatggcatcctcatgccctcctccccctcccacctcatccagtccatcatccctccccacagaaactgtcaaatctcagcctctcacagtcctctatctagagtcttgcaaatgtcacagccccaggcttcttttttcttttctgtccagttgctgctacttttccacagagggaagagatggcctctatttctgcagctctggggtcctcagggaagtggggagaatgctggtcctatgaaatggagggagagacttcctcctcagactggtgccctcctagggtgtctaaaatgaaacatttctcaccacttttgtagaacaattgtttactcaccaggtacgtgaaaattcacgttcctcctctgaacataccctgaactctattactctgaccccttgtcttgggcaacaggggagcattcacacacagccttcctgccctgggcatctttcattaacttgaggagaaacagaatccagcccaaaaggcttctctctatcactggacaagtcaagatgggagatagcaagtcagaagactccaccaaggaaagtaggcatatattttcttgggagaatagaaagcaggaaagcttgaaatattaataggccaggacagcagttgacagaggagcttgaaggggagagttttgattttagaaggaaaatatgatttttaaaagttcactctgccagccaggcatagtggctcatgcctgtaatcccagtgctttgggaggccaaggcgggtcgattgcttgagcccaagagttggagaccatatggaataaaatgggcaacatggtaaaactccgtctctacagaaaatacgtaaaaaattatccaagaacagtggcacatgcctgtagtcccagctactctggaggctgaggtgggaggattgcttgcacctgggagttgaggctgtagtgagctatgatcatgccactgcacttcagcctgggtgacagtgagaccctgtctcaaaaaaacaaaaagtttactctgccattacaaaagtcttgaaattttataagctaccaaaaaataaaaataagaaataagtctccgataatttcaccacctcaagacaaccaataaccactattaacattttagtgttacttcctttcagattttctctgtgcatacttttacacaattttgatcattctttatatagaattttttggcctaaccttttcatctgttagaaatgcaaaatgcttgttccccagtgccataaagaaatagcacttgaacataaatttaattctctcagcaaggcaatttttactttctgcagaaagggtgcccatcacagatggaacaaagacaagagcacacttgaacaaaggaggtacaaaacatttatatctgacccatccagaccctactgctgtgtcctgattccattggctggaactggacctgacagtctaggcagcacccagttggctaaaggtttaaaactttttctaaagaggtaatggcagaggagaagaaaggaaaagaggaagttgcttatgaaaagactcagaaaagtaataacattcccaaataaggaaggggcataggctgcaagctgtgacatgcctgtgcacaggtctagcacagatatcttggttaaagtacagggacatagaatgtatttaattttcttacatttaataactacataggatagggcttaacaaagagttattagcacaaagcaaggaagtttgaaggaagttagtttttaaaagaaactattatctctaacacttatgatttattctttaacaagaagggaaattttgaagaggaactttttgctttctacatcacccaatgttgtaggcattttccatgttgtagaaaactcttaaaacattttaggccaggcacggtggctcacacctgtaatcccagcactttgggaggccgtggcaggcagatcacgaggtcaggagtttgagaccaggctgaccaacatggtgaaaccccatcctactaaaaatacaaaaattagccaggtgtgatggcgtgcgcctgtaatcccagctactcaggtaggctgaggcaggagaatcacttgaacctggggggcggaggttgcagtgagccaagatcgcgccactgcactccagcctgggtgacagagcgagactctgtctcaaaaaaaaaaaaaaaaaaaaaatcttaaatgctatattatactcctaacttaaggaggtatcacatgtactttaattttactgttataaatagcttgcatacacacagggaagtgaggtaaggagaccacactcattttactccatttggatgtacaattgatccagcatcatttactaaaaataccaaaccttaagtgttcatctcaatgaatctttatagtatgaaatatttctagcaccccagaaaactcctttgggttcctctcagcccacaccccacccctaccaaagtaaccactgtcctgacatctgtcatgatggaatacttttgcctggtcctgaactttgtataaatagaatcaaatagtaggcattcttggtttctggcttgttttttcaacataatgtctgtgagaaacatccatgttgtcacattagtttctttttttattgctgagaagtattccattgtgtgactaaagcacaattgatttatccattctcctgtagatggatgtgtggattgattccatccgggggctactgcaaaccaagctgctatgaacattcttgcatatattgtttggtggttacctgcattcatttctcttggatacgtacctggttttgtcatagggtaggcatatgtctagctttaatagattctaccagtttttcaataaactctcctatcatcagtatatcaaagttccagttgctctgcatccttgccaatactttttaagttttgccattctgcatatgtgtagtaaaacataataatggaggccaggcacagtggctcacgcctgtaatcctagcactttgggaggccaaggcaggtggatcacctgaggtcaggagttcgagaccagcctggccaacacagcgaaaccccgtctctactaaaaatacaaaaatcagccgggtgtggtggcatgggcctgtagtcccagctactcaggagactgaggcaggagaatcgtttgaacctgggggcagaggttgcagtgaactgagatcagcaccactgcacttcagcctgggggaaagagcaagactccatctcaaaaaataaataaataaataaaaataataataatggctttaattttgcatttccccaatatcaaatgatgtagaccactttttagatttgtgttggaccacttagatatcctctttacagtatgtcttctccttgtagatttgttgtctttttctaaaatattctgaatactagtctttttttggataaatgtattgtaaacatgttctcccattccatggtttgtcctttaattcttttaatcttgtattttgatgaacagaagtacagaagttcttaatcttaaataagtcctaatttgtcagtttttt

SEQ ID NO: 3260 - DNA, 2287 bp, Homo sapiens
aagcttatagcaagaaaaagttctgttagaagagcttctgtttctcagagttccagaacctttcttctgggagacccttaatagcatgacctgccatcaggagaggaggctcagacagcctgcatttgattcctggtgcagggtgggtttgttcccagtaggaaaagcagcttctactgatgcagggactctacctccccactctttatggaataccagaaggttattgctgatagggacattagccatcgcctggctcaagtccttcatggaagagaccaggaactgatggccaggaaacctaaattacctagcaaatttatgggccattctgtgatttggactcagtaagtccagagatcctgcctttacatcattgtcttttgttttctggagtgctggtaggttagatcccaaactctgaagtactgtctgtgttaaaacactttttccccatcccattttgagctagcctcttcctcaaccaggcccatgccttttctcctaattcactttaaagaggcaacagcatgcagtgaaaggacctctgagtttgtatcaaacagacctgggttcaaagttctgcttccctgtttcatagctatgtaaccttaagcaactcacttaccatctctgagtctctgtttccttgtctgtaaaacaaggacaacagttaactttctgggacctagcattcaataggcactcaatcagtgagcatgattccctaaggtggaagagtttgtatcaccttcgggatttccagtgggtttagggtgttttctgccatactcccagtagactctataccttctgactaccctggaccatgggggagctgcgcgcaaagactcaagactgaacacaacattttgggtcaaaagaaagctctttattgattgactcagcaatgcagggctggcacccatcagcttcaaaccacatcttatcgcatccactcctgtccactcccgtccactttgccctcttccaggctgaaatcttgctttcaggcaagggcttccggccagccttgcattagttctcagctatggtcttctgaacccagtcctggatggaagtcaccttcacatacacaccatactcagccacagcacagctcttatcaaagcttaagatcccagtcgcataccaggtgtcctcctccaggtcgtgaacggcaaaggcactgcccgcatcgccatagcaggtgtcttcttggtacttagacatgccagcacagaaggtgtgttcattcagtatgggctgcacccctacagggctcttcggtgtcttcttttcgggggactgtgctgccttcataatgccttatgcattggtcttggtcagccacaggcagcatgacatacttcagatggtcagtaaatttaaaattggcatttcgcccccagccagaaacataacccacacgccctacttctgcataatcctttgaaggtaggcagatgggcatcactctctcattaacagacaccttctgtttgagtttgatgagcccaatatctacctgggagtagttagggtgtagaacaaccttctcaatctctacaagctgctttttccccacatagagtgttaaagtaggggcaatgtctttcgctgttgcattttctgaatggttcaggaagagatttttagccgtggtcagcagccattgttcattgatcagcgtggcacctgtggtgagattatggtgggaaaccatcttagcctgccagggaaaagctgcctttggcatccaggtgtccacccaggatccgctgcactgggtttgccggattcttgggcttcccacatactgcttcacattcaggaagtttatctccaacagccttatttatccactgcttctcattgtttaaggtgtacactccatctccttctgtgcgcagtttgtagtagttcttacactggtagcgaaccgagtgctccacatagccatgtgcaatctcggggggcttcgggcagccgtcatctgcttcacattcaggaagtttatctccaacagccttatttatccactgcttcttatcatttaaggtgtatactccatctccttctgtgcgcagtttgtagtagttcttacactggtagcgaaccgagtgctccacatagccatgtgcaatctcggggggcttcgggcagccgtcatctgcgatatccgtgacatcattgcctgagtccactgcaaaaagctgtccccagagcaggagggcaatgacagctcccaaggcactcatcttggttggtcttgcctctggaagag

SEQ ID NO: 3261 - DNA, 1471 bp, Homo sapiens
gggtcaaaagaaagctctttattgattgactcagcaatgcagggctggcacccatcagcttcaaaccacatcttatcgcatccactcctgtccactcccgtccactttgccctcttccaggctgaaatcttgctttcaggcaagggcttccggccagccttgcattagttctcagctatggtcttctgaacccagtcctggatggaagtcaccttcacatacacaccatactcagccacagcacagctcttatcaaagcttaagatcccagtcgcataccaggtgtcctcctccaggtcgtgaacggcaaaggcactgcccgcatcgccatagcaggtgtcttcctggtacttagacatgccggcacagaaggtgtgttcattcagtatgggctgcacccctacagggctcttcggtgccttcttttcggggactgtgctgccttcataatgccttatgcattggtcttggtcagccacaggcagcatgacatacttcagatggtcagtaaatttaaaattggcatttcgcccccagccagaaacataacccacacgccctacttctgcataatcctttgaaggtaggcagatgggcatcactctctcattaacaagacaccttctgtttgagtttgatgagcccaatatctaccttgggtgtagttagggtgtagaacaaccttctcaatctctacaagctgctttttccccacatagagtgttaaagtaggggcaatgtctttcgctgttgcattttctgaatggttcaggaagagatttttagccgtggtcagcagccattgttcattgatcagcgtggcacctgtggtgagattatggtgggaaaccatcttagcctgccagggaaagctgcctttggcatccaggtgtccacccaggatccgctgcactgggtttgccggattcttgggcttcccacatactgcttcacattcaggaagtttatctccaacagccttatttatccactgcttctcatcgtttaaggtgtacactccatctccttctgtgcgcagtctgtagtagttcttacactggtagcgaaccgagtgctccacatagccatgtgcaatctcggggggcttcgggcagccgtcatctgcagatatccgtgacatcattgcctgagtccactgcaaaaagctgtcgtccccagagcaggagggcaatgacagctcccagggcactgcagcgtgaaaacaagttggtcttgcctctggaagagctggtctccctgcttcacagcacatgcatgcatccacacacacaggcatgtacacacacacacacacgcacacacacacatgcatacacacacactcgctttttgaaagatttccttgactttatcatccatttattgaatttgttttcccatttttgtttttaaattccaaggtctatcttgttctctgatagtatcctattcttacatctctgaagaattc

SEQ ID NO: 3262 - DNA, 1009 bp, Homo sapiens
caggaagagatttttagccgtggtcagcagccattgttcattgatcagcgtggcccctgtggtgagattatggtgggaaaccatcttagcctgccagggaaagctgcctttggcatccaggtgtccacccaggatccgctgcactgggtttgccggattcttgggcttcccacatactgtcaaggagagcaagacactcgtgagtggaaatgtgcaagagcctttccaattttgatcattctttatatagaattttttggcctaaccttttcatctgttagaaatgcaaaatgcttgttccccagtgccataaagaaatagcacttgaacataaatttaattctctcagcaaggcaatttttactttctgcagaaagggtgcccatcacagatggaacaaagacaagagcacacttgaacaaaggaggtacaaaacatttatatctgacccatccagaccctactgctgtgtcctgattccattggctggaactggacctgacagtctaggcagcacccagttggctaaaggtttaaaactttttctaaagaggtaatggcagaggagaagaaaggaaaagaggaagttgcttatgaaaagactcagaaaagtaataacattcccaaataaggaaggggcataggctgcaagctgtgacatgcctgtgcacaggtctagcacagatatcttggttaaagtacagggacatagaatgtatttaattttcttacatttaataactacataggatagggcttaacaaagagttattagcacaaagcaaggaagtttgaaggaagttagtttttaaaagaaactattatctctaacacttatgatttattctttaacaagaagggaaattttgaagaggaactttttgctttctacatcacccaatgttgtaggcattttccatgttgtagaaaactcttaaaacattttaggccaggcacggtggctcacacctgtaatcccagcactttgggaggccgtggcaggcagatc

SEQ ID NO: 3263 - DNA, 702 bp, Homo sapiens
tttacaagtaaaatgtttatttagaaacagaatgcttgctcctaggtactgcaaggaaaaaccagcatttagacatttttttttttcagcaaggcaattttactttctgcagaaagggtgctcctcacagatgaaacaatggtgacagcacacccgaacaaaggagggaagcagtttttatcccttatgcagcttgtgtcctgtctccattggctggagctggacctcacaatttaaattaaacccgactggctaataacttaaaactttcctatatagggaaaggcaacagagaacaaaggaaaagaagaagttgcttgcaaaaagacttagaaaagtaataatatttccaaataaggaaggggcataggctgcaagctggaacgtgcctgtgagcatgtccagcacaaatatcttggttaaagtacaaggacatagaatatacttattcccttatatctaacagctacataggatagggcttaatgaagagttattagcacagagcagaggaggcttgaaggaagttagtctttaaaagaaactattatttctaacacttatgatttattctttaacaagaaaggaaatttcgaaaaggaaactttttactttctacaggctgatgagtgcagctaatcctcattattataagcatcactattatcatcacttgcaagagccatgtgacaatatttagac

SEQ ID NO: 3264 - DNA, 567 bp, Homo sapiens
ctcatagaataagtctaattcctcttttggctacagctattttttttaatgctgtgcacattttatagtcctttactgttcagacttggaaagctaggatgaaataaatatttactaaacacccctccccctgcaaaaaagaaaaagtaataatattcttaaataaggaaggggcataggctgagagctggggcatggctgtgagcacatccagtacacatattttggttaaagtacaaggacatagaatgtactacatgcctgtgagcatgtctagcacaagtattttggttaaagtgtaaggacatcgatgtacttactcctttatatctaacagctacataggatagggcttaacaaagagttattagcacaaagcaaggaggcttgaaggaagttagtctttaaaagaaattattatttctaacacttatggtttattctttaataagaagggaaatttgaagaggaactttttactttctacattcccctttaattcatggcacagttgggactacttattttcatatgaggacattcaataaacagactttactaatgaaa

SEQ ID NO: 3265 - DNA, 549 bp, Homo sapiens
ttttggttcaaaagaaagctctttattgattgactcagcaatgcagggctggcacccatcagcttcaaaccacatcttatcgcatccactcctgtccactcccgtccactttgccctcttccaggctgaaatcttgctttcaggcaagggcttccggccagccttgcattagttctcagctatggtcttctgaacccagtcctggatggaagtcaccttcacatacacaccatactcagccacagcacagctcttatcaaagcttaagatcccagtcgcataccaggtgtcctcctccaggtcgtgaacggcaaaggcactgcccgcatcgccatagcaggtgtcttcttggtacttagacatgccagcacagaaggtgtgttcattcagtatgggctgcacccctacagggctcttcggtgtcttcttttcggggactgtgctgccttcataatgccttatgcattggtcagtaaatttaaaattggcatttcgcccccagccagaaacataacccacacgccctacttctgcataatcctttgaagg

SEQ ID NO: 3266 - DNA, 579 bp, Homo sapiens
tttttttttttttgggtcaaaggaaagctctttattgattgactcagcaatgcagggctggcacccatcagcttcaaaccacatcttatcgcatccactcctgtccactcccgtccactttgccctcttccaggctgaaatcttgctttcaggcaagggcttccggccagccttgcattagttctcagctatggtcttctgaacccagtcctggatggaagtcaccttcacatacacaccatactcagccacagcacagctcttatcaaagcttaagatcccagtcgcataccaggtgtcctcctccaggtcgtgaacggcaaaggcactgcccgcatcgccatagcaggtgtcttcttggtacttagacatgccagcccagaaggtgtgttcattcataatgggctgcaccctaaaaggactcttgggtgtctcctttcgcggaatgtctggcttcataatgccttatgaaatggtcttggtcgtcacaaggcgccttgcatatttccgatggcccggaaatgtaaatttgaatttggccccagcagaaacgataagcaaggcgccgtatttgaaaat

SEQ ID NO: 3267 - DNA, 533 bp, Homo sapiens
  misc_feature (1)...(533): n = A,T,C or G
ggtcaaaagaaagctctttattgattgactcagcaatgcaggnctggcacccatcagcttcaaaccacatcttatcgcatccactcctgtccactcccgtccactttgccctcttccaggctgaaatcttgctttcaggcaagggcttccggcagccttgcattagttctcagctatggtcttctgaacccagtcctggatggaagtcaccttcacatacacaccatactcagccacagcacagctcttatcaaagcttaagatcccagtcgcataccagggtgtcctcctccagggtcgtgaacggcaaaggcactgccgcatcgncatagcaggtgtcttcttggnacttaggacatgccagcacagagggtgtgttcattcagtatggggctgcacccctacagggctttttcgggtgtcttcttttcgggggacttgtncttgccttcataaatgcctcgtgccgaatttcctgcaagcccgggggatccataggtttaagagcggcncaccggtgggagnttcagttt

SEQ ID NO: 3268 - DNA, 616 bp, Homo sapiens
  misc_feature (1)...(616): n = A,T,C or G
aaatncaccctttcaactataacaanaccantaattcnagccaacaacaacagcncctttaatcaaaagcttaaanaaccccaaatccggcaataccccangttgtnccttcntccccaggtccttgaaacgggcnaaaaggcacttgcccccgcaatcgcccaataagcaaggtgtccttccttggtaacttaagacatgcccagcaacaagaaaggtgtgttcattcaagtatgggctgcaacccctacaggcacggctcctcgggtcgccttctttttcggggactgtgctgccttccataatgccttatgcctttggtcttggtccaacccacaggcagcatgacatacttcagatggtcagtaaatttaaaattggcatttcgcccccagccagaaacataacccacacgccctacttctgcattaattcctttgaaggtaggcagatgggcatcactctctcattaaccggacaccttctgtttgagtttgatgagcccgaatatctacctgggagtagttagggtgtagaacaaccttctcaatctctacaagctactttaacactctatgtggggaaaaagcancntgtagaacaaccttctcaatct

SEQ ID NO: 3269 - DNA, 4865 bp, Homo sapiens
cttaagatcccagtcgcataccaggtgtcctcctccaggtcgtgaacggcaaaggcactgcccgcatcgccatagcaggtgtcttcttggtacttagacatgccagcacagaaggtgtgttcattcagtatgggctgcacccctacagggctcttcggtgtcttcttttcggggactgtgctgccttcataatgccttatgcattggtcttggtcagccacaggcagcatgacatacttcagatggtcagtaaatttaaaattggcatttcgcccccagccagaaacataacccacacgccctacttctgcataatcctttgaaggtaggcagatgggcatcactctctcattaacagacaccttctgtttgagtttgatgagcccaatatctacctgggagtagttagggtgtagaacaaccttctcaatctctacaagctgctttttccccacatagagtgttaaagtaggggcaatgtctttcgctgttgcattttctgaatggttcaggaagagatttttagccgtggtcagcagccattgttcattgatcagcgtggcacctgtggtgagattatggtgggaaaccatcttagcctgccagggaaagctgcctttggcatccaggtgtccacccaggatccgctgcactgggtttgccggattcttgggcttcccacatactgtcaaggagagcaagacactcgtgagtggaaatgtgcaagagcctttccatctgagaaaggggtgaaagcatgggcggctgtcactgctgcgtaaagtagaaagatttaaatgctttgcccttaccacctgctgatctcatttccaatagttgcagttttaaaataattctgttttttaaattgtttacattacaaaaagctctatttcccacttttctaacaaaggaagtgggaaatactgagatttttgagccctggctggtgaactgtattatatttaaacaattatcccaataaaggaatttccacaattccctgaaattcattgaaagggctaggggctacaataattcattctctctaaagaaagatgaatctagagcagcactggctggagctcagattttgtagatggtgcagttaatacgaggcaggttggcatttccacaccagtaagagcagaagaggctgggcctttgcctcttgttctgagaatgaaaggagagagcaacagctcctcctaataacgagaagcaggagttccagcccatgtccagcctcctgctaggcttccatggattaagattttatgtcattccttgacttgttctccctggagcttgcttctccttagacccagggctctctagcaggctctctgtatgcacaggctctcctaatctgtgggcgatgtagacaatggattcagccagtgcccttcaggccctaatgaacaagacccttggtgacccttagggagtcatcacctaactgcttaagtctctccctggccagctgcggttctcccacatccctcctcctggctcttgtgtgctcagaggaagccgcactggaaggctgtgcctctaggacgttccccgctggacgcctgcctgctctcttaagtgctcagcacccacctgcttcacattcaggaagtttatctccaacagccttatttatccactgcttctcattgtttaaggtgtacactcctgaaacaaaaggcaagaagtgagccaaaggagaagtcaagtctagaccccgtgcagagtgagaaggcatttaaagagaagaactaaaaggaagaggaaaaggggacaaaaaggaaggggaaaaggagagagtatatgagaaggaggaagggaaagagtgctgtgctggaagccaagtgcctggatgccagttaagcccagcagaacacactgtggtcatggcggtcacagccaagcagtacagggagggctcagggttcaaatcctgactctgcctcttacaggctgcctgaatttgggcaagatactcaacctgtctgtgcctcagtttccttatcagcaaagtgaaaacaataaactctgttcagagggatactgtgaggactaagtgagcaaataagtataaagcccttagagcagtgccaggacagcaagactcactaggtgagggtgacatcatcatcagcattccttcttttcccacatctgctggagatgtaaatctgactctgagatttacatgaggtaggctgcatggcatcgcctccccttaacaaaacagaaaacttgaggctgacaaaagttagtctgcccaaagggccatggctactggcgacaaaacgcttattagaatctaaatctcctggctccaaggagagcaacgaactttctggcgaatcacctcagcaccacccatcatggaaatgtcagagaagggggttgtatgtagggcatggagacagttgtccacatcttaccatctccttctgtgcgcagtttgtagtagttcttacactggtagcgaaccgagtgctccacatagccatgtgcaatctcggggggcttcgggcagccgtcatctgcaaagagagagaagccagagagtttgctatttggaaattgttcccagtgaaccgtgaaaagtcagatgagcgggagctgctctgcacatcaatctccttccaccccgaatagaagctcgcgaactgtattatatttaaacaattatcccaataaaggaatttccacaattccctgaaattcattgaaagggctaggggctacaataattcattctctctaaagaaagatgaatctagagcagcactggctggagctcagattttgtagatggtgcagttaatacgaggcaggttggcatttccacaccagtaagagcagaagaggctgggtctttgcctctggttctgagaatgaaaggagagagcaacagctcctcctaataacgagaagcaggagttccagcccatgtccagcctcctgctaggcttccatggattaagattttatgtcattccttgacttgttctccctggagcttgcttctccttagacccagggctttctagcaggctctctgtatgcacaggctctcctgatctgtgggcagtgccgacagtggattcagccagtgcccttcaggccccaatgaacaagacccttggtgacccttagggagtcatcacctaactgcttaagtctctccctggccagctgcggttctcccacatccctcctcctggctcttgtgtgctcagaggaagccgcactggaaggctgtgcctctaggacgttccccgctggacgcctgcctgctctcttaagtgctcagtgctcagcacccacctgcttcacattcaggaagtttatctccaacagccttatttatccactgcttcttatcatttaaggtgtatactcctgaaacaaaaggcaagaaatgagccaaaggaaaagtcaagtctgcacccagagcagagtgagaaggcatttaaggagaagaattaaaaagaagaagaagaaaggaggcagacaggaagggagaaaggagagagaatatgagaaggaggaagggaaagagtgctgtgctggaagccaagtgcctggacaccagttaagcccagcagaacacactgtggtcatggcggtcacagccaagcagtacagggagggctcagggttcaaatcctgactctgcctcttacaggctgcctgaatttgggcaagatactcaacctgtctgtgcctcagtttccttatcagcaaagtgaaaacaataaactctgttcagagggatactgtgaggactaagtgagcaaataagtataaagcccttagagcagtgccaggacagcaagactcactaggtgagggtgacatcatcatcagcattccttcttttcccacatctgctggagatgtaaatctgactctgagatttacatgaggtaggctgcatggcatcgcctccccttaacaaaacagaaaacttgaggctgacaaaagttagtctgcccaaagggccatggctactggcgacaaaacgcttattagaatctaaatctcctggctccaaggagagcaacgaactttctggcgaatcacctcagcaccacccatcatggaaatgtcagagaagggggttgtatgtagggcatggagacagttgtccacatcttaccatctccttctgtgcgcagtttgtagtagttcttacactggtagcgaaccgagtgctccacatagccatgtgcaatctcggggggcttcgggcagccgtcatctgcaaagagagagaagccagagagtttgctatttggaaattgttcccagtgaaccgtgaaaagtcagatgagcgggagctgctctgcacatcaatctccttccaccccgaatagaagccaatggaaaggcaagctcccctcatttctggcaggaaccccaatgttctttatggtcctgaaagcccagaggtcgagataagaagggggaattgggtgttctcagagagagtgcagacccgagagggtcagagtgggatgcacactcctacccaaccaaagactgacctgcgatatccgtgacatcattgcctgagtccactgcaaaaagctgtccccagagcaggagggcaatgacagctcccagggcactgcagagagaagacaaggaggagtggaaagctagtctccctgcttcacagcacatgcatgcatccacacacacatgcatgtacacacacacacacacacatgcatacacacacactcctcccacttagcagccagaaaagaaagtcgatatatggaagtgctaggaccaagaaattgcccccacacctgcccatacacactttagcagcttctgagcataccaagctt

SEQ ID NO: 3270 - DNA, 560 bp, Homo sapiens
  misc_feature (1)...(560): n = A,T,C or G
attgactcagcaatgcangggctggcacccatcagcttcaaaccacatcttatcgcatccactcctgtccactcccgtccactttgccctcttccaggctgaaatcttgctttcaggcaagggcttccggccagccttgcattagttctcagctatggtcttctgaacccagtcctgggatggaagtcaccttcacatacacaccatactcagccacagcacagctcttatcaaagcttaaggatcccagtcgcataccaggggtgtcctcctccaggggtcggtggaacgggcaaagggcacttgcccggcattcgccataggcagggtgtctttctttggggtactttaggacatggccaggcacaggaagggtgtgtttcatttcagtatgggggcttgcacccctacaggggcttctttcgggtgttcttncttttttcgggggggacttntggcttggcctttcaataaatngccttaatngcatttgggnctttgggntcaggccacagggaggcatggacatactttnaggatggggtcagntaaattttaaa

SEQ ID NO: 3271 - DNA, 374 bp, Homo sapiens
  misc_feature (1)...(374): n = A,T,C or G
aagaaaaaaccttcctnaaaanctcccaaaaaaactgcctttatccccccnacataaaatgttaaaaacangggcaangtctttcgctgttgcaattttctgaaatggttcaagnaagagatttttaagccgtggtcaagcagccattgttcattgatcagcgtggaacctgtggtgagattatggtgggaaaccatcttagcctgcccagggaacagctgctttggcatcccaggtgtcnacccaggatccgctgcactgggtttgccggattcttgggcttcccacatactgcttcacattcaggaagtttatctccaacagccttatttatcnactgcttctcattgtttaaggtgtacactccctctcct

SEQ ID NO: 3272 - DNA, 361 bp, Homo sapiens
  misc_feature (1)...(361): n = A,T,C or G
gatcccagtcgcataccaggtgtcctcctccaggtcgtgaacggcaaaggcactgcccgcatcgccatagcaggtgtcttcttggtacttagacatgccagcacagaaggtgtgttcattcagtatgggctgcacccctacagggctcttcggtgtcttccatccaggactgggttcagaagaccatagctgagaactaatgcaaggctggccggaagcccttgcctgaaagcaagatttcagcctggaagagggcaaagtggacgggagtggacaggagtngatgcgataagatgtggtttgaagcttgatgggtgccagcctgcattgctgagtcaatcaataaagagcttttcttttg

SEQ ID NO: 3273 - DNA, 370 bp, Homo sapiens
  misc_feature (1)...(370): n = A,T,C or G
cccaggtccttgaaaacggccaaaaagcacctgcccccgcaaccgcccaataagcaaggtgtccttccttggtaccttaagacatgcccaaccaacaagaaggtgtgttcaattcaagtaatgggctgcaacccctacagggctcttcggtgtcttcttttcggggactgtgctgccttcataatgccttatgcattggtcttggtncancacaggcagcatgacatacttcagatggtcagtaaatttaaaattgcatttcgcccccagccagaaacataacccacacgccctacttctgcataatcctttgaaggtaggcagatgggcatcactctctcattaacagacaccttctgtttgagtttga

SEQ ID NO: 3274 - DNA, 289 bp, Homo sapiens
  misc_feature (1)...(289): n = A,T,C or G
tacttcagccaacaanaaaagctccttatcaaaagcttaaagatcccagtcgcaatacccaggtgtcctccncccaggtcgtgaacggcaaagcactgcccgcatcgccatagcaggtgtcttcttggtacttagacatgccagcacagaaggtgtgttcattcagtatgggctgcacccctacagggctcttcggtgtcttcttggtcttggtcancacaggcagcatgacatacttcagatggtcagtaaatttaaaattgcatttcgcccccagccagaaacataa

SEQ ID NO: 3275 - DNA, 263 bp, Homo sapiens
  misc_feature (1)...(263): n = A,T,C or G
cgacctacaatctgcactaatcccnctgaaggtaggcagatgggnataactctctcantaacaganaccttctgtntgagngtgatgagccnaatatctacctgggagtagntagggtgtagaanaaccttctcaatctctataagctgctttttccccacatagagtgttaaagnaggggcaatntctctctctctctctctctctctctctctctctctctctctctctctctctctctctctctctctctctctctctct

SEQ ID NO: 3276 - DNA, 235 bp, Homo sapiens
  misc_feature (1)...(235): n = A,T,C or G
gggnaaaagaaanactttattgattgctcagaatgcaggntggacccanacttaaccacacttacgcaccactctgccactcccgccactttgcctctccagctgaaatcttctttcagcaaggcttcgccagccttgcattagtctcagctatggcttctgaacccagtcctggatggaagtcaccttcacatacacaccatactcaccacacaggctcttatcaaacttagat

SEQ ID NO: 3277 - DNA, 567 bp, Homo sapiens
  misc_feature (1)...(567): n = A,T,C or G
tttatgatgaaggaaaggcaaggcaggtctactaatcacacattccctcaacttttgtctgagaaggtctttctccttcacttttgaaggataatttctctggatacagaattctaggttggtagttttttgtttttgttttttcctttcaacacaataaatatattatgccactctcttcttgatcgctcagtttctgaagagaagccctatttattacccttgctcttctgcagctactggtgccagcataggagccctctggctcctttcaagattttctcttcttttngggtttcctgtgctttgtatgtgtctaggtatagacattttgntatttattctgcttggcgttcctggtgcttcctggatctgtcattaatttngaaaaattctcagccatgacaatttccaatatttcttctcctnnctcttccttgtattctcattacatgttgttacatcttttgggattgtcacacaggtcttggaagttctgttcagatgtttncaacctnnnctccctctgnattccaggttcacgggttctnctgacaatccacaggg

SEQ ID NO: 3278 - DNA, 486 bp, Homo sapiens
gggacgcggaccgccaggacttgaacgcaactcccaattgcagaaaattggcaacgtctctgaagagcccttgcttttgcctggacccccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggagtgtggggcgcctggggcccctggtcggcctgctcgcgtagctgcagcggcggcgtgatggagcagacgcggccctgcctgccccgctcctaccgcctgcgcggcggccagcggcctggcgcccctgcgcgcgccttcgcggaccacgtggtgtcggcggtgcgcacgtcggtgccactgcaccggagccgcgacgagacgccagcgctggccggtacggacgccagc

SEQ ID NO: 3279 - DNA, 497 bp, Homo sapiens
  misc_feature (1)...(497): n = A,T,C or G
gggacgcggaccgccaggacttgaacgcaactcccaattgcagaaaattggcaacgtctctgaagagcccttgcttttgcctggacccccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggaggtgtgggtttttntttttttttttttntttttttttttttttttttttttttttttcttttttttttttttttttctnnttttttttttttttttttttttttntttttcttttttttctttctttttttctttttcctcccttctctcctcttcttctttttctctcttttttcttctttttttttcccctcctttctctttttcttctctctctccttctttttccttttttttct

SEQ ID NO: 3280 - DNA, 250 bp, Homo sapiens
cccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggagtgtggggcgctggggcccctgctgaaggttacctaaccattctttaaaaggagaatgaccctccatgggaatggccag

SEQ ID NO: 3281 - DNA, 1001 bp, Homo sapiens
atttgccctcgaggccaagaattcggcacgagcggcacgagtttttttttttttttttttgagacacaaaatttaatttaatagaaattttgtttgtagttcttacattctcagtgtgagccaatctgggacccactgccccacccagaagtggcccagtcctgggggcaggggagaaagggaggggtgaaatgagaagagccccgttcttcctcagtgctggggggttggagacaccacccccttctgctgccctcctctgggctccaggaaggagagcagatgaaatctcaggcctgtggcttctccacaccactgccccccaggttggaggggagctaagagatgagagaaggggacagaggcaagaaaagatgttgatcaagaaagatgagaaccaggggtgagggctgaaggagaatcaaagataaaataccagtttaaaaaaaaaaaaaaaaagggcggggagggggtgggggagagtggaggaggggaacaaaaccaaaatccaccccaaatccgaaccagcctggaaaaaaatgaaagttctcgagtctcacagagacattatttggcgcggcaagctctgcggcaggagcgctcaggcctcagtccagccctggaggcaggcctctctacagctcgtccttggcctggccggggacatcttcctcctcatcttcctccttgtcctcctcatcctcctcatcctcatctttgtcctcatcatcctccttgtcctctgcctcctcctccactttgcgtttcttgtcttcttcctcctccttaagcctctgctcctcgtcctgtttgtccttcatttgtttctctgctgcctttgttacgccccacgtctcgttgccaaactcctcagcgtatgcctcatcgttggtgatgaggaagttgtcaaagatggtgccagacttgacctggaggatgaatgggaaggatggtcagaggtgatacccgatagcccttgctttggacagggtttccacctg

SEQ ID NO: 3282 - DNA, 644 bp, Homo sapiens
  misc_feature (1)...(644): n = A,T,C or G
gacacaaaatttaatttaatagaaattttgtttgtagttcttacattctcagtgtgagccaatctgggacccactgccccacccagaagtggcccagtcctgggggcagggganannnggaggggtganatgagaagagccccgttcttcctcagtgctggggggttggagacaccacccccttctgctgccctcctctgggctccaggaaggagagcagatgaaatctcaggcctgtgnttctccacaccactgccccccaggttgnntnntgcgctaagagatnagagaaggggacagaggcaagaaaagatgttgatcaagaaagangagaaccanntnnnagtngaggaggggaacaaaaccaaaatccaccccaaatccgaaccagcctggaaaaaaatgaaagttctcgagtctcacagagacattatttggcgcggcaactctgcggcaggagcgctcaggcctcagtccagccctggaggcaggctctctacagctcgtccttggcctggccggggacatttcctcctcatcttcctccttgtctcncatcntctcacctcatcttgtcccanatctcctgtcnctgctgtccgatnttggctcgaggccaatccttatggcgatnatcgtacaag

SEQ ID NO: 3283 - DNA, 864 bp, Homo sapiens
  misc_feature (1)...(864): n = A,T,C or G
gagtctnggggaacccctcngcggnangaggtgtcccccccnggggggaaaaaagggngaaaattnnaaaaaaagggggggggnnaaaaaaaaaaaaaaannnnnggggggggggggnggggggggggcccaccaacncccaanggaaactgtaaaatgaagttgantttnaananaatattgnccggcaaccctcgcagaacgctcaggcctaatcaatcctggagcaggcctctctacaagtcgtccttggcctggccgggggaaatcttcctcctcatcttcctccttgtcctcctcatcctcctcatcctcatctttgtcctcatcatcctccttgtcctctgcctcctcctcctctttgcgtttcttgtcttcttcctcctccttaagcctctgctcctcgtcctgtttgtccttcatttgtttctctgctgcctttgttacgccccacgtctcgttgccaaactcctcagcgtatgcctcatcgttggtgatgaggaagttgtcaaagatggtgccagacttgaccctgccagaggtccaggcccagcacgccaaagttatcataggcatagatactgggatcgggagaatactcggggttgtcaatttctgggtggatccaagtgcccttgtaatctgggttgtcgatctgccggggcttccactcacccttgtactcagggttctgaatcactgggggttcccactctccgtccatctcttcatcccagtcctcgggcttcttagcatcagggtcagggatatgctcgggcttgtcccagtcctcaggcttggagtctgtgggatcatcgatcttggcccgctcatcccagtcttccggttttgaagcatcaggat

SEQ ID NO: 3284 - DNA, 399 bp, Homo sapiens
tttttgagacacaaaatttaatttaatagaaattttgtttgtagttcttacattctcagtgtgagccaatctgggacccactgccccacccagaagtggcccagtcctgggggccggggagaaagggaggggtgaaatgagaagagccccgttcttcctcagtgctggggggttggagacaccacccccttctgctgccctcctctgggctccaggaaggagtgcagatgaaatctcaggcctgtggcttctccacaccactgccccccaggttggaggggagagagacattatttggcgcggccagctctgcggcaggagcgctcaggcctcagtccagccctggaggcaggcctctctacagctcgtccttggccttgccggggacattttccttct

SEQ ID NO: 3285 - DNA, 702 bp, Homo sapiens
  misc_feature (1)...(702): n = A,T,C or G
ggtttaaattaaaaaaaccccctttcttccctaaatgctgggggtttggaaaaaccaaccccccttcttcttcccttcttcttgggctccccngaaggnaaancagattaaantcttcaggcctgtggcttctccacaccactgcccccccaggttggaggggagctaagagatgagagaaggggacagaggcaagaaaagatgttgatcaagaaagatgagaacccaggggtgagggctgaaggagaatcaaagataaaataccagtttaaaaaaaaaaaaaaaaagggcggggagggggtgggggagagtggaggaggggaacaaaaccaaaatccaccccaaatccgaaccagcctggaaaaaaatgaaagttctcgagtctcacagagacattatttggcgcggccagctctgcggcaggagcgctcaggcctcagtccagccctggaggcaggcctctctacagctcgtccttggcctggccggggacatcttcctcctcatcttcctccttgtaatctgggttgtcgatctgccggggcttccactcacccttgtactcagggttctgaatcactgggggttcccactctccgtccatctcttcatcccagtcctcgggcttcttagcatcagggtcagggatatgctcgggcttgtcccagtcctcaggcttggagtctgtgggatcatcgatct

SEQ ID NO: 3286 - DNA, 444 bp, Homo sapiens
ggctttgcttcttcaacacaattgcccccaggtttgaagggaacttagaggttcagagaaggggatcggtgtcaggaaacgatgtgatcaagaaagatgagaaccagggtgagggctgaagggaatcaaagataaaataccagtttaaaaaaaaaaaaaaaagggcggggagggggtgggggagagtggaggaggggaacaaaaccaaaatccaccccaaatccgaaccagcctggaaaaaaatgaaagttctcgagtctcacagagacattatttggcgcggcaagctctgcggcaggagcgctcaggcctcagtccagccctggaggcaggcctctctacagctcgtccttggcctggccggggacatcttcctcctcatcttcctccttgtcctcctcatcctactcatcctcatctttgtcctcatcatcctccgtcgac

SEQ ID NO: 3287 - DNA, 256 bp, Homo sapiens
ttgagacacaaaatttaatttaatagaaattttgtttgtagttcttacattctcagtgtgagccaatctgggaaaaaaatgaaagttctcgagtctcacagagacattatttggcgcggcaagctctgcggcaggagcgctcaggcctcagtccagccctggaggcaggcctctctacagctcgtccttggcctggccggggacatcttcctcctcatcttcctccttgtcctcctcatcctcctcatcctcatct

SEQ ID NO: 3288 - DNA, 322 bp, Homo sapiens
ggaattaaaaaaagttttcatgaaaaaataaatacataattgaaaagccaacatgattgctgttcactacacccttttggcagtattctatgaaaataatccaagtctgtatgtaagagctttcagaaaatgatacatagctaagtctccaaaaaatgctaataagcaatgaccacaattaaatagaatgcatgaaacaggaagcttaagaagaccaagctggtcacagtggctcacacctgtaatctcagcactttgggaggccaaggcgggaggattgcttgagggcaggagtttgagatcagcctaggtgacatagtga

SEQ ID NO: 3289 - DNA, 486 bp, Homo sapiens
tctttctcacattctttacatttatagggtttttcaccagtatgaatcctctgatgtctagtcagggatgaactatttctaaagacctttccacatgctttgcattcatagggtttcttaccagtatgaattctctgatgacgagcaagttctctacatactccaaaagccttcccacattccttacatgcataaggtttctcaccagtgtgaattctctgatgttcaatgagctgtgaactaattctaaaaaccttctcacagtgcatacatttgtagggtttctcaccagtatgaattctctgatgttcggtaagctgtgaatgaaatctgaagtccttgccacattccatacatttgtaagttttctcatcagtatggattttctgatgtcgagtaagttgtgcatgcactctaaaggatttcccacagaatgagcattcaaagtgtttctcaccatcatgaactctttgaagtggagtaact

SEQ ID NO: 3290 - DNA, 395 bp, Homo sapiens
tttgctaaatgatatacctggtatattacaataattagtactctgaactgtttaaaattaagacttcttcctacaactgaatcttaggtaaagatggacacctgcatgagggaaggaatatgtgagcagcttccatttcccttccatggtcttctcagcttcctccaacagtagattgttcagcctcccagtatgaattctctgatgttcggtaagctgtgaatgaaatctgaagtccttgccacattccatacatttgtaagttttctcatcagtatggattttctgatgtcgagtaagttgtgcatgcactctaaaggatttcccacagaatgagcattcaaagtgtttctcaccatcatgaactctttgaagtggagtaacttttccaactc

SEQ ID NO: 3291 - DNA, 1016 bp, Homo sapiens
ttaagtatcaaagttaagtttaataaagtaagttccttccattttgtaatgtataaaataataccatttaaacaggcagaaactagctaatctgcatttatagagcatagttttttgggtgggaaaaaagcattctttcatcatttcacctttactagaagaaacagacttatgatggttcttactattatttttcaactttagaattattcattcagtagaagctgtatttcaagtacccaaccattctgtttttcactttcaatgtaatcttcaaaaattacatgagatattcaacatactttattataaaataggctttgtattagacgattttgcccaactgtaggctaatgtagtgttcggagcccttttaaggtaggctaagctatgatgtttgacttttggtattttcaactcacagtgggcttatctggacctaaacccatcataagttgagaagcatctgtatacccaacattggttatgtatactttcattaaatactcatttgaaaaataaagctttcttcacatcaaccgtgtgatgtaggtctttaatttttgaaactgcaaaacaggttccaagatgagctcttactgatgtatatggtataatacggtatggccaaaaccactgcttatgacctctcaaatattcacacatcaaggccaggcgcagtggcttatgcctgtaatcccagcactttgggaggctgaggcggacggatcccttgaggccaggagttcaagaccagcctggtcaacatggcgaaaccccatctctacaaaaaatacaaaaaattagccagggcatggtgggtgcatacctgtagtcccagctactagggaggctgaagcaggaggatcacttgaactcaggaggcagaggctgcagtgagctgagattgcaccactgcactctagcctgggtgacaaagtgagaccctgtctgccaacaaacaaatattcacacatcacccagtatttaaggaaggggtcatcattcagagaggt

SEQ ID NO: 3292 - DNA, 849 bp, Homo sapiens
gtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattaaaaaa

SEQ ID NO: 3293 - DNA, 691 bp, Homo sapiens
  misc_feature (1)...(691): n = A,T,C or G
ngtccagtgaaacaccctcggctgggaagtcagttcgttctctcctctcctctcttcttgtttgaacatggtgcggactaaagcagacagtgttccagggcacttcaggaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattaaaa

SEQ ID NO: 3294 - DNA, 303 bp, Homo sapiens
gtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtccgcccaactccaagtggcaaaaggaattggggattcttaggtgtccctaagatctaaaagggatcagttctaagggcaggagcagtgcttaggaagcaaagaaagcatttctttcacctatcacaatatg

SEQ ID NO: 3295 - DNA, 595 bp, Homo sapiens
  misc_feature (1)...(595): n = A,T,C or G
ctacggagtcgagctctgtcagtgcatgattcttgccaatcgctaaacgtaggactcgaggaaggccattgnaattctgctaagaagacagtgcaagtgcctataaaaacgacagtttagggggaaaacaaaccaatacccggaaagctgagaggccagctttttaatcgtcatggttttatgtaaaataaaacagcacgtggaaggtattgtaagcgcttggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagaggaatcagattcctggaagaggcaggaagcagtggcttaggaaaagccaaagagaaaagccatgtcctttgcaacctgattacacaaatgatgnaaaaggaatagactttcctcattcatctttgaataacgtctccttggttaccctgggtattcctgaatgtaatttcnataaatgtggttgt

SEQ ID NO: 3296 - DNA, 311 bp, Homo sapiens
agaagggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaaaaaaaaaaaaaaaaaaaaaaaaa

SEQ ID NO: 3297 - DNA, 640 bp, Homo sapiens
  misc_feature (1)...(640): n = A,T,C or G
tttcccaaatttgtggaaaattttaatagggcagacagcgtggtaaatgtattacaaaattattaaactttacatatgggacacttattttctaggctcataaacacatacgacataacaaataaagacataaacatacaaacataaagaggtagaggggccatccagaggactccctgacctacctataatattgcttatacaactaaaattcagtcacttgctctctcaataatatgtaacatgctgaactctttgaagctgcttgagtttacgttatctgacatcaaataggatgtttaataaatatggacttctgataaacgtagtccataaagaacagaaagccacatattccttccgaatgtgactacagtgactttagcaaatgaaagtgaaaagttctaaattttcttaaagaattaaaaaataaattcaaaaatgatataaatatcttggtcactatttcaagattaagaaaaaaatcaatccattacagtgcccattataaatataaaaaattaatttctcaaacttgttttacagacaatatttttataaatattgctcanagttccagcatatatatatatatacacacacacacacacacatatatggaaacacacacaaacacaca

SEQ ID NO: 3298 - DNA, 4810 bp, Homo sapiens
  misc_feature (1)...(4810): n = A,T,C or G
caanttccccanggcacnnaccaatngganaancanccggcccaanttgaattngtaantccggccccnacnaaaaggggcnnaaatggggaacccgggnacccccaggaaacctctccccttttttttttttttttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttttttctagctccaccatctctgcaacttgccaagatgcggcaagactatctgcaacaaagtaaaatatacaggttttttattccaccagtgcctcagatagggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcaagtcctagataatgatctatctgtgcctgatgccgttcataaataacaggaacactgaagagtgaaatgagagccaaaatcagtagtgtcagaccattaaacaaggcaccaacataggtaaatacccacatcaacactgcaaacttcagagaatcaactaaatcatcaactaagaagaggcgcctgagttcctttatcgtgcagttcacatgaccaagagcagaattactgtacttctgaaccaactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaactgaagttttacacagctctgctgaaaatatagcagatggtgatctgtcctctttttctgtatcggaaggaagttttttctcagcttctttcacaagaactttgggtttaactatgctctctatctctgcttgagtggccaaagcagaaacatctggaggcaataagagcacctttgatgtagcagacccatttttagaaaagtcatctgagaaactgattttctcttcaactttgggttgtatgttcttcaaagaaaggtcatggggcaattctgtgcaaggcaatgacccagctccatccggggcattagcaatttcacttttgtgggatacttctaggtcagtatattccctggctaatttagaaaatgaatcagttttagaactgatcaatgtagggaactcatctataatttcaattggagatgaatctgaaaacgtttcagtttctcttatctgtgcttccttagaaataaataagtcatcatttgaataaactgcagtactgagctcctccatctgcaaaggaattttctcctttttgctcaatgttgaaacttcatcaggtaacagggtatcttttgtgttatctaaactgagcttaaaagattccaaatatggctttcctccctcaggtggcaaagcactgagtttttccttattttcatattctatcattgactcaaatgaagtctcagtgagactttctttcacaagcatcacagtttcatcttgtttttgtggaacgtcaggtattgaatcatcactaaataagtcaactggttcagaatcaggtgaggaatcttcaactagctcagaatgatcaggcactggctgttcaacttttgccatttctgaataatcagagaaatccggagctggttcagcagaaagctttgtttctttaattaaatcacatgcaatagatatataaggagcttctgtttcttgaagagctgcattaatattttcaggctctttaatttcttcctttattcctgatactttttttagtgatacactcatggcctcttcatatggtggggggttttcaggctcatgttttatgctttcataattaactgaagaagcttctaatggtgatgagctgggctgtatcacggaagcaccagcactaggaactgcagaattcaatggtgcttccataacaatgtcaggcaaaactggtgaaggagtagcttctgactcttcaaatgatgggcaaagctgtgctgcaggatagagtgactcttgcataacttctgatgtttgaaccaagtccatttttgtttcataagcaatctttgtaccagtaacttcattcaattcactttcacatgcttcctgtactaaatctggagtcaggccttcaggcatgtttgccacgacttcctcagtcacctttgttaaattatctgttgtgacataatctgtctcagaatcctgtgctgctacaagaaaagggtttgatgttttggtgctagtattcttctctgttactatttgggccttcttttcttctatttttttttcatcggtcttattttctgaagtaggatctcctaacaaaggaaaaatgtttgttgcaatgctctcagttgctgctgggttaaagggagcacatgtgatatatgctcctgaacgatcctttataccttctggcgtactggggaaagaagtatcatcattactactctcactatctttttcgtgattagtttgctcaaggctatctgcaaaacattttttatccactttactttccaagttgctctcgattttacctccagcagccaacatatcactatcttccttactatctttcacttcccatactcgctcaaatggtttgaagtctgcatattcctccctcataggagcttccactgcaactctcttttcattaaaactgtcttttgctttttctgaagacacaacttcatcctctttaaccaatttagtaagagctgtaggtaactcttgttgattatgaaggatgttattactaactaacttctcttcttcatctttatttttcacgattatttcttccctaggatttgctactattacggcagattctgcttttggagagacactgaacgatgatcccatttctgagtattctaattctgaaaactctgttaaatctctatctatgagtagagtttttgccttctctgagacctctttagaagcttcactgacattttcttgaagtgttccttcagtgggtaatactgttgacaaattaccaaggtattcatgttctttgaaagaagcggctgagagaggagacagagaaggaagagaagcagcagtttcaagcaggacagatgggaaatcctcttgaccagccgaaatagtgttacctggctgctccttcaagtccatattttctgcagaggagcgtatcacaggctcagatgcagcaggaagagcaaaaagggtctcatccactgagcccgaggagcccctgcgcttgggcgcggccggggtggaggggggcgcggcgggagccggggctggcggggtccacacgggctctgcctgggggctcacgctggccgggggaggagggggaggccgggccggaggctcgtcgtcctcagggagcttggagggcgagactgcggcagcagacagcggggatggcgcgggcacggtcgacgacaccgggctcgggtcccaagacggctgccgctccggggcgacggggggagcggccggcaggggtccccggggcgccggcggcacgaagtcatttccgaagtccatcaggggcgcgccggcggcaggggcggtgggcactggggccgcggacagcccggcggcgggcttcctctccagcacctccagctcctccaggtcttcgtcctcgtcctcctcttcctcctcctcttcttcctcctcgtcctcgggctccctcacgaactggtacttgaacgcgggctgcggccggggtgggctgtccgaggacgagaccagaggagactggtccaggtcttccatggctggagggtggagatgatgctgcagctgctgccgccgccgccggggccgcgtctcagagccgcgggcggttgtgggggttggggaggactgagaggggctgggccgactgagccgagggacctactgtggtg

SEQ ID NO: 3299 - DNA, 1812 bp, Homo sapiens
acccccaggaacctcccccttttttttttttttttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttttttctagctccaccatctctgcaacttgccaagatgcggcaagactatctgcaacaaagtaaaatatacaggttttttattccaccagtgcctcagatagggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcaagtcctagataatgatctatctgtgcctgatgccgttcataaataacaggaacactgaggagtgaaatgagagccaaaatcagtagtgtcagaccattaaacaaggcaccaacataggtaaatacccacatcaacactgcaaacttcagagaatcaactaaatcatcaactaagaagaggcgcctgagttcctttatcgtgcagttcacatgaccaagagcagaattactgtacttctgaaccaactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaaccttgtccttccaatttttcttctgaccgtccatctcttgtcacgatctgctttgcagctccaattattaattatgcataccaacagaaaagctgtaactgcacaaacctactccctgagacatgaaatacccgtttcctcaaccgaagtctgcagtctcctctgctgcacaactgcagcaggactgaagtcacctgacgtcttctgggtgtggaacagtctgacgcagtgcaatctgtaactaggct

SEQ ID NO: 3300 - DNA, 2311 bp, Homo sapiens
ttttttttttttttttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcaagtcctagataatgatctatctgtgcctgatgccgttcataaataacaggaacactgaagagtgaaatgagagccaaaatcagtagtgtcagaccattaaacaaggcaccaacataggtaaatacccacatcaacactgcaaacttcagagaatcaactaaatcatcaactaagaagaggcgcctgagttcctttatcgtgcagttcacatgaccaagagcagaattactgtacttctgaaccaactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaaccactgagcccgaggagcccctgcgcttgggcgcggccggggtggaggggggcgcggcgggagccggggctggcggggtccacacgggctctgcctgggggctcacgctggccgggggaggagggggaggccgggccggaggctcgtcgtcctcagggagcttggagggcgagactgcggcagcagacagcggggatggcgcgggcacggtcgacgacaccgggctcgggtcccaagacggctgccgctccggggcgacggggggagcggccggcaggggtccccggggcgccggcggcacgaagtcatttccgaagtccatcaggggcgcgccggcggcaggggcggtgggcactggggccgcggacagcccggcggcgggcttcctctccagcacctccagctcctccaggtcttcgtcctcgtcctcctcttcctcctcctcttcttcctcctcgtcctcgggctccctcacgaactggtacttgaacgcgggctgcggccggggtgggctgtccgaggacgagaccagaggagactggtccaggtcttccatggctggagggtggagatgatgctgcagctgctgccgccgccgccggggccgcgtctcagagccgcgggcggttgtgggggttggggaggactgagaggggctgggccgactgagccgagggacctactgtggtgacggctcccggaacaatgagactgctcctcctgcctccgcgccggtgatgcgccacccgccctgtccccagttgccgccg

SEQ ID NO: 3301 - DNA, 2107 bp, Homo sapiens
aagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtcattcctgctttaccggtatgatctcgtctaaacaaacatttcatttcagaaaatctgcatcaatctacacggaccatacacagtgcacaaactgaaaagggcttttttttttttttttttctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcaagtcctagataatgatctatctgtgcctgatgccgttcataaataacaggaacactgaagagtgaaatgagagccaaaatcagtagtgtcagaccattaaacaaggcaccaacataggtaaatacccacatcaacactgcaaacttcagagaatcaactaaatcatcaactaagaagaggcgcctgagttcctttatcgtgcagttcacatgaccaagagcagaattactgtacttctgaaccaactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaaccactgagcccgaggagcccctgcgcttgggcgcggccggggtggaggggggcgcggcgggagccggggctggcggggtccacacgggctctgcctgggggctcacgctggccgggggaggagggggaggccgggccggaggctcgtcgtcctgagggagcttggagggcgagactgcggcagcagacagcggggatggcgcgggcacggtcgacgacaccgggctcgggtcccaacacggctgccgctccggggcgacggggggagcggccggcaggggtccccggggcgccggcggcacgaagtcatttccgaagtccatcaggggcgcgccggcggcaggggcggtgggcactggggccgcggacagcccggcggcgggcttcctctccagcacctccagctcctccaggtcttcgtcctcgtcctcctcttcctcctcctcttcttcctcctcgtcctcgggctccctcacgaactggtacttgaacgcgggctgcggccggggtgggctgtccgaggacgagaccagaggagactggtccaggtcttccatggctggagggtggagatgatgctgcagctgctgccgccgccgccggggccgcgtctcagagccgcgggcggttgtgggggttggggaggactgagatggggctgggccgatctgagccgag

SEQ ID NO: 3302 - DNA, 640 bp, Homo sapiens
  misc_feature (1)...(640): n = A,T,C or G
atcgagtgacaagccatttgntcaaanaacttgaccagaaccacaatccattcaaagctcnggaacaatcggagtcagcntcaggatgttgcaagantctcagcacttggtaataancgtgggacatatctgtcncagancctgtgctgcacaagaaagggttgagntttgtgctagtattcttctcggtaacattnggccttcttttcttctattttttttcacggtctaattttctgaagtaggatctccaacaaaggaaaaatgttngttgcaatgctctcagttgctgctgggttaaagggagcacatgtgatatatgctcctgaacgatcctttataccttctggcgtactggggaaagaagtatcatcattactactctcactatctttttcgtgattagtttgctcaaggctatctgcaaaacattttttatccactttactttccaagttgctctcgattttacctccagcagccaacatatcactatcttccttactatctttcacttcccatactcgctcaaatggtttgaagtctgcatattcctccctcataggagcttccactgcaactctcttttcattaaaactgtcttttgctttttctgaagacacaacttcatcctctttaa

SEQ ID NO: 3303 - DNA, 652 bp, Homo sapiens
  misc_feature (1)...(652): n = A,T,C or G
tagaagaacagaattttacactcaactctcttgatactaaattctgggtatatcaaaaatgaaaggcaaaataaacttaccttcagagaatcaactaaatcatcaactaagaagaggcgcctgagttcctttatcgtgcagttcacatgacccagagcagaattactgtacttctgaacccactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaaccttgtccttccaatttttcttctgaccgtccatctcttgtcacggtccgctttgcagctccaattattaattatgcataccaacagaaaagctgtaactgcacaaacctactccctgagacatgaaatacccgtttccacacccagaagacgtcaggtgacntcagtcctgctgcagttgtgcagcagaggagacggcagacttcgtttgggcgagnccnacna

SEQ ID NO: 3304 - DNA, 1041 bp, Homo sapiens
tttttttttttttttttttttttttttttttttttgaaaaaataaaatttactgtttatttctttgttacacaaaggtggtccaagacatcttagtccatctcctatgtccttttggccataattacacacacaataatggcaagctagattaggagtctagctcagggtcaagtttttccactttaatgactatctctggagctaaagcggcagcaccagcttgttggttctctgcctctgactccgacaacacttcttcctttatttttacaggcttattactggcctcctcctcttcatctgaagactcatcgagctcccattcatcatctatgtccatttcaaatactctcacatgacgaagatttgagcttaacacacaggacacttttcgaaaaccattcccagcaacatactgtgctttcatactttccagtaatctccagtgcttctcgaaatgcatggtacgggtgggaatagcactacactgttcatctagccttgtagaataagtcccagtgaactgatattctgcagaatcttcactgttatatactaaagacaaaggcagctggaccaagagtctatctcttccttcacgtcctacagtgtctttaagaactactgttacagtttcatcatcataaaactgtgcatctaaacaactgtagatgcttcttctgactttttctgttgtggcatatgtaaagctcccaaatttaatagcaattagtccattactcacagattgagaaatatcagtatgtctccttaagatgcacattttataaagtgaatcttctagaatagtaaaaagaagataatgtagatttgaagttttattattccacagaaaaggaaatttgaacaatctacgtgtagaatcctcactaaaataaaagggaaaaagaaatgagaaaaatttaaattggctgcggaattacaccatccaataggtaaacagaattaccttctggtatctctatacaatggaatacagattgcttgattcatcgattttccaattacatcctatata

SEQ ID NO: 3305 - DNA, 1368 bp, Homo sapiens
  misc_feature (1)...(1368): n = A,T,C or G
ttttttttttttacaacataaatcatttaatgtaacatttgcaaccttagaaaggcagacatgtttaatccaagtccgtttataaattccaatttcacatggattaaaaactgcagataaattaagtcacaataatatcctgtacatgcattaaggctggtgactgctaaagtctcttgggaatctacaaataggaaatcacacgcagattactgggtctgaagagtgtctacattgttaaaaaaatcttgctttttttttttttggtgatgcagatttcaacagtaactctggaaaactgtgaaaaatgttatttaaaaatatatatgtatatgctactgcacagtttcaaagatgtgattcataaataatgttggctgcactgattaattttataacaattactgcacttccaagttgatgcgaacacgcagtgactcatactcaatattaggcactagtaatatccttcaggcgtactacagttttatgttagctgtattgtacatatatatttttaaatgtatgcatttatacaaactgtgtatattatgtatggggtgtcagaaatgtacacatcactgttatataatacacacatcattgttgtacatatgaggataagttttagtgcagaaagtctcattgcattgcattccatgtgttcaatctagtacacaatttgtcaactcttcagattatttttccagtacattcctcattagattgtgggtttcaagtttccatttgcaatttgaatgtttccagaaatctctgtcttaaccaaacctctctctccaggcacgattctgcacatgagtctgatctgtgtagagtagtatcatcaaaaatgccaaattttgatcaggaatatacctggactactctctttcaaaggcaattgaacatcgtgataaaggatagcatctattcaggtcatggaaggatatggtcagttgaacttgtgttgaactttggaggcaaatgtacgtcttcaaataaaaagacatggtaataaaaattatttgcttaaatttgagagtctctggaaggatatacatcaaactgtgagcagtggttgtctcaggcagaagggacaaccagggacttacactttctactttctacatttctgcactgtttgagtttttacaatgagtagatattacttttctaattagaaaacacaagaaaggtatttcaacttgaaacaaaactaaacaggccaggcatggtggctcatgcactttgggaggccgaggccaaaggatcgcttgagcccaggagtttgagaccagcctgggcaacatagtgagacccccatctctacaaaaaaaataaaganaaaattagccgggtgtggtgcac

SEQ ID NO: 3306 - DNA, 593 bp, Homo sapiens
tagctccaccatctctgcaacttgccaagatgcggcaagactatctgcaacaaaggtaaaatatacaggttttttattccaccagtgccttcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcatttcagctttgcgcttcaatccagggatttttgcttggattttagccatagcatctttaacattcttatttgcaagtcctagataatgatctacctatgttggtgccttgtttaatggtctgacactactgattttggctctcatttcactcttcagtgttcctgttatttatgaacggcatcaggcacagatagatcattatctaggacttgcaaataagaatgttaaagatgcttggatttta

SEQ ID NO: 3307 - DNA, 492 bp, Homo sapiens
aagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactgaagaagcttctaatggtgatgagctgggctgtatcacggaagcaccagcactaggaactgcagaattcaatggtgcttccataacaatgtcaggcaaaactggtgaaggagtagcttctgactcttcaaatgatgggcaaagctgtgctgcaggatagagtgactcttgcataacttctgatgtttgaaccaagtccatttttgtttcataagcaatctttgtaccagtaacttcattcaattcactttcacatgcttcctgtactaaatctggagtcaggccttcag

SEQ ID NO: 3308 - DNA, 826 bp, Homo sapiens
  misc_feature (1)...(826): n = A,T,C or G
tttttctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcaagtcctagataatgatctatctgtgcctgatgccgttcataaataacaggaacactgaagagtganatgagagcttcagagaatcaactanatcatcaactaagaagaggcgcgtgagttcgtttatcgtgcagttcacatgaccaagagcagaattactgtacttctgaaccaacncctcagatatagcaacttcagattccagatatnccctgaatgggtggccttcatctgatttctggatagcttggatcacacccttgtatatcctaaagctgatggtcacagagagcagggccaaggcaatgtaggctgttacgctcacaatgctgaanactgctctatctctctctnctctctctctctctctctctctctctcctctnntctctctctctctc

SEQ ID NO: 3309 - DNA, 539 bp, Homo sapiens
  misc_feature (1)...(539): n = A,T,C or G
tagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcaagtcctagataatgatctacctatgttggtgccttggtttaatgggtctgacactactggattttgggctcccattttcactcttcagtggtccnggttatttatgaacnggcatcaggc

SEQ ID NO: 3310 - DNA, 526 bp, Homo sapiens
caagtttttccactttaatgactatctctggagctaaagcggcagcaccagcttgttggttctctgcctctgactccgacaacacttcttcctttatttttacaggcttattactggcctcctcctcttcatctgaagactcatcgagctcccattcatcatctatgtccatttcaaatactctcacatgcaccgaagatttgagcttaacacacaggacaccttttcgaaaaccattcccagcaacatactggtgcctttcatactttccagtaatctccagtgcttctcgaaaatgcatggtacgggtgggaatagcactacactgttcatctagcctaaagagggaaaaaaaccaactcaggaatgaaaaggggatcttatcctccctagttttactacaggtggtattagggtcaattatggttttgacttctactcatacttctatttccaatataattttagcaactgttgtgttagaaaaaaagctgtgatataatattctataaaaattccatattcg

SEQ ID NO: 3311 - DNA, 679 bp, Homo sapiens
  misc_feature (1)...(679): n = A,T,C or G
aagtctataagctttattgatactttgcttttacagttcacaatgcattccacagatttagttcagtacagcttaaaccacaatgggataaatcctcattttggaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagagcataccagaagagcaagctttgtcattcctgctttacaggtatgatctcgtcttaacaacatatcatttcagaaaatctgcatcaatctacacggacgatacacagtgcgcaaactgagaagggctgtttnttttgttttctagacaacactatcacacatgctaacaccgtatactacctaccaaagaaacacattgcttt

SEQ ID NO: 3312 - DNA, 482 bp, Homo sapiens
ttttttgaaaaaataaaatttactgtttatttctttgttacacaaaggtggtccaagacatcttagtccatctcctatgtccttttggccataattacacacacaataatggcaagctagattaggagtctagctcagggtcaagtttttccactttaatgactatctctggagctaaaagcgtaagcaccagcttgttggttctctgcctctgactccgacaacacttcttcctttatttttacaggcttattactggcctcctcctcttcatctgaagactcatcgagctcccattcatcatctatgtccatttcaaatactctcacatgacgaagatttgagcttaactaaaaaagaaaaggccataaaagcatttttaaattaatggcttatcatatataaagaattagaaatcagaagtctgaatcaaagaatggttttataggaaagttatattcccatcaatttacaacaaaatc

SEQ ID NO: 3313 - DNA, 520 bp, Homo sapiens
  misc_feature (1)...(520): n = A,T,C or G
aaatggcccgttcccataaaaataaacagggaaaacnactggaaagaagtggaaaatggaagaagccttncaagaagaatccaaactaaaatccatccaactaaagaaagaaggcgccctgaagttccctttatcgtgcaagttccacatgaccaagagcaagaattactgtacttctgaaccaactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaaggaggtcaacaaccttgtccttccaatttttcttctgacccgtccatctcttgtcacngantctntttgcagctccaattattaattatgcataccaacag

SEQ ID NO: 3314 - DNA, 454 bp, Homo sapiens
tttttttttttttttttctttttttttttttttttggctctaaagggggtagagggggtggccgggccggaggctcgtcgtcctcagggagcttggagggcgaaactgcggcagcaaacagcggggatggcgcgggcacggtcgacgacaccgggctcgggtcccaagacggctgccgctccggggcgacggggggagcggccggcaggggtccccggggcgccggcggcacgaagtcatttccgaagtccatcaggggcgccccggcggcaggggcggtgggcactggggccgcggacagcccggcggcgggcttcctttccagcacctccagctcctccaggtcttcgtcctcgtcctcctcttcctcctcctcttcttcctcctcgtcctcgggctccctcacgaactggtacttgaacgcgggctgcggccggggtgggctgccgaggac

SEQ ID NO: 3315 - DNA, 438 bp, Homo sapiens
ttagatctatattgtttacaatgtgcaagattagagaacagaacctaaacggcaggactgaaaagactaaaccgaatgccagtgaaacagaacagcatgacatttgctggtatacaaccaaatgtaaaaacacggtgagatagccgttttaatcctttagacttcaactcttcagaggtttcactttcaatccaaaatatctaaattccaaagcttattcatagaaatatattagtggtcacatataaaaactgaataagaaattaaaaagcagatatacccttgtccttccaatttttcttctgaccgtccatctcttgtcacgatctgtttgcagctccaattattaattatgcataccaacagaaaagctgtaactgcacaaacctactccctgagacatgaaatacccgtttcctcaaccgaagtctgcagtct

SEQ ID NO: 3316 - DNA, 413 bp, Homo sapiens
atagcactacactgttcatctagccttgtagaataagtcccagtgaactgatattctgcagaatcttcactgttatatactaaagacaaaggcagctggaccaagagtctatctcttccttcacgtcctacagtgtctttaagaactactgttacagtttcatcatcataaaactgtgcatctaaacaactgtagatgctagaattaaaataagttttgttatatcaaagatgatcgtgactactgagaaaatattgtatgcatgttatactggcagcaagcagaaaaaaatttaaaagttaagtgacattctgtacaataacatttaaaatatatcattggtttgtattaaaatcagttactttttgtactgattattcacatatataaccaaatcttaaaaatggtaatca

SEQ ID NO: 3317 - DNA, 461 bp, Homo sapiens
  misc_feature (1)...(461): n = A,T,C or G
ctatctgcaacaaagtaaaatatacaggttttttattccaccagtgcctcagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcnagtcctagataatgatctatctgtgcctgaaagagaggtataaaggaattattaccgttgctaaagaagcttattaaccactacta

SEQ ID NO: 3318 - DNA, 528 bp, Homo sapiens
  misc_feature (1)...(528): n = A,T,C or G
ctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcctatttgcaagtccnagataatgatcgaccnatgttggtgccntgtttaatgggtctgacactactgattttggctctcatttcactcttcagtggtccnggttaattatgaacggc

SEQ ID NO: 3319 - DNA, 448 bp, Homo sapiens
ttttttaaaatttactgtttatttctttgttacacaaaggtggtccaagacatcttagtccatctcctatgtccttttggccataattacacacacaataatggcaagctagattaggagtctagctcagggtcaagtttttccactttaatgactaagagcagaattactgtacttctgaaccaactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaaccttgtccttccaattt

SEQ ID NO: 3320 - DNA, 547 bp, Homo sapiens
tttatagaaacagtctcacaatgttgcctaggctggtctcaaactcctggcctcaagcaatccttccgccttggcctcccaaagtgctgggattacaggcatgagctaccgcgcccggcccacattttcatcccctacttttcatacaatgagaatattctccactaaaatgtctaagctcctggcacacaatctttccagcaatttttcatcccaatgggctttgtagacttacccaaaatcagtaagtgtcagaccattaaacaaggcaccaacataggtaaatacccacatcaacactgcaaactataagaaaataacattagcccattataaacaaaattcaagtaaagtttcttaattatgctttcaaaagcatcccatctaaatgcctacctacaaaaggcatacaacttgaagactgggtaaagtaccatgagcagttcactattaagtcacgagtctcaattatgaatttcaaaatcctaaaataattaatagatttgacccattttctctggactacactaccaagtagttgattctg

SEQ ID NO: 3321 - DNA, 443 bp, Homo sapiens
cgcttggattttagccatagcatctttaacattgttatatgcaagtcgtagataatgatctatctgtgcgtgatgccgttcatcaataacaggtaccctgaagagtgaaatgagagccaaaatcagtagtgtcagtccattaaacaaggcaccaacataggtaaatacgggggagggtcagggaagaacgaaccttgacgttgcagtgcagtttcacagatcgttgttagatctttatttttagccatgcactgttgtgaggaaaaattacctgtcttgcctgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatg

SEQ ID NO: 3322 - DNA, 225 bp, Homo sapiens
  misc_feature (1)...(225): n = A,T,C or G
ataaatcatttaatgtaacatttgcaaccttagaaaggcagacatgtttaatccaagtccgtttataaatnccaatttcacatggnttaaaaactgcagataaattaagtcacaataatatcctgtacatgcattaaggntacttctaggtcagtatattccctggctaatttagaaaatgaatcagttttagaactgatcaatgtagggaactcatctataatt

SEQ ID NO: 3323 - DNA, 191 bp, Homo sapiens
caatacttaagatgatgaacacatggcagtcaagacaggtaatttttcctcacaacagggcatggctaaaaataaagatctaacaacgatctgtgaaactgcactgcaacgtcaaggttcgttcttcccaaccctacccctattttcggtgatttttgtgtgagaatattaatattaaaaataaacggaga

SEQ ID NO: 3324 - DNA, 144 bp, Homo sapiens
  misc_feature (1)...(144): n = A,T,C or G
naaaaccttggcctttccaatttttcttctgaccgtccatctcttgtcacgatctntttgcagctccaattattaattatgcataccaacagaaaagctgtaactgcacaaacctactccctgagacatgaaatacccgtttcc

SEQ ID NO: 3325 - DNA, 142 bp, Homo sapiens
  misc_feature (1)...(142): n = A,T,C or G
antccngtcttcttaatgtctctccagtacaggaggtcaacaaccttgtccttccaatttttcttctgaccgtccatctcttgtcagcgagtctntttgcagctccaattattaattatgcataccaacagaaaagctgtaa

SEQ ID NO: 3326 - DNA, 3870 bp, Homo sapiens
  misc_feature (1)...(3870): n = A,T,C or G
ttttttttttttttagattttgacattatttaatcataggagttcactccagtataccttttctgcctttgaataaggtatgaaccttcacaaaaagctaccatcatcattaattgggaatgtctccagtgtgaattttttggggcagattaagtcatacttcttggctcaagaaccagatgggatcctgaggttttttttttttttttttttttttttttttagagtataggagactttaataacttcataatgtctggtataaatgatatacctaaggctatggacgtctctccagcctaaattcccaaaggtacagtaagtctgcactgaacatcatcaataggttcttaggaactgcaactttaagtgaaatgatgtataacaaaaccaattttaccatagactaatggatacaaacaagagttaagttcctaaggcaaatgtctggtcacaacatcatcaaacttctaaagaccccaaacgcttccaatatcagacattaaaataaatctgagctatatacacatttaagacggattaataaaaacagataagataattatttaccctgttattccagtacagggccatgggtggacagagcgcatcctagcagctcagggcaatggtgggaacaaaccctgattaggagccattccactgcagggcacacttcctcacaaactcagactgagataatttagatatgtcaattaacctaatgtatacatctttggggtttgaaactggagcacccggagacatagggagagtgtgcgaactccacacagtgtccctggctgggaatcgatatttttctcatcaacatcataacaattataacattataacaaaacaaaaacatttttcaaggacctgctataaacaaatgcagattttaagaatacatatagattaacagcaatacatacttctcccattgcagttgataaccctttcccaactctagtctccattcaacagcaagacaacaaagggtattgtcaggagtggagtaaatggctgttactgttgtcttagccattgattcagagatttctgtccttagaagtattctcttatattcgcatgagctaatgatttcttgtgaccttcttaaaagggctgagttttattaaatatcaactccaagagtattgtttggctttgctaatgtctacttcgtcaataaatcaggtggatattagtatgctatagacctatttatgaactagggagaggtgagggtaatggatatcaaaataatgataaacaaatacttgtatggtgatactgtggtttaactccaaagccttatggcttcatctgaaaaccaggaaattccttcaaacagattttctatccaatgatttttctatccaacaattaaattctgtgatatcatttaagagggatatctgacaaatgttttcttacattattattcatgagattttatccagcataaattcatgatgttaaatgagttctgcattctgactgaaggtaatctttcattttttcttttttcaggacttatctcgagtatgcagtttttgatgtttaacaaggtttgaactcctgttgaaggctttactacattccttacatttgaatggtttctctcccgtgtgaatcatttggtgtcgaataagagaggagctccggttgaaggattttccacagttaacacattgatagaaattgtttccaaaatggagtgttggattattactgtcttcacttttactgaaggcctttccacatttattgcttgtgcaggcctttgcttcagcatgaagtttttgatgcttagtaaggtttgtacgtcggttgaagaatctcccacattcactgcatttatagggtttctctcctgtgtgaatgatctgatgtcgaataagggatgaacttcggcagaaggctttcccacattgataacattcataggaattcattgtagtatgacttttttggtgtcgaatatctgtactcaaactcaagtcattcccatattcatattctgaatgttgcttacctactgagtctaaattaaatttgaagtaagttttaaacttatcacattttggagacccctttcttgaaggaattcccagttgtatagcacaaattgagctaactgaattaatatcaaagcttttcttattttcactacattcaaaatcttcctcctcagtgtaaattgtctcaggaatgaaagcctcttgtggcaaatttatgtcccattttttctggttcctatataaccaattctcacctttccaggcatctgaagaagggtgtccactttcggtaagccttgtcataatcactccatgggatgattcttctccagaaatactcttcatgtcaaaaatagtcttccttggtatttctttctccattatccatctttttttcttactctccaacttaaggctctcaaatggtttggaaagtagatgtgctttacgcaatgaattcaggttcctaaagttttccagcatcacattcctgtacaggttctttacagcagagtccagttgcccccactcttccttgctgaattccacaaccacatctttgaatgtcactggttcctgtggtttgcctgttcgtgagccagctttcattttctccttgatgctccccatctgcagggcagagtccttgcagggcatatcttcatcttcaagcatttcaatcacatcttctatgagggtcaccatatctttactgttgtttggatgttgtaaattcacccaagtcctgacttcttcaggcaggattgccaggaattgttccagcaccaacagttctataatctgcttctttgtatgaatctctggtctcagccattgaagacagagctcccagagttggctcagggcttcatggggcccagacactttcaaatactggaaatgtctgaacttttgacgagatgcctcagagtcatgtgtctccacgacggggttggtttcctgctgccaagacatatctgctctcagaacctctctttgttcacgtagagacaggtttcgaggttttgagatagccatcaacttgctcagaggctgcatcttcctaaatagaactcccacagtagttcaaatccgccttactagattgcagtaattctcaggcttgagctaagcacctgtgtactatatgcagtgtgatttaagccaagttatttcacggtaaggaggaaagttccagaaactttagacacaaagccaatattcaggtacctgagcaatgtaaacagntacagagctaggacagggagagacgttcaggatggcatgctgcatttaggtaagatttccgaggtggaatagttttgatgatagagatccaaggtgtgacgtgactgcaagtagcttaagtggcaaatgatgaacaaagcgccagttctcagaggagccgcggaatcgctgtcttggacagtgaagggagctggcgttggtaatcacgctgcaactaggaatccctgacctcgccgaaccctcaactcactgccggctccgagtttcataaattgccgcggaacaacctcgacgcactcctgcgcacgcgcaccagctgtggaaggaaccccctaggagcccccgcgacctggatcggtgaggtagaccaggcctttgccagccccgtccctttctgcaggccccgcccacgccgcacacttggaactctggccctgtgaatggactcacggtgagcttctagtggcttaaagaaatgagcgtcatacttccggcgctgcctcatcccgtccggggaaactagtccaaatcgcctttctgttccccacaccccatttgtctggaatcaaaaaacaatgacaatttcgacaagaaa

SEQ ID NO: 3327 - DNA, 577 bp, Homo sapiens
tttcaggacttatctcgagtatgcagtttttgatgtttaacaaggtttgaactcctgttgaaggctttactacattccttacatttgaatggtttctctcccgtgtgaatcatttggtgtcgaataagagaggagctccggttgaaggattttccacagttaacacattgatagaaattgtttccaaaatggagtgttggattattactgtcttcacttttactgaaggcctttccacatttattgcttgtgcaggcctttgcttcagcatgaagtttttgatgcttagtaaggtttgtacgtcggttgaagaatctcccacattcactgcatttatagggtttctctcctgtgtgaatgatctttccaggcatctgaagaagggtgaccactttcggtaagccttgtcataatcactccatgggatgattcttctccagaaatactcttcatgtcaaaaatagtcttccttggtatttctttctccattatccatctttttttcttactctccaacttaaggctctcaaatggtttggaaagtagatgtgctttacgcaatgaattcaggttccta

SEQ ID NO: 3328 - DNA, 511 bp, Homo sapiens
tttttttttagattttgacattatttaatcataggagttcactccagtataccttttctgcctttgaataaggtatgaaccttcacaaaaagctaccatcatcattaattgggaatgtctccagtgtgaattttttggggcagattaagtcatacttcttggctcaagaaccagatgggatcctgaggtagtttacagaagacacagttctggtgtacagagtataggagactttaataacttcataatgtctggtataaatgatatacctaaggctatggacgtctctccagcctaaattcccaaaggtacagtaagtctgcactgaacatcatcaataggttcttaggaactgcaactttaagtgaaatgatgtataacaaaaccaattttaccatagactaagggatacaaacaagagttaagttcctaaggcaaatgtctggtcacaacatcatcaaacttctaaagaccccaaacgcttccaatatcagacattaaaataaatctg

SEQ ID NO: 3329 - DNA, 421 bp, Homo sapiens
tttttagaaagctgcacaaaaaggctttattatatgctgttctaaattaggagtttaggagataataaagggaaaatcagttacattaaagcctagtaaaggaggctgatcacagagcccttttctgatgttcatcctactctaatccagacacaaatgagagtggcttactttaccaagatgtgattgatttctttggtcaggctgagtctgccatccccatcttctcctgcagtgcttagtgcccctcattctgcttccttcagtgtgttctccctttccaggcatctgaagaagggtgaccactttcggtaagccttgtcataatcactccatgggatgattcttctccagaaatactcttcatgtcaaaaataggcttccttggatttctttctccatatccatcttttttcttact

SEQ ID NO: 3330 - DNA, 578 bp, Homo sapiens
ttttttttcattaaaaaacactgtacaaaaatcatggactttattatacattaaaaaatcttctaacaacttttttcctgaagccttgtcagtatatacctattgtgacaaaatgaaaaaataagttctccaccccacatgtataccaataccatgatcacataaagtcgagttcttcaaatccaattctaaagtgaaacattgcatgattttgaattgtacactgcatgattaatagtatcagtgaaataagaatcaattcacttacattacaaaatcaccaaatatacaaagcaattttgcatattagttacaacttaacccccagtctcatattaactgaagtaaatttcatgagtgaagccacagagattggttaaaaagtataatatagttccagtttcaaatctttatgtcttactagttaatgtagaaagacaaaatctcatgggagaagagtaaaccaaacttgctaaaaataaagggttgctttctacaattggtgtgtttaagtatttaaaatacaatctgaatgctaagaggttgtttcagaaccaacattaataatttcattttag

SEQ ID NO: 3331 - DNA, 386 bp, Homo sapiens
agcggccgccctttttttttttttttttcttttttttttttctttttttttcttttttttttttttttttttttttttttttttttcttgtaattttatacctattgttacaaaatgaaattttttttctccaccctacatgtataccaataccatgatcacataaagtggagtacttcaaatacaattctaaagcgaaacattgcatgactttgaattggacactgaatgattaatagtatcagtgaaataagaatcaattcacttacattacaaaatcaccaaatatacaaagcaattttgcatattagttacaacttaacccccagtctcatattaactgaagtaaatttcatgagtgaagccacagagattggctaaaaagc

SEQ ID NO: 3332 - DNA, 518 bp, Homo sapiens
acctctttttctgtatatatctactgatttttttaaattaatgcatataaacacattactaaactcttgaaaagttctaaagccctccaaaatacaaacaggttatattactaatgtttatgtattagactgatcattggtactaattagactgataattggtactaataatcatattgcctatgaaaccagtgttacaaatatgttctctaggttctattgcaaatcactataataatacactgaaatagtttcacattagaacttatttttttaaaaaagttgactgttccatttttttccaagcactagatgagaggttctgattcattaaaaaaaaaatatatatatatatatatatacacacacacacacacacatacatatataacactaaatattatgtaagcactaaaattctggaatttacattaaaaataagttaacaaagttttataagattttagtgaactatgaactttaacacaaacaatcctgccttagcctttggagtagct

SEQ ID NO: 3333 - DNA, 4488 bp, Homo sapiens
taaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacactgtggacaaatgagaaaagaacatggagtcacctttcacctcagcaagttcctgtcactgatgttatgttgaaggcagcaacaagacacatgcacaagcttaaaaccatatgactgggcctttaatgcccttcttctgactctgaaaatttcctccctactactctccctcctttgagtctctcaatcattttcttttttttcttttgagaaggagtctcactctgtggcccagactggaatgcagtggcgccatcttggctcactgcaagctccacctcccaggttcaagtgattctcctgcctcagcctcccaagtagctgggactacaggcacccgtcaccacgtccggctaatttttgtagttttagtagagacggggtttcgccatgttggcaaggctggtttctcaatcttaaatcaccccccccaccacccgccgactcctcccaggcatggtggtgggagcattggtctcttactattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggaccctataagatgaaagatttcaggctgaaattggagaggaagatgttggtaacatgggggttcaaatatgagacataaaaagtgaacaaaagaattattattaccacaagaacattggaattaggaaaccactttggtaaagtcatcgaactttagaaatgaaaaaggaaaaacaaacttgaaatcaactgtttaccaaaagggacaagcttacaaaacacatgcaatgattcatatctgggccaataaatagtccatggatatactgaaacagttctataaccaagcactctatatgccatgcatcttgtcagggagggagtaggagtatatgatgggaaacagatctgtcatccatagggaacatggtgggggaacatgaagaatggagagcacccaccttcttatcccagccacagatcatactgcccatagagaggcccatgccccggtactggcacatcatgttggacagcagcttggaggctgccgacactgaaatacgttctccatttcgcagatagtacagcctgggtgaggacaaggtggagtgaggaaagagaggttagctctttccaacttgatggggcaggaaatgattaaagagataagcattggaaaggaattattttgtaggatctaaagatcagagaaagatttggaatttaacgtatctgaaacatacaaaggcagcctagtaaatcatactgtcccgccagggtggatgtgtcagtgctaaatacctgacgtactatctggcttatgagtggagcacaggctgagatttgggagaagggtcttatcaccaaaaagctgttttgtgaaatatactattagcactaagatggaccacataggacaagagtaaggagcaatgatctgagagatccagggattaaccactaggctaagaaaggaagatgagaggcctcgcttacctgcattccttggccagcaggcgctcccagtactgacagtctgctgcacagccagacatggtgccaagcaggtaagggttaatctcaatcaccttgttcacccgtaaggcacctggaagaagatggagctttgggagagaagggatgaccccatagatcccccagtgtgtcctaaatcaatatccacttccactttgttgcagagttggcctcctgtggaaaggagagcccagctccccagattctgcctgctggagcgtatacactcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctgataagagaaaagaggttgagaaaggcaatgaaaaattctgtagtaagaggctccaggaaaaggttttagggagtatgagggtgaggagatatgcagaaatgatctaaccatcaataaatgaaacagttaataaccaatctctagaaggaaatggcttgggagaaggaaaagaagaggcatgccagtatcaaccttttccattttccagcacaacagaaatgaaagcaagcacatgttaccattactaaaaaattttgagagtgacttaaagggtttcttccatgcataaagcattcaaccctcacaaaacacgtttagtaacagtatcctcactttacagaagaggggcttgggacctagactaagtgacttgttctaagtcgcgcaacagtgagttgctgagaggaggccagcaggcaaatttcataggtttcccaagacaccacacacctcctatatcatgtgataaccccatgaaagaaggctccaccatttgtgtgtggacaagggcaggaaagttctcttgtcttcctttgggagcccccacctcacctgtaactctttgtcctaacttgcacttcctcctctcaggccccatccccatgtggcctcttctttgggtctggcgctctccgggactgaaggctacccccgaccctgtaccccgcgctcccgctctcgcctcctcctctcaggcgaccctccactcctcagcgcccgcctccctgcatccctaggggcttccctactgccccgacctgcattccccggggtaaagcgagctctggagatcgcatagagaaactgtagtgtcctgggtccgagcgacgcccgcttcccgcaaccgggagagccgattccggccgctgccctcggggggctccgcatacatctagtagcgccatgaccgccagcacccagagatctgtccgctctcggaggaggaagtgaaagcgaaagccacagatcgaaggggagggaacaagactcttttccacatccccctgccttttccgagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggtacctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtggtgagtttgtgaggcgcgcccagtccctctgttcccgcctggcacttggtctggccgggcccgccccatctgccacttcggagaggccacggctctgagcttgcggccgttagtgccctgatgggccctgtggttggggtcttgaacatctgggggtggcctaagggatagggaattggaagggcctcatagggactaaaaagcttaaggggaaagggtgatgcagttagggggtaaaacctttggggttgataaaaagaggaagacatccgcagctggaaaagtgcgctgcaaaaagcagtggcccgtttggtgtgccggaaacataagaaaccacagt

SEQ ID NO: 3334 - DNA, 1303 bp, Homo sapiens
ttttttttttatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggacccttcttatcccagccacagatcatactgcccatagagaggcccatgccccgggcacgggccatccatcttggtctggcagcctggaggcaccttggaggctgccgacactgaaatacgttctccatttcgcagatagtacagcctgcattccttggccagcaggcgctcccagtactgacagtctgctgcacagccagacatggtgccaagcaggtaagggttaatctcaatcaccttgttcacccgtaaggcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgccc

SEQ ID NO: 3335 - DNA, 1101 bp, Homo sapiens
tatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggacccttcttatcccagccacagatcatactgcccatagagaggcccatgccccggtactggcacatcatgttggacagcagcttggaggctgccgacactgaaatacgttctccatttcgcagatagtacagcctgcattccttggccagcaggcgctcccagtactgacagtctgctgcacagccagacatggtgccaagcaggtaagggttaatctcaatcaccttgttcacccgtaaggcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctgcattccccggggtaaagcgagctctggagatcgcatagagaaactgtagtcaggacggtccgagcgacgcccgcttcccgcaaccgggagagccgattccggccgctgccctcggggggctccgcatacatctagtagcgccatgaccgccagccacccagagatctgtccg

SEQ ID NO: 3336 - DNA, 927 bp, Homo sapiens
  misc_feature (1)...(927): n = A,T,C or G
tttatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggacccttcttatcccagccacagatcatactgcccatagagaggcccatgccccggtactggcacatcatgttggacagcagcttggaggctgccgacactgaaatacgttctccatttcgcaaatagtacagcctgcattccctggccagcaggcggctccagtacttgcagtctgctgcacagccagnacatgggccaagcagggttagggtaatctcaaatcacttggtcaccgtaaaggcacctatgtaggaaccagctgaggcccgagaatcccatgctgcatcaatccatgcttgaacttgaaagcccaacggtggggcaatgggcatcttaaattggaacttcttttttctcccccacccaggactgggaaaatttttgggttgat

SEQ ID NO: 3337 - DNA, 833 bp, Homo sapiens
  misc_feature (1)...(833): n = A,T,C or G
ttttatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctctttcagggctaagattaggccgatagccactgtccatgaccccgtaggcataagtgttcccactacccgtggagaacatatttcctgagagccgagtcccatgttcatccacgtagtagagtccaggacccttcttatcccagccacagatcatactgcccatagagaggcccatgcncnggtactggcacatcatgttggacagcagcttggaggctgccgacactganatacgttctccatttcgcanatagtacagnctgcatcctttggcagcaagcgcctccagtacttgcagtctgctgcacagccagaccatgtgcccaagcaggggaagggtaatctcaatcaaccttgttaacccgtaagcccttatgangacccagctgagccccaaaatccctggtggattcactcatgctg

SEQ ID NO: 3338 - DNA, 748 bp, Homo sapiens
tttataacccgttttcctttttcctccttggggggcccccggaaacttccctgggggaaatgcttgttcaaatagagaacacgcagaagatgcacttcaccggcctcctctggctgctgagcccgtactctctctttggctcaggctaggctcctccttctccttggacttaacgtggcttaggtccctgagtcggccaagacctcccagagtgagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgggctgccaaggtcataggcctcttcagggctaagattaggtccgatagccactagtccatgcaccccgtaggcataagtgttcccactacccgtggagagcatatttcctgagagccgtagtcccatgtatcatccacgtagtatgaggtccaggacccttcttatcccccagccacagatcatactgcccatagagaggatgcccatgccccgcggtaactggcacatcatgttggacagcagcgtggttggaagctcgcgacaactgaataaggttctccattggcaatagtaaaggctcgaatccctgggacagaggggctcccaataatcgaaaatcttgctgcaaggcagaaatggt

SEQ ID NO: 3339 - DNA, 661 bp, Homo sapiens
  misc_feature (1)...(661): n = A,T,C or G
ataaccggttttctttattctacttagtggggcacccagaaacttccctgggggaaatgcttgttcaaatagagaacacgcagaagatgcacttcactggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtangcataagtgttcccactacccgtggagaacatatttcctgagagccgagtcccatgttcatccacgtagtagagtccaggacccttcttatcccagccacagatcatactgcccatagagaggcccatgccccggtacctgcacattatgtttgacagcaacttgaaggtgtcgcactgtaatacctcttcattttcaaatatgcacaccttg

SEQ ID NO: 3340 - DNA, 735 bp, Homo sapiens
  misc_feature (1)...(735): n = A,T,C or G
tttataaccgnttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagaccctggccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtaggcatagtgttcccactacccgtggagaacatatttcctgagagccgagtcccatgttcatccacgtagtagagtccaggacccttcttatcccagccacagatcatactgcccatagagaggccccatgccccgtacttggcacatcatgttggacagcagcttggaggctgccgacactganatacgtttctcanttcgcagatagtacagcctgcattcttggccagcnagcgcctccagtaactgcagtctgctgacaggcaggacatgtgccaagccag

SEQ ID NO: 3341 - DNA, 653 bp, Homo sapiens
ccgtgtttctatattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagtcctcccagaggagacctgaccagctgccaccaccaccattattgaatggcttcccggtactggtgcagcaggtcactgacatctgtactttctactttcacccaaccatcttccttcatgtggtacatattgacaacgcctccagaatagctgtctctgtgagtggcataagcaatagccctgcgaccaaggtcataggcctcttcagggctaagattaggccgatagccactgtacatgaccccgtaggcataagtgttcccactacccgtggagaacatatttcctgagagccgagtcccatgttcatccacgtagtagagtccaggacccttcttatcccagccacagatgatactgtccatagagaggcccatgtcccggtactggggaatcatgttggaaaacagcttagaagctggcgacactgaaataggtctccaattcgaaatagtaca

SEQ ID NO: 3342 - DNA, 596 bp, Homo sapiens
  misc_feature (1)...(596): n = A,T,C or G
tataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtagcattaagtgttccactacccgtggagaacatattttctgagagccgagtcccatgttcattcacctaggangaagtcaagacccttcctatccccagccccgatcatactgcccattgagaagcccatgcccccgggtctggccatt

SEQ ID NO: 3343 - DNA, 599 bp, Homo sapiens
tttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatcgctgtctctgtgagtggcataagcaatagccctgcggccaaggtcataggccctctcagcggcaagattaggccgataggccctgtccatgaccccgaggcataagtgttcccactaccgtggagaacatatttccgagagccgagtccatgttcatccagtagtagagttccagaacccttcttatccagcccaagattatatggccctagagagggcccagccccgtaactgacaatcaggttggc

SEQ ID NO: 3344 - DNA, 585 bp, Homo sapiens
atttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtaggcataagtggtcccactacccgtggaggacatatttcctgagagccgagtcccatgttcatccacgtagtagagtcccgggcccttcctatcccagccacagatcatacggcccatagggaggccctggcccc

SEQ ID NO: 3345 - DNA, 554 bp, Homo sapiens
gaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattatggcgatagccactgtccatgaccccgtaggctaagtgttccacttaccggtgaggaacatatttccgagagccgagtccctgttcaatcccgtagtagagttcaggaccctcttattcaggcacagatcatatgtgccttggaagggccaattcccggtaatgggacatcatg

SEQ ID NO: 3346 - DNA, 594 bp, Homo sapiens
gtttttcttctatcccaattagtggggcaccacaaacttccctcggcgaaatgctcgttcaaatagcacgaacacgcagaagatgcactatcaccggactcctctggcctgctgagcccgtactctctctttggctcaggctacgcccttcttctccttggatttaacgtggcttaggtccctgagtcggccaagacctccaagagtagacctgtgcagctgccaccaccaccattattgattggcttcccggtactggtgcagcaggtccctgacatctgtactttctactttcacccacccatcttccttcatgtggtacatattgacaacgcatccagaatagctgtctctgtgagtggcataacgaatagccgtgcgccgaaggtcatagcgctcttcagggctaagattaggccgatagccaatgtccatgatcccgtaggcataagtgttccactacacgtggagaacatatttcctgagagccgagtccaatgtttcatcacgtagtagactccaggacccttcttatcccagccacagatcatactgcccatagagaggcccatgccccggtactcgcaaatcatg

SEQ ID NO: 3347 - DNA, 592 bp, Homo sapiens
ccgtttttctttattctacttagtggggcacccagaaacttccctgggggaaatgcttgttcaaatagagacacgcagaagatgcacttcacgggcctcctctgggtgctgagccggaatctctctttgggtcaaggtagggctcttcctctccttgggattaacggggcttaggtccctgaggcgggcaagaacttccagaagagaacctgccagctggcaccaccaccattattgattgggttcccggtaatggtgcaggaggtcactgacatctgtactttctactttcaacccaccatcttccttcatgtggtacatattgacaacgcctccagaatagctgtctctgtgagtggcataaggaatagacctgcggccaaggtcataggcctcttcaaggctaagattaggccgatagccactgtccatgaccccgtagcgataagtgttgccactaccccgtgagaacatatttcctgagagccgagttccatgttcatccacgtagtagagtccaggaccttcctatcccaccacagataatatgccatagagaggccatgcccggtactggcacatcatgtggaca

SEQ ID NO: 3348 - DNA, 557 bp, Homo sapiens
attctagtgagtgggggcaccaaaaacttccccgggtaaatgcttgttcaaatagagaacacgcataatatgcacttcaccggcctcctcttgctgctgagtccgtactctctctttggctcagtgtaggactcttcttctccttggacttaacgtggcttaggtcactgagtcggccaatacctcccagatgagacctgcccagctgccaccaccatcattattgattggtttcctggtaccggtgcagcaggtcactgacatctgtattttctactttcaccccagcatctctcttcatgtggtacatattgacaacgcctccagaatagctgtctctgtgagtggcataagcaatagccctgcggcacaaggtcataggctttttcagtggctaagattaggccgatatgcactgtccttggacccgtagggataagtgttcccactaaccggtgaggaatatattactggagagtcgagtcccatggttgcatccacgtgagagagtacagagagcttattattacagcctcagatgataatgaccttaagag

SEQ ID NO: 3349 - DNA, 522 bp, Homo sapiens
ttttttatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtaggcataagtgttccactacccgtggagaatatttctgagagcgagtccatgtctgttcatccacg

SEQ ID NO: 3350 - DNA, 471 bp, Homo sapiens
ttttttttatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaaggtcataggcctcttcagggctaagattaggccgatagccactgtccatgaccccgtaggcataagtgtt

SEQ ID NO: 3351 - DNA, 540 bp, Homo sapiens
ttttttttttttttttttttttttttttttttttatttataaccgtttttttttattttacttaggggggcacccaaaaacttccctgggggaaatgcttgttcaaataaaaaacacccaaaaaatgcacttcaccggcctcctttggctggtgagcccgtactctttttttggctcaggctaggcctctttttctccttggacttaacggggcttaggtccctgagtcggccaaaacctcccaaaggagacctgcccagctgccaccaccaccattattgattggcttcccggtactggggcagcagggcactgacatctgtactttctactttcacccaaccatcttccttcatgtgggacatattgacaacccctccaaaatagctgtctctgtgagtggcataagcaatagccctgcggccaaggtcataggcctcttcagggctaagattaggccgatagccactgtccatgacccccgaggcatagtgttcccactacccgggagaacatattttctgagagccgagtccatgt

SEQ ID NO: 3352 - DNA, 483 bp, Homo sapiens
  misc_feature (1)...(483): n = A,T,C or G
ttatttataaccgtttttctttattctacttagtggggcaccagaaacttccctgggggaaatgcttgttcaaatagagaacacgcagaagatgcacttcaccggcctcctctggctgctgagcccgtactctctctttggctcaggcnaggccncctcttctcttttgttttttatgtggtttagttccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgcctccagaatagctgtctctgtgagtggcataagcaatagccctgcggccaagggtcataggcctcttcagggctaagatttaggccgatagccactggtccaatgaccccgtaggcattaaggtgtttcccactaaccc

SEQ ID NO: 3353 - DNA, 510 bp, Homo sapiens
ttttttatttataaccgtttttctttattctacttagtggggcaccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccagcattattgattggcttcccggtactggtgcagcaggtaaagacatctgtactttctactttcacccaaccatattccttcatgtggtacatattgacaacgcctccagaatagctgtctctgtgaatggcaaaagcaatagccctggcgacaaggtcatagtgctcttcagggctaagattgggccgataggcactgttcatgaacccgtaggcagtaggtgtgaccagtacccctggagaacaaatatgtcctagagccgagttc

SEQ ID NO: 3354 - DNA, 938 bp, Homo sapiens
  misc_feature (1)...(938): n = A,T,C or G
attaccctgggcaaaggtcataggccttttagggctaagattaggccgatagccaantttccatgacccnttaggcanaagggttcccantacccgtggagaacatattncctgagagccgagtccaatgttcaatccaacgtagtagaagtccaggaccccttcttatccccagccaacaggatcattactgccccataggagaggcccatgcccccgggtactggcaacattcatgttgnacagcaantttggagggctgccgacacttgaaatacggttctccattttcgcaggatagtaccagcctgcattcctttggccagcaggncgctcccaggtactgacaggtcttgcttnacaggccagacatggtgccaagcangtaagggttaatctcaatcaccttgttcacccgtaaggcactaatgtaggacccagctgaggcccgagaatccactgctgcaatcactctatgctggaacttgaaggcgagcgtggtggttccatgggccatctcaatctgaacgttcctttctccgtccccacccagggactggaagaattctgtggctcccaggccccggcatgccgtcccgctggaaaacaggggtgggttagggtcgtgtcatctaaaggcgcagcttcaaccaagaagactagaagtcagcccaggagctgggagtagtgtcacgcggggtgggggttcctatgagcatcactttgcaaaaccaggagggacggaagtgcgagggggcagagtcttggaaacaggtcctgggccaactgcaacagaatatacccgccgcgtgtaggggaagcggcgccagggagagggcgcagtctctgaatctttccacggggtccatcctagggcccctccaggttcaacggtctcctaacctgtagtcacccacaagagcgtgccctttctgccc

SEQ ID NO: 3355 - DNA, 478 bp, Homo sapiens
ttatttataaccgtttttctttattctacttagtggggcacccagaaacttccctgggggaaatgcttgttcatatatatgagaacacgcagatatgtatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattggacaacgcctccagaattagctgtctctgtgagtgggcataagcaatagccctgcggccaaggtcataggcctcttcagggctaagattaggccgatagcactgtccatgacccgtagcataagtgttccactac

SEQ ID NO: 3356 - DNA, 474 bp, Homo sapiens
tttttttttttttttttttttttttatttataaccgtttttctttattttacttaggggggcacccaaaaacttccctgggggaaatgcttgttcaaatagagaacacccaaaagatgcacttcaccggcctcctctggctggtgagcccgtactctctttttggctcaagctaggccttttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacatattgacaacgccttcagaatagctgtctctgtgagtggcataagcaatagccttgccggcaaggtcataggcctcttcagggctaagataggccgatagccactgttcatgacccccg

SEQ ID NO: 3357 - DNA, 439 bp, Homo sapiens
ccgtttatgcttattctacttaacggggcccccaaaaacgttgctgggggaaatgctagctcaaatggagaaccccctaaagatgcacttgaccgcccagctctggctgctgagcccgtgctatctgtttggctcaggctaggccttttcttctccttggacttaacggggcttaaggccctgagacgcccaacacctcccaaaggatacctgcccaactgccaccaccaccattattgactggctgccctggtctggtgcatgaggacactgacgtctgtactttctactttcacccaaccatatgccttgatgtggtacatatggacaacgcctccagaatagctgtctctcggagcaggctatgcaatagccctgcggccaaggtaataggcctcttcagggctaagattaagccgatggacactgtggatgaccc

SEQ ID NO: 3358 - DNA, 435 bp, Homo sapiens
  misc_feature (1)...(435): n = A,T,C or G
ttccttggccaacaagcgnttcccaattattgaaagtctgctgcanagccaaacatggtgccaaagcaggtaagggttaatctcaaatcaccttgttcacccgtaaggcaccataaatgtaggaccccagctgaggcccgaagaatccactgctgcaatcactccatgctggaacttgaaggcgagcgtggtggtgccatgggccatctcaatctgaacgttcctttctccgtccccacccagggactggaagaattctgtgggctgcattccccggggtaaagcgagctctggagatcgcatagagaaactgtagtgtcctgggtccgagcgacgcccgcttcccgcaaccgggagagccgattccggccgctgccctcgggggcctccgcatacatctagtagcgccatgaccgcccagcacccagagatctg

SEQ ID NO: 3359 - DNA, 469 bp, Homo sapiens
actgctgcaatcactccatgctggaacttgaaggcgagcgtggtggtgccatgggccatctcaatctgaacgttcctttctccgtccccacccagggactggaagaattctgtgggctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgc

SEQ ID NO: 3360 - DNA, 349 bp, Homo sapiens
  misc_feature (1)...(349): n = A,T,C or G
ggcttctctnctctcccgttatgggggtcgggggaatnatgggtcaagggtcttccgaagaaagcgagaaaggaacaggcgccttcaaaagcccacttggcgatgggttacagtaagaggaagtctgcattatcacgaggagcttggaaaggaggtaacacactcaaggcaaatttcaagtaactcatcctggaggcagctgcctactctncagctgtggttctccaccacagagagaagaaaagggagggagatggagtgcgcaggtctgagaaggctttcattctggagcatcttcaggagcctncaccatggcccagtagcacccctttttctccatgagctgctn

SEQ ID NO: 3361 - DNA, 364 bp, Homo sapiens
  misc_feature (1)...(364): n = A,T,C or G
cttgtacttcctactttcacccaaaccaatcttccttcatgtggtacatattgacaacgcctccagaaaactgtctctgtgagtggcataagcaatagcctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggacccttcttatcccagccacagatcatactgcccatanagaggcccatgccccggtactggcacatcatgttggacagcagcttggaggctgccgacactgaaatacgttctccat

SEQ ID NO: 3362 - DNA, 324 bp, Homo sapiens
  misc_feature (1)...(324): n = A,T,C or G
tttcncagatagtacaagcctgcaattccttggccagnagacgctcccagtactgacnagtctgctgcacagcaaaacatggtaccaagcaggtaagggttaatctcaatcaccttgttcacccgtaaggcactaatgtaggacccagctgaggcccgagaatccactgctgcaatcactccatgctggaacttgaaagcgagcgtggtggtgccatgggccatntcaatctgaacgtacctttctccgtccccaaccagggactggaaaaaatctgtgggcaccaggcccgggcatccgctggaaaaaggggtgggtagggtc

SEQ ID NO: 3363 - DNA, 312 bp, Homo sapiens
  misc_feature (1)...(312): n = A,T,C or G
gcggaanctttaaacccaanaaagacttagaaattaancccagaacttggaagtaatgtcaacgcggggtgggggttccctatgagcatcacttttacaaaacccaggagggacggaaagtgcgagggggcagagtcttggaaacaggtccctgggccaactgcaacagaatatacccgccgcgtgtaggggaagcggcgccagggagagggcgcagtctctgaatctttccacggggtccatcctagggcccctccaggttcaacggtctcctaacctgtagtcacccacaagagcgtgccctttctgccc

SEQ ID NO: 3364 - DNA, 281 bp, Homo sapiens
  misc_feature (1)...(281): n = A,T,C or G
ccatagagaggcccatgccccggtactggcacatcatgttggacagcagcttggaggctgccgacactgaaatacgttctccatttcgcagatagtacagcctgcattccttgncagcaggcgctcccagtactgacagtctgctnacagccagacatggtgccaagcaggtaagggttaatctcaatcaccttgttcacccgtaaggcactaatgtaggacccagctgaggcccgagaatccactgctgcaatcactccatggcaccaccacgctcgcct

SEQ ID NO: 3365 - DNA, 254 bp, Homo sapiens
  misc_feature (1)...(254): n = A,T,C or G
ccaaaacattggtccaagcaaggtaagggttaatctcaatcaccttgttcanccgtaaaggcactaatgtaggacccagctgaggcccgagaatccactgctgcaatcactccatgctggaacttgaaggcgagcgtggtggtncatgggccatctcaatctgaacgttcctttctccgtccccacccagggactggaagaattctgtggctccaggccctggnatccgctggaaaacaggggtgggtagggtc

SEQ ID NO: 3366 - DNA, 267 bp, Homo sapiens
  misc_feature (1)...(267): n = A,T,C or G
cttccttncatgtggtcanatattgacaacgcctccagaatagctgtctctgtgagtggcatnaagcacatcanctgcggccaaggtcataggcntcttncagggctaagattagnccgatagcaactgtccatgaccccgtaggcataagtgttnccactacccgtggagaacatatttcctgagagccgagtcccatgttcatccacgtagtagagtccaggacccttcttatcccagccacagatcatactgcccatagagagc

SEQ ID NO: 3367 - DNA, 218 bp, Homo sapiens
atattccttcatgtggtacatattgacaacgcctccataatagctgtctatgtgagtggcatatgcaatagccctgcggccaaggacataggcctatttacggctaagattaggccgatagccactgtccatgacctcagaggcataagtgataccactacgcgtggagaacatattgctgagagccgagtccaggactatccatcgtctatagctca

SEQ ID NO: 3368 - DNA, 198 bp, Homo sapiens
  misc_feature (1)...(198): n = A,T,C or G
aggtcactganatctgtactttctactttnacccaaccatcttccttcatgtggtacatattgacaacgcctccagaatagctgtctctgtgagtggcataagcaantanctgcggcaaaggtcataggcctcttcagggctaagattaggccgatagccactgtccatgaccccgtaggcaataagtgttcccacta

SEQ ID NO: 3369 - DNA, 454 bp, Homo sapiens
  misc_feature (1)...(454): n = A,T,C or G
atcgtgattgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaagcctcccacagcttcgcgggcactggcttcctgaacacctctcctggcgtcttaggaatactccacggncgtggacatgtggtcagtgggctgcatcttcggggagctgctgactcagaagcctctgttccccgggaattcggaaatcgatcagatcaacaaagtgttcaaggagctggggacccccagttgagaaaatctggcccggctacagtgagctcccagtagtcaaaaagatgaccttcagcgagcacccctacaa

SEQ ID NO: 3370 - DNA, 931 bp, Homo sapiens
  misc_feature (1)...(931): n = A,T,C or G
aanngnnnnnnnnnngnnannnnnnnngannnnnnnnnnnnnnnnnannnnnnnnnnnnnnnnnnnnnngnnnnnnnnnnnnnnnnnnnnnannnnnnnnnnnnnnnnnnnnnnnnngnnnannnnnnnnnnnnnnnnnnnnagnnnnnnnnnnngnnnnnnnnnnnnnnnnnnnnnnnnnnnnnnnnnnnnanngnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnnnnnnnnnnnnnnnnnnttgnnnnnnnnnnnnnngnnnnnnannnnnnnttggggaannnnaanntggnnnannnnnnnnnntttgnagtcaannctggttaagnccaanttgaannncgtgggccgtnctgttcaagcgcatctccgagaagntnncgggcaatgttccggcgcaaggccttcttgcactggtananggggcgagggcatggacgagatggagttcaccgagnccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttgcagaccttccttcacccctgacttctgcttcacctttgacctctgccccccatgaatcccattttacctctagacctataagttctggtttatgnatgacncctcccactggaatncgnttcaccactg

SEQ ID NO: 3371 - DNA, 447 bp, Homo sapiens
  misc_feature (1)...(447): n = A,T,C or G
ccctttttttcccaaaaangaaaaggaatcgtggcggccttttnccgagaatgttgagggaaccttcactttcaacggactttgtggacatgttttccgtgctctgcgaagtcggctccccgagagcttcaaggcaaactatgccttcaagatctatgacttcaacactgacaacttcatctgcaaggaggaccttggagtgacgctggcccggctcactaagtcagagctggatgaggaggaggtggtgcttgtgtgcgacaaggtcattgaggaggctgacttggatggtgacggcaagctgggctttgctgacttcgagggctcttgctcctgtctctgcctctgggtcatgagtaccaccctgcctgcctccccaacaccgtggaatcctcactggtgtgctgtccacagatttgtgaactcctggtagtaaaacacttttgc

SEQ ID NO: 3372 - DNA, 1521 bp, Homo sapiens
ccagtgccaagcttggtaccactagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttctttttcgtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgcacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccacgagggtggcccgccggtttctgagccttctgccctgcggggacacggtctgcaccctgcccgcggccacggaccatgaccatgaccctccacaccaaagcatctgggatggcccta

SEQ ID NO: 3373 - DNA, 284 bp, Homo sapiens
  misc_feature (1)...(284): n = A,T,C or G
gcgcnngncggcggcnggcggccaccatggggaacaagcagaccatcttcaccgaagagcagctagacaactaccaggctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaaggggaacctcactttcaacgactttgtggacatgttttccgtgg

SEQ ID NO: 3374 - DNA, 219 bp, Homo sapiens
  misc_feature (1)...(219): n = A,T,C or G
ggaagatcgccttggagtccgaggggcgccctgaggaacagatggagtcggataactgttcaggaggagatgatgactggacccatctgtcttcaaaagaagtggacccgtctacaggtgaactccagtccctacagatgccagagntgacccgcggctgattgagtccctctcccagatgctgtccatgggcttctctgatgnaaaganggcggctgg

SEQ ID NO: 3375 - DNA, 400 bp, Homo sapiens
  misc_feature (1)...(400): n = A,T,C or G
tcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctctcggtccaccagctggtggaaaacacagatgaaacctactgcattgacaacgaggccctgtatgacatctgcttccgcaccctgaagctgaccacccccacctacggggacctnaaccacctgggtgttcggccaccatgagcggggtcaacaccttgcctgcggtttnccgggccagttgaacgcagaccttcgcaagtgggcggttgaacatgggttgcc

SEQ ID NO: 3376 - DNA, 516 bp, Homo sapiens
ctcggccgatcgaaagggagtcgggttcagatccccgaatccggagtggcggagatgggcgccgcgaggcgtccagtgcggtaacgcgaccgatcccggagaagccggcgggagccccggggagagttctcttttctttgtgaagggcagggcgccctggaatgggttcgccccgagagaggggcccgtgccttggaaagcgtcgcggttccggcggcgtccggtgagctctcgctggcccttgaaatcggggggagagggtgtaaatctcgcgccgggccgtacccatatccgcagcaggtctccaaggtgaacagcctctggcatgttggaacaatgtaggtaagggaagtcggcaagccggatccgtaacttcgggataaggattggctctaagggctgggtcggtcgggctggggcgcgaagcggggctgggcgcgcgccgcggcggcgactctggacgcgagccgggcccttaccgtggatcgccccagctgcggcgggcgtcgcggccgc

SEQ ID NO: 3377 - DNA, 372 bp, Homo sapiens
cccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggagagtcctccaagggggtttgttactctgaagaacgtaatgtcaataaacagcttttatgtaatgcccagggctgagcaccctgagcccccatca

SEQ ID NO: 3378 - DNA, 518 bp, Homo sapiens
  misc_feature (1)...(518): n = A,T,C or G
cctgccacacggncagncgaccccacttggtgccacagggtccagcctcggccactctgggctcaacctttccagcacgtctgggagcccaatgaggctatgggacagtgtgcatttccctcaaggcctccaataccatgtccccctgacgtgggaggtcaaagnagatttgcccaaccttttcattcatgccaaactgaacaatttgggcatatgcactctgagttagttttctcaagtcatcttgagcaccagttgtaattcttccaaagaagatttcttcagagactcgaccacctaaagtcatacacatcctatccaagagctgctctttggtatagaggtattgttcttttggtaaatactgagcataacctagtcctttgccacgtgggatgatggatacctttaaaagcgggtctgcgtgctccagataccagccggcaaccgcatggcctgcttcgtggtatgccacagtcttcttctcctcaggcatgcagaacctgcgttttcttctc

SEQ ID NO: 3379 - DNA, 1186 bp, Homo sapiens
catttcttcctcacttacttcttctgcaagagaaaggaggcgtctgctcagaccagcaccggggcgagtgctgccacagcacatgcgggctccgttcagctaagcaacaagtgtcccaagaatggatatggaggccgggcgcggtggctcacgcctgtaattcccagtgctttgggagccgaaggcgggtggatcacctgaggtcaggagttcgagaccagcctggccaacgtggtgaaacccgtctcgactaaaaataaaaaaattatgccgggcgtgcgttggggctgcgactcacctgatactcccagctactaggattgggaggcaggagaatcgcctgaacccaggaggtggaggttgcagtgagccgagatctcaccattgcactccagcctgggtgacagagcgagactccatctcaaaaagaaaaaaagaaaacagtgttgctatgttggccaggctggtcttgaactcctgggctcaagcaatcctcctgccttgccctcccaaagtgctggaattacaggcctgagtcctgtgcacctggctgggatggccttttgttcacactggttttgtttcataataaagtgtcagatggttttgcaaggaaagagactttgaaagaactgagctgctcccggctccacccctggcccagtccaaggctctcgcctgcacctgcccgtgccggtgtgccgtgcctgcggacgccgccctccctccagctggcatggccactgagacctcacacaggcccttcttccagggctgccggagcgtcgaggagttccagtgcctgaacaggatcgaggagggcacctatcgagtggtctacgagcaaaagacaagaaaacaggtgggtggggtcccctcaccccacaaaggcaggggaagtggggcaggggctggctgccgagagctgcgactgcacctgggttcccgtcctcacctgagcagctactggaggttggatttcccctcagcacctctagaagccagaggtcagcctggccctgggctttgccactcccttgcagtagcaggcggcctgcccacaggccgaggcccagcggcgtggagtggtctgtgccggggctggtgtgcaggtttgcgttcccagcgtcccacccaagcaggtgtgtgagccgggaactctgttgggagtcggccactgggatcc

SEQ ID NO: 3380 - DNA, 406 bp, Homo sapiens
tttttttttttttttttggccaaacaatttttattttcaaaaacaactttattcatgacacatattaaaaaaaaattcccacccctggaaatgagctaaaaaaataaacaaaatccacctcccacctccctgttcccacttcctcccattccctccaaataaaagggaaaaaaggcaaaggaaaaaaaaaaaaacaaaaaaacaaaacaactgaaaaacaaaaacacccctaaaccccccaaaacaaggtagtgcatttccccagggggaaggggaatttacactggagccgctgggagcggaacggagatcttccggctacagaaacctgcaaagaaaggcgaggataagacggagggaaggtaacaagcagaacagtttggggtccttccaaagccctgggtat

SEQ ID NO: 3381 - DNA, 749 bp, Homo sapiens
tgccctggcggccagctctgcacggtgtactacgcctccctcaactccgcgacatcatgctggccactggcaagctgtcccctgatgccatcccagggaagtgaacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctgaaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagtttcgccaactcccgggacacatccttcgagcagcatgtgctgtggcacacgggcgggaagggcgttgacctggtcttgaactccttggcggaagagaagctgcaggccagtgtgaggtgcttggctacgcacggtcgcttcctggaaattggcaaacccaagctgatgtcggccatctccaagaccttctgcccagctgaccgcatgggtgtgagccagcttgagaacactaactactcaataaaaacgaaagtggacatgcaa

SEQ ID NO: 3382 - DNA, 404 bp, Homo sapiens
gctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttaaaaaaa

SEQ ID NO: 3383 - DNA, 8460 bp, Homo sapiens
  misc_feature (1)...(8460): n = A,T,C or G
cggccgtcgacacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcgctgtccccgaccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccggcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgacccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcacttcccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcacccctcgggacatgtggccttcctcacctccactgagccgcagtatggccagggcatcctgagccaggacgcgtgggagagcctcttctccagggtgtccgtgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaacgctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggagggcccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccaggccatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctcggtgccgctgagcagtacacacccaaggccaagtaccatggcaacgtgatgctactgcgcgccaagacgggtggcgcctacggcgaggacctgggcgcggattacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgttcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagccngctgagtggggggtcgtgggccagtccccgaggagctgggcccctgcacaggcacacagggcccggccacacccagcggccccccgcacagccacccgtggggtgctgcccttatcgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctcccc

SEQ ID NO: 3384 - DNA, 590 bp, Homo sapiens
ctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgtggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaacttccaagttgtttgaatctggtcatgtgaaaacctatttaagccttggtttccacatctgaagaatggaggtagtctgaagaaaaatataaaaaacagtgaagtgggtactgttactacccccattttgcagatgtgaagagc

SEQ ID NO: 3385 - DNA, 749 bp, Homo sapiens
  misc_feature (1)...(749): n = A,T,C or G
aggaaaaggagggagaggagcgggtctcgnagaacagcatctactgcctcccctgttgtggatgagcgggagctgctcttctcagagggggcccagtactcccggctgggccgcagagctcccgtcccagcagactcctcttgacctgccctcccagctcagctactcccaggaagtgggaggacttttaagacaccattaaggaaacgctgcccatctcctccaccccgagcaaatctgtcctccccagaaccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcagtgcaccccaagcctctgagtgaggacagcaggcagggactgttctgctcctcatagctccctgctgcctgattatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtg

SEQ ID NO: 3386 - DNA, 536 bp, Homo sapiens
gcggccgctgatgggaggcggagcccgggcgggcgagcggcggcgcggcggccaccatggggaacaagcagaccatcttcaccgaagagcagctagacaactaccaggactgcaccttcttcaataagaaggacatcctcaagagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgactccaaccactgacaacttaatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgatgctgtaggggccta

SEQ ID NO: 3387 - DNA, 345 bp, Homo sapiens
  misc_feature (1)...(345): n = A,T,C or G
cctgcaagtttatatcagacaacttcgcttagctctccagggtaaaacgggtgaggccttaaaaacagaagagaacaagattaaagtcgttgcattgaaaataacaaacaatatcaatgttttaatcaaggcaaaagagagccagtgaagatacaacttcaggttcaccacccaagaaatcttcagcaggaccaaaaagagatgccaggcacgatttataaccctcccagtgggaaatatagcagcaatttgggcaactttaattatggtgagcgtttccgtttgggtacnaggaatatgaganattaggcaaaaattgtgttatactttattttaatggggatt

SEQ ID NO: 3388 - DNA, 2334 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttgcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttt

SEQ ID NO: 3389 - DNA, 302 bp, Homo sapiens
ggggtttgagggcctcagttgtatatcagaatcttcagagctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtaaagtaaa

SEQ ID NO: 3390 - DNA, 352 bp, Homo sapiens
cactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgtccacaggaagtgcttctaaagtcagaacaggttctccaaggatcccctcgagactactctgttaccagtcatgaaacattaaaacctccaagccttaaaaaaaaaaaaaaaaaaaa

SEQ ID NO: 3391 - DNA, 268 bp, Homo sapiens
  misc_feature (1)...(268): n = A,T,C or G
acagaagagnccaggtccngcggcctatcaggtgccctcgatcttgggtccncgcgtcatcggcaaagtctcngcccnaacttgctccatctcaacggagagcggctggcagtttcttcgaggacctcagcaagcaccggaagccccgcggctggagtttcgggatccggnactcggactacctggccccgctggtgaccgacgcggacaacatgnacgccaggcgggagcggccccacacgtgtttgcttaaagtctcgagtccgca

SEQ ID NO: 3392 - DNA, 364 bp, Homo sapiens
tggcttttcattggtttcatgttgatgtttgggtcacttattgcttccatgtggattctttttggtgcatatgttacccaaacactctgatctacaaatttggaagaaccgaagagctatggacctgagatcacttcttaagtcacattttccttttgttatattctgtttgtagataggttttttatctctcagtacccattgccaaatggagtagattgtacattaaatgttttgtttctttacatttttatgttttgagttttgaaatagttttatgaaatttctttatttttcattgcatagactgttaatatgtatataatacaagactatatgaattggaaaaaaaaaaaaaaaaaaa

SEQ ID NO: 3393 - DNA, 458 bp, Homo sapiens
gcgagtcgggggctcgcacgaaagccgccgtggcgcaactgaaggtgaaggccggcgcgctcgcgagtcgactgtgatccctcggccgatcgaaagggagtcgggttcagatccccgaatccggagtggcggagatgggcgccgcgagtccatggtgtcggtaaccgagccgatcccggagaagccggcgggagcccggggagagttctcttttctttgtgaagggcagggcgccctggaatgggttcgccccgagagaggggcccgtgccttggaaagcgaatcgtttccggcggcgtccggtgagctctcgctggcccttgaaaatccgggggagagggtgtaaatctcgcgccgggccgtacccatatccgcagcaggtctccaaggtgaacagcctctgcatgttgggacaatgtaggtaagggaagtcggcaagccggatccgtaacttcggg

SEQ ID NO: 3394 - DNA, 574 bp, Homo sapiens
tgagatcatgcagggattcatcagggctttcaggccctgcccaggcacctatggtacttgctggacttgaaacagatggaagagccgtgccgtttctagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccccttcagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtc

SEQ ID NO: 3395 - DNA, 319 bp, Homo sapiens
  misc_feature (1)...(319): n = A,T,C or G
gggccacatttgcccanagcctnggagttctcgcnnaggccgggacccggttccccggccccacagtgggggtttgcaaacccgtaaaaaactgggttgcaaattcttgaagaatcagcatcatgtttggcagctgagtattggagccaggagcctgccatgaggttttaagaacagagtgctgttttagagctggcagcagcatcttcagcccaagagaaggttatattcccagaggatgtcagtcccaaggnccaacatgcttgcnttatgtatcagaggacatgctcagcagatccaagagatatatttggcaact

SEQ ID NO: 3396 - DNA, 540 bp, Homo sapiens
  misc_feature (1)...(540): n = A,T,C or G
ttttgtaggtagaatcatttttattggagcatgacctgtttggggcttataactctgcagcccctatgggtagctgggggtgggggaagatagtatcaaaaaacggtgaagagagctgatgaggctgtggggactggctggaagctgctggcagggtggagtgggctggggccccggcagattcagatcgaggtacagcagcgttaataatactcttggagcgttaatactctggggaggggcaggcacttgttccttccgaagcatttcttcctgtgctgcgatgatctgggcaatgccgccaaccatcttctctttcaccaccactgtctcattctcctgctcttcaaaggctgcagccttctgtgctgctttcaccagattatctgaggctcgcttcactgcgttgccagcagcctgaagtcgtttcattgcctccgagtcctgggcagccttgaccttgcaagccacaaggagcttggctgtggaggcaggnctactgctggctgatgagatgagcttctcctggctggcatggcc

SEQ ID NO: 3397 - DNA, 371 bp, Homo sapiens
tgtgctggagttggaagagcgcgcgctactacgcgaagcccgactggggagagcccgaagctcagggggcatgcaggccacccctgccactgagggtctggcgcggccccaggctccttcatcgtccgccttccgttgcccctactgcaaaggcaagtttcgcacctcagcggagcgcgaacgccacctgcacatcctgcataggccctggaagtgcggcctgtgcagtttcggctccagccaggaggaggagctgctgcaccacagcctgccaagtgtgcggccagagctttacacagtcttggtttctcaagggccacatgcgtaagcacaaggcctccttcgatcatgcgtgtccggtgtgcggccgc

SEQ ID NO: 3398 - DNA, 1587 bp, Homo sapiens
gggcgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcg

SEQ ID NO: 3399 - DNA, 300 bp, Homo sapiens
tttttttttttttttttttttttgctgggctctgtggtttattggcgtctgattcctaaggcaccaggagaggctcttttccctggcgtctctgaccttgttccttgggacctttggacctgctggttaacttaggccttttgagggttcttaataagacaagctcacgaggggtagggccccctgaacattagggcaggaagggcccagttacaggtgcttcattcccactgccatccccaccctgaggcctgggagccagtctgccctgcttttcttctgcccggcagcagctcctgt

SEQ ID NO: 3400 - DNA, 440 bp, Homo sapiens
gtaggtagaatcatttttattggagcatgacctgtttggggcttataactctgcagcccctatgggtagctgggggtgggggaagatagtatcaaaaaacggtgaagagagctgatgaggctgtggggactggctggaagctgctggcagggtggagtgggctggggccccggcagattcagatcgaggtacagcagcgttaataatactcttggagcgttaatactctggggaggggccacttctgggtggtaagctgcttccttgcaagcccgaagcatatctgcaatagcacggcggctcagattggctgtggcaatgacatcttcctggcgacaggaattgccagcagcaacggccttggcggttgccatggtgatacccttggtcattcggatgaagtcttctggggtagaggtcttggcagttccaggtagcca

SEQ ID NO: 3401 - DNA, 337 bp, Homo sapiens
  misc_feature (1)...(337): n = A,T,C or G
agctttggatgtcangaaatttcctctgtgaggtccttgggaagttctgtttgcacttttccnagttcagagcgggaagtactgattggtttcccaggatgctcatttctgcccttggacccaaaacaagtggtgagagatactgccatgctgaagcttgtggagaaagtacaatcagagcctgcaaacaggcagtcctcagctctggaatctggatcacgacgtcgatatccttctgaattcggtcttgccctgaacacatccccattaaataaatccttggaaaagaagcagccgctatttccaccccaccccccntcgcaacnttntcantttc

SEQ ID NO: 3402 - DNA, 386 bp, Homo sapiens
ccaggaggccagtggagccgatggagaaggtggcagtggtaaccaggtgctcactcagggccaggcgttgctgggcttccggcgccccaatgctcagctccacaccctacccacccatcggcagcccctctgctgttccccagggacctctcatacactggccaggaggctgcagaacgtgtgtctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgt

SEQ ID NO: 3403 - DNA, 232 bp, Homo sapiens
  misc_feature (1)...(232): n = A,T,C or G
tagatacttcagccagcgactctctgagggctgcgatttttcctgctgcttnanattcccagcctgctggtgtcccacgttttcttcttnactggnactganagtttcttctagagacctgcaaaaaggactgcttctctccacaagctttgcatgtccacttgacactcttttttacctggtgcgcctggnagaggcggcagctgcagcagcgtagcacccgagaacgctg

SEQ ID NO: 3404 - DNA, 156 bp, Homo sapiens
  misc_feature (1)...(156): n = A,T,C or G
ccagggagccaanggcctgaaccagggggcatgccatggctgagggctgggcttgganattcgcggtttaccccctcgactttccacgcctcctgcccggggctgttccgggttaggacgggatgggggagcccagcagtgcccactgcacgcctg

SEQ ID NO: 3405 - DNA, 321 bp, Homo sapiens
aggtgcagatcttggtggtagtagcaaatattcaaacgagaactttgaaggccgaagtggagaagggttccatgtgaacagcagttgaacatgggtcagtcgctcgcccatctctcaggacgggcgatggcctccgttgccctcggccgatcgaaagggagtcgggttcagatccaaaggggaactgttgacactcgggccctttgagggggtttcttttggacttttttcatgttttcttcccaaatcaaaatttgtttaagtctcattgttagtaattctgggacaggttattaaaggatttaaatttgaaaaaaaaaa

SEQ ID NO: 3406 - DNA, 505 bp, Homo sapiens
tgtaggtagaatcatttttattggagcatgacctgtttggggcttataactctgcagcccctatgggtagctgggggtgggggaagatagtatcaaaaaacggtgaagagagctgatgaggctgtggggactggctggaagctgctggcagggtggagtgggctggggccagtttcttccgcgcctcttccagctctcgttccttccgaagcatttcttcctgtgctgcgatgatctgggcaatgccgccaaccatcttctctttcaccaccactgtctcattctcctgctcttcaaaggctgcagccttctgtgctgctttcaccagattatctgaggctcgcttcactgcgttgccagcagcctgaagtcgtttcattgcctccgagtcctggtcagccttgaccttgcaggccacaaggagctgggctgtggaggcagctacctgcttggctgatgagatgagcttctcctggctggcatggccttgtacagctgcattggc

SEQ ID NO: 3407 - DNA, 510 bp, Homo sapiens
ttttttttgcttttcaatcaggctgctttattctgttgtggcaggagttcccgggcccctgggcaccacctctgcccactcccatcctctccccaagctcccatttctccagggcttgtccctgcggtgtgggcagaagcagcttcttgcccgtctgcaaaagctgcaaaagaccctttgcccggggcgtttcctttcccgttggggcttccactgaccctgctcaccggaggcgtcctagatgtagtagagcggcacctcgccacacagggtgctcaagactggggatgctctctggagctatcttcatgatgtagcagcaggtgccaggggctggcttgtaggcgatcagcagctgctggtagtcatacaccacgaggccagtggagccgatggagaaggtggcagtggtaaccaggtgctcactcagggccaggcgttgctgggcttccggcgccccaatgctcatctccagaaccatcaggacctctttgctgcccacatccatct

SEQ ID NO: 3408 - DNA, 312 bp, Homo sapiens
ccatcatcctaagcccaaagtagaaaatggtaaaaggtagtgggtagaagtccctatataaggaaggggatgggattttcccttctaaaagttttggagagggaaatccaggctattaaagtccctaaatttctaaggatggccattttttccttttgctggtgcttcccccctcacacacttggttttgttttatcctacatttgagatttttattttatgttgaacctgctgctttttttcatattgaaaagatgacatcgccccaagagccaaaaataaatgggaattgaaaaaaaaaaaaaaaaaaaa

SEQ ID NO: 3409 - DNA, 712 bp, Homo sapiens
atcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 3410 - DNA, 424 bp, Homo sapiens
ggtcacacaggctgtgagtgagccatgcccagcttctccagccccttggccaggacaaggagcctggagtctgggtctgggggtggcccctgagggtgggctgagtgggcagctgcagccctgctccctcctccctcccaccagctggtgggccagccggccgtacacttgaagcgtgacttcttcctggccaatgcgtctcgggcgcgctcagagcagttcatcaacctgcgagaggtcagcacccgcttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgaaaaaaaaaaaa

SEQ ID NO: 3411 - DNA, 372 bp, Homo sapiens
agcagttcacatagtttattcagcaatataacaggagagaacctccattgtaagagacataaggcagatacagggtgcatctctggggtacattcttcatacagactaacaaataacttcaggtttcacaacatgtagcaagtatgatttgttgcacaccaacagccattcattcctcacgttttccttgctaaaagagccctggtcaggcacggtggctatgcctgtaatcccagcactgtcggaggtcagggcaggtggatcatctgaggtcaggagttcaagaccagcctcaggtgatctgcctgcctcagcctcccaaagtgctgggattacaggcgtgagccaccacgcccggccacgttctgagtt

SEQ ID NO: 3412 - DNA, 432 bp, Homo sapiens
caacgtgaacatcttcgacgccatcgcggagattgggaaccagctgtatttgttcaaggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggttcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaa

SEQ ID NO: 3413 - DNA, 395 bp, Homo sapiens
agggggaggtcggctttccatttccagatgttaccgtccagctgctgctcgccgctgctggattccagtttcctccccttctggcgatggattggtgatgacaccgagtctcactttctccttcccccgcccggaccaaccgccgtggggggccgagggtgccggggacggcaggagagcgatcaccggctgggcggcgggagccgacgaggggcgagccccgctccggccttccctctccgcgctctccccccgtcacttttatgaattcgactccactttctaaaggaattatgagtcttgtggcaaacacaaaccggagtggccgggagggggaaaaggggggaaaagaaaatctttaaaaattaaaaaaataataaaacgaaaaaaaaaaa

SEQ ID NO: 3414 - DNA, 390 bp, Homo sapiens
ggcggccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgcactttccacatccggatctgaggacactgccga

SEQ ID NO: 3415 - DNA, 394 bp, Homo sapiens
actgcgagaaaaaaaatacttatttcttgccccatacatacctttctcagccaccatgagtgtgtcaccacctgcctccgtttccctggccagctcaatgctgacctccgcaagttggcagtcaacatggtccccttcccacgtctccatttctttatgcctggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaaggga

SEQ ID NO: 3416 - DNA, 406 bp, Homo sapiens
tcggcatggctatcttcctgaagaacgtgacattccacggggcagccacccaagcctgctgctgcggccccttctcggccaggcattggctcagcccgctgagtggggggtcgtgggccagtccccgaggagctgggcccctgcacaggcacacagggcccggccacacccagcggccccccgcacagccacccgtggggtgctgcccttactgccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctcc

SEQ ID NO: 3417 - DNA, 563 bp, Homo sapiens
tttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgc

SEQ ID NO: 3418 - DNA, 428 bp, Homo sapiens
ggaccaccttctcccgagccgagcacgaaggtttcagaggaagccgagtcccagcagcagtgggatacttcaaaaggagaacaagtttcccaaaacggtttgccagctgaacagggatctccacggattttacagcgaaacccttacatgagtaattgaaatgaaattaaatgagattacagcataatgaagaagaaaactagaatctaacagatggcagaaacggtggacacaagcaaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggc

SEQ ID NO: 3419 - DNA, 392 bp, Homo sapiens
tcgaagaggagggagaatgttgaagcacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggaaccagggaaaatgtgtagagggcatggtggagatcttcgacatgctgctggctacatcatctcggtt

SEQ ID NO: 3420 - DNA, 337 bp, Homo sapiens
cagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttacccagtgctgacccggacctcctccaggatacagcactggagttggccaccacctcttctacttgctgtctgaaaaaacacctgactagtacagctgagatcttggcttctcaacaggg

SEQ ID NO: 3421 - DNA, 708 bp, Homo sapiens
  misc_feature (1)...(708): n = A,T,C or G
aggcagccctgtctgaggccagaggtctgcccacgtggcggatgaggcaggtgtgaggccagcttgagcatctggatccatttgtctcgggctgctggctgcctgccatttcctcctctccacccttatttggaggccctgacagctgagccacaaacaaaccaggggagctgggcaccancanagcgtcaccctctgtttccccgcacgggtaccagcgtcgaggagaaagaatcctgaggcacggcgaatttgctggaccatttggaagaaaagatgcctttagaagatgaggtcgtgcccccacaagtgctcagtgagccgaatgaagaagcgggggctgctctcagccctnccctgaggtgcctccctggaccggggaagtcagcccagcccagagagatggaggtgccctcgggcgggggccctgggacttcctctgatcgatctgccctcctaaaaagcaagctgagggcgctgtcactgcccctcggagcctgcggagatccagctgcttcgggggcaggatggacaggattggagcccagagcggactgggctgtaacagttccggtactgaagataacagccagggaggacaagcagggtggggcttagggacagactgcaagaggctcctgtcccctgggttctctgctgcatttgtgtcatcttgttgccatggagttgtgatatccatctaagctg

SEQ ID NO: 3422 - DNA, 423 bp, Homo sapiens
  misc_feature (1)...(423): n = A,T,C or G
cctggtccttgttccggtccaagtcttccatcanccttgcaatttcagcatcctgcagcttcgagccaatggtgagctccttctggatcagctccttcagctccttcttgctcagggtgtgcttgtcaccctccctgccggagtacttgtggaagatggccacgaggagccaatggcctgatccagggggcatgccatggctgagggctgggcttggagctggcacagcactgctgctcctgactatccctccagcgggggagcgccacagatggccccagtctggatccagcggctgaactgggcaggggatggctggacccccagcgtgagggcagctggccattcgcggtttaccccctcgactttccacgcctcctgcccggggctgttccgggttaggacgggatgggggagcccagc

SEQ ID NO: 3423 - DNA, 352 bp, Homo sapiens
taggtagaatcatttttattggagcatgacctgtttggggcttataactctgcagcccctatggtagctgggggtgggggaagatagtatcaaaaaacggtgaagagagctgatgaggctgtggggactggctggaactgctggcagggtggagtgggctgggaccggcagattcagatcgaggtacagcagcgttaataatactcttggagcgttaatactctggagaggggcaggcacttggggggccctaggcagtgaaggcacttggggttgcggaggggacatgggatgtactgtcttaagcaatgatgtcacattggtcaccatcaccttggcagagttctttagc

SEQ ID NO: 3424 - DNA, 519 bp, Homo sapiens
aggctgagagctgtgactgtctgcagggtttccagctgacccactccctgggtggggggactgggtctgggatgggtacccttctcattagtaagatccgggaggagtacccagacaggatcataaacacattcagcatcctgccctcgcccaaggtgtctcagagcagtttacagcaatgttcatgcgcaaggccttcctccactggtacacgggcgagggcatggatgagatggaattcaccgaggccgagagcaacatgaatgacctggtgtctgaatatcagcaatatcaggatgccacggccaaggaggaggaggatgaggagtatgctgaggaggaggtggcctagaactctccttttctaggtaaagcgggggaggcagtgtgtattcttcactgtgttgtgacagctatgtgtcactacgcacttgttcatttgtgtcttcacatctcctgctgctgcattttaaagcacttttatagtgtgcagttttgactaataaagtattctcacag

SEQ ID NO: 3425 - DNA, 565 bp, Homo sapiens
ggtgcgtacggcgagaacttgtgcgcggactacaccttctcccagttatgcgacgggaaagtatccgtccacgtcatcgagggtgaccaccgcacgctgctggtctgtgaagagccgttggtgcccgtgcccgcaggaatctgggctgggcctcgtgcgcccgtggggtctgcgcttggtctttctgtgcttggatttgcatatttattgcattgctggtatagacccccaggcctgtccaccctgccaagactcctcaggcagcgtgtgggtcccgcactctgcccccatttccccgatgatcctgcgggcgcgggcagccaccctaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgccctatatcgccggcgccgggcaccaactccatgtttggtgtttgtctgtgtttgtttttcaagaaatgattcaaattgctaa

SEQ ID NO: 3426 - DNA, 285 bp, Homo sapiens
  misc_feature (1)...(285): n = A,T,C or G
cgtcgacggtggtagtagcaaatattcaaacgagaactttgaaggccgaagtggagaatggttccatgtgaacagcagttgaacatgggtcagtcggtcctgagagatgggcgagcgccgttccgaagggacgggcgatggcctccgttgccctcggccgatcgaaagggagtcgggttcagatccccgaatcctggnatgtcggccggaaaggcggccgccccctcgcccgtcacgcaccgcacgttcttggggaacctggcgctaaaccattcgtagtcgacc

SEQ ID NO: 3427 - DNA, 832 bp, Homo sapiens
  misc_feature (1)...(832): n = A,T,C or G
aactgtggcctaangcactttcgtcatcattgnggatatgatggactatgattaaangagcctctagntatcttcgaatctgagtgccacacactagggatttaacactttntcagcaacatgagtgttcaccactgcttcgtttcctggccagtcaatgctgactccgcaagttgcagtcaacatgtcccttcccacgtctccatttctttatgcctgntttgcccttctcaccagccgtggaagccagcagtatcgagctctcacagtgccggaactcacccagcaggtcttcgatgccaagaacatgatggctgcctgtgaccccccccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaagcagagcccccatcacctcaggcttctcagtnaaggtctagacatgctgcacatagtaggcgctcaataaatacttgtttgtt

SEQ ID NO: 3428 - DNA, 455 bp, Homo sapiens
ttatgtgggggttgaggctcagagcaagcgggggatcctaactctcaattaccctattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctactcctctggccgcacgacaggcatcgtcctggattcaggtgatggcgtcacccacaatgtccccatctatgaagtgcttctaaagtcagaacaggttctccaaggatcccctcgagactactctgttaccagtcatgaaacattaaaacctacaagccttaaaaaaaaaaaaaaaaaaaaaa

SEQ ID NO: 3429 - DNA, 471 bp, Homo sapiens
catgagggaaatcgtgcacttgcaggccgggcagtgcggcaaccaaatcggctgcacttcttcatgcccggctttgccccactgaccagccggggcagccagcagtaccgggcgctgaccgtgcccgagccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgtgaaaaaaaaaaaaaaaaaaaaaaaaaaaa

SEQ ID NO: 3430 - DNA, 401 bp, Homo sapiens
cgacgtgcgaagccagaggaaactctggtggaggtccgtagcggtcctgacgtgcaaagtcgtcgtccgacctgggtataggggcgaaagactaatcgaaccatctagtagctggttccctccgaagtttccctcaggatacgtggcgtctcgcagacccgacgcacccccgccacgcagttttatccggtaaagcgaatgattagaggtcttggggccgaaacgatctcaacctattctcaaactttaaatgggtaagaacgcggctcgctggcgtggagccgggcgtggaatgcgagtgcctagtgggccacttttggtaagcagaactgcgctgcgggatgaaccgaacgccgggttaaggtcgacggccgcgaatttagtagtagtaggcggccgct

SEQ ID NO: 3431 - DNA, 214 bp, Homo sapiens
gcctttggagatgaggtcgtgccccacagtgctcagtgagccgaatgaagaagcggggctgctctcagcccctccctgaggtgcctcctggaccggggaagtcagcccagcccagagagatggaggtgccctctgatcgatctgccctcctaaaaagcagctagggcgctgctcactgccctcgagcctccgagatcagcttcttcggggcaga

SEQ ID NO: 3432 - DNA, 383 bp, Homo sapiens
cccccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccactcgggttctgccttcaaagctagtagctgccccagccacacacgtcgcggtcggagaactgagaagggggcgctgggtccgaggttctggaaaagcaagaactcacctgcaaacaggcagtcctcagctctggacttctggatcacgacgtcgatatccttctgaattcggtcttgccttgaacacatccccattaaataaatccttggaaaagaaaaaaaaaaaaa

SEQ ID NO: 3433 - DNA, 466 bp, Homo sapiens
  misc_feature (1)...(466): n = A,T,C or G
ctcatggcgacactgaaggcccctctgagggtccacgatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgnctcctggatggagtctcgctctgtcaccaggctggagtgcagtg

SEQ ID NO: 3434 - DNA, 197 bp, Homo sapiens
gtctctccagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggtaggcgtgg

SEQ ID NO: 3435 - DNA, 253 bp, Homo sapiens
tgatccacaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggtgagccggg

SEQ ID NO: 3436 - DNA, 176 bp, Homo sapiens
ctccctccaggatacagtttgttcctcgtggcggcgcatgagttcggccacgcgctgggcttagatcattcctcagtgccggaggcgctcatgtaccctatgtaccgcttcactgaggggccccccttgcataaggacgaggtgaatggcatccggcacctctatggtgaggcagg

SEQ ID NO: 3437 - DNA, 482 bp, Homo sapiens
ttttttttgcttttcaatcaggctgctttattctgttgtggcaggagttcccgggcccctgggcaccacctctgcccactcccatcctctccccaagctcccatttctccagggcttgtccctgcggtgtgggcagaagcagcttcttgcccgtctgcaaaagctgcaaaagaccctttgcccggggcgtttcctttcccgttggggcttccactgaccctgctcaccggaggcgtcctagatgtagtagagcggcacctcgccacacagggtgctcaagactggggatgctctctggagctatcttcatgatgtagcagcaggtgccaggggctggcttgtaggcgatcagcagctgctggtagtcatacaccacgaggccagtggagccgatggagaaggtggcagtggtaaccaggtgctcactcaaggcccagcgttgctgggcttccggcgccccaatgctcatctccagaaccatc

SEQ ID NO: 3438 - DNA, 363 bp, Homo sapiens
actcgccccggcggggcgcgggacatgtggcgtacggaagacccgctccccggcgccgctcgtggggggcccaagtccttctgatcgaggcccagcccgtggacggtgtgaggccggtagcggtctcgcgcgcgccgggcccgggtcttcccggagtcgggttgcttgggaatgcagcccaaagcgggtggtaaactccttcacaatgtgaagctgtgggtgcagtggcgccaagggctcttgctcctgtctctgcctctgggtcatgagtaccaccctgcctgcctccccaacaccgtggaatcctcactggtgtgctgtccacagatttgtgaactcctggtagtaaaacacttttgcatc

SEQ ID NO: 3439 - DNA, 333 bp, Homo sapiens
gctagagaagagaaatgttcacatttgggagagtaagagaactgattatcaaggattgatagtgaactgtcaggaaaagaacctaaaaagtacagtcgccacagagacaactaggtgttcaggaaagaaaagttgatagtgacagtactgcccaggaacgctgaaggactaagaaaagtttttgagacagctaatacagcttcctggtttgggtagaaccctggttgtagggcatggaagatagaggatttgattgttgtgtggaaagtataaggaaagagaaaaattaaaggagatgaggttgaggaaagtttggtttttaagggaagttct

SEQ ID NO: 3440 - DNA, 427 bp, Homo sapiens
gggctgcagcagatcaccggccacggcggtctccgaggctatctacgggtttttttcaggacaaatgatgcgaaggttggtacattagtgggggaagacaaatatggaaacaaatactatgaagacaacaagcaattttttggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgact

SEQ ID NO: 3441 - DNA, 378 bp, Homo sapiens
agatgtgacagccaccgtggacagcctgccactcattcacaggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgccctgcaggaggcgctcgtactctccgaccgcgcgccattcgccgccccctcgcccttcgcagagctcgttctgccgccgcagcaataaagctcctttgccg

SEQ ID NO: 3442 - DNA, 449 bp, Homo sapiens
ttttgtaggtagaatcatttttattggagcatgacctgtttggggcttataactctgcagcccctatgggtagctgggggtgggggaagatagtatcaaaaaacggtgaagagagctgatgaggctgtggggactggctggaagctgctggcagggtgcagtgaataagatgcctatgtacaagacagtggaatagttcacctcaaaggtttacaagataacatttgtaagacttgagtgacagaggcaaaattttagcagtttctcaagactcttggagttgagcagatttgagaagggaaatcagaatcgccgagccttgccatctgtcagtggttttggtctgtcccaagatgttctcaatcatgtgcttcctgttgaacaatctaacaaaataccatacgggggtagagaaatctctgcaacactgacttttggtcagtgaatca

SEQ ID NO: 3443 - DNA, 596 bp, Homo sapiens
gcgctctgcggcccagtggactgcggctggggaccccagcactgacgtcccgtggacttttggaaaaagacttccaaaaagtagcccactttattcacagagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttg

SEQ ID NO: 3444 - DNA, 1218 bp, Homo sapiens
agcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctga

SEQ ID NO: 3445 - DNA, 559 bp, Homo sapiens
tttccagattcacccaagggctcttttattgttattatggagtcattgacaagtatcgatcacctactccatgcctggctttctgctagatgctgccttggtcacacaatcactgacacattatgaagaaaactgcattacaaacctctatactctaacagcaagaccagtcccctaccgcctggtcttccttcccctgcctgggccagagtccctgcacaactcccaagacaccagagcagagcgtgagtaagggcaggctctgcccctgggtgcgtgctccagggccgtggacagttatgggaactgtctacaagcagcacagggagttcacattttacatttcataggcaatggagtatcagatggagttaaaatggttcttctggggatcaattctcatgctcctggagcctgacctagagtctagccaaggtactcagactgggcacagcagcaggggccacctgtgcccacttaacttcagtctcaaaagccaagactttgccttccaaaacatacaatcgactttacatgcatcttgatgtcagagagctca

SEQ ID NO: 3446 - DNA, 594 bp, Homo sapiens
agagcccagcgccgaatccccgccccgcggcggggcgcgggacatgtggcgtacggaagacccgctccccggcgccgctcgtggggggcccaagtccttctgatcgaggcccagcccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttcctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgact

SEQ ID NO: 3447 - DNA, 687 bp, Homo sapiens
ttttttttgcttttatgatatttaattagtttaagcatggtgttagaagtgtcattagaatttactctgataaaagtatttatcattttgactaatttcttaaaactagtatatttcaaagtatattaaacaaacagaataataatagaaacttgatgacattatgtatatactacatacaactacagtaaatacaattataaaatcctgtcatttctaattcctataacaaacctgtatagaaaaatttagctcctggtaccactgatttcaatccacacagaagtaaacggttctggtacataagcctaaactatcttatttaatttgatgttcaacgttttccaaacagatggcttctcttagctcatttaagcccttattatattacaaatagacactctggaaaattaaaatccccaccactgctaaatctaaacctattgtatagattgctaaaggtacctgatgagctaatgaaattattttaaaataatgtgtaggcacacttgacagaataaaactagatggctattaccaaaaatatactctagaatatatggaacctttcaaaagggaaaaaaattacaaacctttgttgcatagacagcttcttcttatagctttgcacttcttcttcttctttgaggcatcatattctcccctcagttgaaactttgccacctc

SEQ ID NO: 3448 - DNA, 1109 bp, Homo sapiens
ggggaatgccatgtaggctctgatagagttgtctatcggtctgtttgtgaatgccctttcgcttaaacttccagcccttctggtggcatccttggttgtaaggtggctgctgtataacgtccactctctttcatatttaatatgtgtgattgttactgttgtctttttgttttaaagtaaccataagaggagatgatctgagttatatttattgatcagaggaatagagtgcagtaaaactcatactggcatttcgcttttctcatttccctgtaaatgggcgggtattaatccattcccaccttctaatgtccttgatgtccagctggctttgtgggtgtgcaatggttttactgtactgcctcgatctgtgccaggcatttatacacagccacatgtgcgagtcaggtagagcgtatgtggtcacccccatggctcacggagttagctgaatggcctctccgctgtccctagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaaggtccctgtgagtttgaaagaagctgtctgcgaagtggcccttgattacaaaaagaagaaacacgtattcaagctaagactaaatgatggcaatgagtacctcttccaagccaaagacaaagagaagcggttcagcctttttggcaaaaagaaatgaactcctttccttcacctcctgcccttctcttaccttttcagtgaaattccagcatgcaagctcattgacacaagaacacagattcttgccgcttcctatgaactgcacaagttttaccacgatgccaaggagatctttgggc

SEQ ID NO: 3449 - DNA, 473 bp, Homo sapiens
tctttatttttgagttactgcatttcctaatttcatggtcataacagcctcctgtctaccgactcagaacgcattttaccaaaactgaaaatgcaggctccatgctcagaagctctttaacgggctcgaaaggtccatgctcctttctcctgcccattctatagcataagaagacagtctctgagtgataatcttctcttcaagaagaagaaaactaggaaggagtaagcacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggaccatgaccatgaccctccacaccaaagcatctgggatggccctactgcatcagatccaagggaacgagctg

SEQ ID NO: 3450 - DNA, 376 bp, Homo sapiens
atcgattaaggtacacagggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagaggggacgggaatatgaacgagataaggagcgcatacttcgagaaagagagaggctaaagcggcaagaggaagagcgccgtaggcagaaggagcgctatgagaaagagaagccttttaaaaaaaaaaaaaa

SEQ ID NO: 3451 - DNA, 628 bp, Homo sapiens
gtccccagagtttgtggatgaagctctgtgtgcgtgctaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaccaatgtaaccatatggaagcaactttttttggtgtctcaaaggagtaactgcagcttggtttgaaatttgtactgtttctatcataaataaagttatggcttcttgttggaaaaaaaaaaaaa

SEQ ID NO: 3452 - DNA, 463 bp, Homo sapiens
ggtggggtggaaatagcggctgcttcttttccaaggatttatttaatggggatgtgttcaaggcaagaccgaattcagaaggatatcgacgtcgtgatccagaagtccagagctgaggactgcctgtttgcagttctgtttcatcaaatggaaatgggacatggacagtttctcctatcccatgcagaccatgctcctgaattaaaactgcagaatgtgttaaagcatcattcaacatcgtgagcacatttgagatactgtacaggacaacctgcttttcatattctctgtgaatttcaaagacgactggggattttcttcctcctctaccaccctggaacagcaagaccaatacatcctgtatttcctcctctttcagcctacttgtgaagacaagggtgaagaccttccatgatgagccatctccacttaatgactgtctcacatgggccggcaacttgtt

SEQ ID NO: 3453 - DNA, 1867 bp, Homo sapiens
gcgctgggctcacggttgctgcacccggcccaggatacgcggcgtgcagactcagcagggcggtgcaaggacaggcgggcctctgcgcccggccctcttccaggactataaagagagcgccggcttctggggctccaccacgcttttcatctgtcccgctgcgtgttttcctcttgatcgggaactcctgcttctccttgcctcgaaatggaccccaactgctcctgctcgcctggtaagggacacctagtccgcgccttgggatgcccgtttcccagccacagtacagactcttcctgggtttgaagaagtcgcatttaaagttctgagctgaaggggctcctttatttcgttaggtgctttcttcccgatcacgtccctgagaccacttctcgcctccctgtgcctctaagttagagttgagggtactgaggcccaaggctgtcctgctccatgtcacccagttggtcagggggctgctggctgagccccaatgctctgaccaggctctgagcagtcagggtggatgggaagtggggggccattgccttctcggagttcaggacagaaggttctggcctcctgtcttagccttcctgggctgtgtctggagcctgggaccttgcttgtggggtaaaagcaacagaacacttgcccttcccaaaatgaagggagaggagatggggcttctcttcctctcccctgagtgggaaaggagctctgggggctggtcctgcagcacagaggaggggtcactgaagcgttattgaccagctgctgtaccttctgcatctcactccacgctcactgcctttttgctcttccttgcagttggctcctgtgcctgtgccggctcctgcaaatgcaaagagtgcaaatgcacctcctgcaagaagagtgagtgcagggccttccctcggaatctgggggatgggccaagttagagcagggaacccagagctctgcaggcaggggcaggccaatgaccagcttccccaaacccctccttcaacacctgattcagaatcagacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaggcccaggatctggaagaccccgggtgatttcaaacctaatgatccagtcctttcctgcaggggcagcccagagcttccctagccttccccagaactgctgtgtcagggatttgccccctgtccggctgtgaagactttcctcatttaaggcataggttttgggaactggcctccttttgttcctgtacccccaatcactacctgtcccagtcttctgtcctgtcccagactcaggtggggctgggcagactttttcatataaaaccctcatcccaaagatctacccagttctcttctgacaaagccatgccatcctgaaatgatggtcctctggggctggaggcagggctcgagccaggcctctgttggggcagggcaggtgcctgattgagtctgctctgacctctcactctccccttcttctccaggctgctgctcctgctgccctgtcggctgtgccaagtgtgcccagggctgcatctgcaaagggacgtcagacaagtgcagctgctgtgcctgatgcccaggacagctgtgctctcagatgtaaatagagcaacctatataaacctggatttttttttttttttttttgtacaaccctgacccgtttgctacatctttttttcttatgaaatatgtgaatggcaataaattcatctagacta

SEQ ID NO: 3454 - DNA, 883 bp, Homo sapiens
actcagctgcctgtaggaaaactgaagactttaataacaaactctccaaggtgaaaatgaacacagcggtgggtgtgctcgcaaacgtgccgccatgtctgttacgctaacatctgtgaagagagtgcaaagttctccaaacctattggctgcagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaacgtccagcattgtcatgcagcacggcacatccctcggtaagtaatttactcaccgtgatttccatggcaacctcaatgcggcaagtacaaccacaggagaaagatatgcggcatcaaggtgaggcgggagcgctcagcactcatgaccctatccccagggagaaactggggcagaggacccaacatgggaggaaatgggcaccatgctattccaagaccatgtctccacctgtgtctgagcctggtgtgggcacttagatgtctaggtggtgagtagaagagaaaaaaaaaagtgttattacggcgcagctattctttatggggttaatagctgccggcgcgttaaactgtctggaacttggttcaatatgctgggaatcgtttgcgggtttcgggccgccgtcttccaatccggatggttggccctcctgggttgagggttttggcagatgcccggttgtctcttcggggctcgaaagctggtttttcccaatgggcgtgccagtttgcgtttgttaaaattttgtggaaaaaaagcgta

SEQ ID NO: 3455 - DNA, 429 bp, Homo sapiens
tttttttgtacaataaaattaatgtttatttcatatcttgctgctgtggtgactcaaaaacaaacacagaagtgttgtgcatacttaaagctcagtacaagtaccatttggacttttttggtttttgttacctggaatgagtgaacaaagttaaggacttgcagagagagttttctactggaatgtaagaggttttgaaggctctcttttctgcaaaggccatgtgcagcaattttcctacaaactttccggtttaattcggaactgaacagtggaattccaaagcacagcttgagaggaacccaatctgcttctgttgtggcaccagaggtttgctttgttgctgaatctatagttgcttcctcaatgaccatttcaaatgactctgtactcccatttacatctgagccagaagccaaatcaggttct

SEQ ID NO: 3456 - DNA, 2329 bp, Homo sapiens
gatacttctggcgagcgcggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtcttggaaagaaaaagttcatcacagaaaagatgaaaagaggaaagaaaaatgtaggcatcatagccattcagcagaaggggggaagcatgctagagtgaaagaaaaagaaagagagcacgaacgtcggaaacggcatcgagaagaacaggataaagctcgccgggaatgggaaagacagaagagaagggagatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtggggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 3457 - DNA, 2529 bp, Homo sapiens
gactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcactgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtcttggaaagaaaaagttcatcacagaaaagatgaaaagaggaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcgtgcgcagaagccagcacagttaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtggggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 3458 - DNA, 1165 bp, Homo sapiens
aaatgggggtagtaacagtacccacttcactgttttttatatttttcttcagacctggtgaacaaaaagtatgccctgggttcttattaagaatgagatcatgtatacaaagtgctcagcactatcacatatgaagcactcaataattgatagctatgaatttcatactactacctccattcttcagatgtggaaaccaaggcttaaataggttttcacatgaccagattcaaacaacttggaagctgcagagacagaattggaattcaggcttaacaaggctttctctcaccctagaagttaacacgacatcttagttttcaaaactcctgacctcctttcccctgctctacatttgcttccctttttcccccaacgacaaatataatcttttttttttttttttttttgagacagatccttgatctgtcacccaggctggagtgcagaggcaagatctcggctcattgcaacctccgcctcccaggttcaagcaatctgagtgcccatttctaaaggactggcttgtggagagggcaagaggcgataaggagaaggctagggcaggcagtgctcaccttcttcaggatgatatcgatgtagccggcaatgagctgtgcaatctgctccccttcagttgtctgtactgagtaatagccatcttggtaatctccaaaatcctagggtgacaagtgggggactcagagggaaagctcaaatctatccaggatggaaatggctaaggatggggaggcccaaaggttgaactgattgaagatgccttcccgtggcaacggccctcttggaagatgcccacctttcttgaacctcctctttattttctccttggaggggaaattttttacttctgaggagtggcctctacactacacagtttcaaatacatatcatttaggaagtctcttatttttactctgatgataaaattgagaggatataatatttggcataaaatggccacactttaaggttggctgtagtatccaaaggggaaaaaacagcatttcctataatttgtatttgtgtcattagggtactttatcaagttgatatcagttttcaattcataaccctataatataaagtcaaaaattcactgtatatagctgctgctgaaacagggaggttatcacatttttccttt

SEQ ID NO: 3459 - DNA, 658 bp, Homo sapiens
ggccgctcgacctttaaatgggtaagaagcccggctcgctggcgtggagcgcgttggcgaatgcgagtgcctagtgggccacttttggtaagcagaactggcgctgcgggatgaaccgaacgccgggttaaggccccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagtcgagagtggacgggagcggcgggggcggcgcgcgcgcgcgcgcgtgtggtgtgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 3460 - DNA, 688 bp, Homo sapiens
ttttttttaaaggttaagtttttattctttgtagtacaatcatagtaaatatattttcacttttcatacatcttccaggacttagatcttattttgacaaatgctttttaaaaaattctcattaacatttacaaaatgacatcaaatagttcattttaactgaattttaaaaaccccccaagaatgactcattccactctttattaaaataacagttcaattctgtgtttgaaaaaaaaagcattatttcaaatgtgttctttaggctcactaatttactttattcttgaaaagaaacataccagcttgcgaattcggtccaacacgaggtcaatgatctccttgccaatggtgtagtgccctcgggcatatgttattggcagcatcttccttgcctgttgataagttgctcagggtggaagagctggcggtaggtgccattgcgaacttcatcatcaattaccatgggtttcaggtctagaaacactgccctgggcacatgcttgccggagcccgtctcactgaagaagctgttgaaggagtcatctcctccccgagtgttcttgtcacttggcatctgggcatcgggctggatgccgtgttccaggcagtagagctcccagcaggcatttgccattctgacaccagcctggccaacgtggatgagatgcactcacgcatggtggct

SEQ ID NO: 3461 - DNA, 493 bp, Homo sapiens
tttttttttttttttggtaataatgggtaacatttattaagtacttactaactgccaggcactactgccagctatttacatacattcactttttaaaatttcacaataactctagaggttattatcattcctattttacaaatggggaaactgagtcatgtggatactaaataacttgcccaagggcatccagcctaaccaatgcctgagcttgcattcaattcaggtagtcgagttccagagttcttgcacgtaacccctgacctgtcatgcctctccacaaacatcatctccgtaaaccccaaggaaaggggcctcatggttatgttttcaccttgagagatgctctctcttcacggatttcttgtgaaactggtgtggttgtcctgggcaacagcaattatcatcctctgctagatcataaggcagcagtttcctcagttaaccaccagaagactcgggacccgaggacagtcaaagtaagcaccggacg

SEQ ID NO: 3462 - DNA, 2374 bp, Homo sapiens
ccgggcacaacttattcttaatgaggatttattctgaatccctcaaaaagtgacttaggttccaagtgttcagcacccattagcttgctggtgtcctggatggtaggctgaattatttttctttttgcaaagtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggatggggagctgagagatcaccgcatggagatcacaataaggaactccccgtatataagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaagaaaaaagaaagagagcacgaacgtcggaaacgacatcgagaagaacaggataaagctcgccgggaatgggaaagacagaagagaagggaaatggcaagggagcattccaggagagaaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcagacacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 3463 - DNA, 814 bp, Homo sapiens
gataatgtgcaagcttggtgagctgagaatattcctgaaaacctttgttcccactgcggaattcctggggacagttattagttccttaatgacgtcaccacaaagacattttggagtgtttggtaaaggcttgtttcttttccagtgaattgctggaagcagaatgggatcaaataaaaatagaacattgtgggctccccaaggctgaggtggagctggaggatgccggccagactgcggagcagcagtcttccttgtgcacatgcctgaagtccgcgtgggtgtttgaggaagtggggatacagcatttaatgaaaaatttatgcttaagaagtagaaaatggcagtcttcctagataattttcaatggccagaatgtgaatgtattgactggagtgagagaagaaatgctgtggcatctgttgtcgcaggtatattgttttttacaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaataaa

SEQ ID NO: 3464 - DNA, 438 bp, Homo sapiens
gaagactctgattctctgagacccaggagagatgtcttaccagcagcagcagtgcaagcagccctgccagccacctcctgtgtgccccacgccaaagtgcccagagccatgtccacccccgaagtgccctgagccttacctgcctcctccttgtccacctgagcattgcccacctccaccatgccaggataaatgccctcctgtgcaaccatacccaccctgccagcagaagtatccacccaagagcaagtaacatcactagaattcatcaggaccatgaaacaacaagatccagtggctcttcttattcccaggactccatcatcttcccttcagctgtagtgggaggctgcatcttccctaacctctgtctggcttgagcgttgacagagaaaaggcttagttctgaaaaccgatatgttgttggaagatgagcag

SEQ ID NO: 3465 - DNA, 714 bp, Homo sapiens
cccaagctcgagttcagttatgtggaatgtatgttgtacagtattcaccagtggggccgaaaactccaggatttcttaccagcaacactgaatgcagcagagctcaaagatctcaaaatcaggctgcagtacttggcacggggcctgcaagtttatatcagacaacttcgcttagctctccagggtaaaacgggtgaggccttaaatacagaagagaacaagattagagtcgttgcattgacaataacaaacaaatatcaatgttttaatcaaggatctctttcacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatggtgagcgtttccgtttgggtacaaggaatatgagagattaggcagaaattgtgttatactttattttaattagtaattatatacagtgtcatggttctatccaatgacttttctgaattagcttggagaactagggctgttgaggaaatgatttatcccattcctctctcattcacccttctgggctgactgtattgaacatgcaacattaaacagtaagcactta

SEQ ID NO: 3466 - DNA, 648 bp, Homo sapiens
  misc_feature (1)...(648): n = A,T,C or G
tacgctacaggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcgganacgggagacgggtatcccttcgacgggaaggacgggctcctgggacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgcttgatggggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgaggtacctccac

SEQ ID NO: 3467 - DNA, 622 bp, Homo sapiens
ccttctcttccctcttccttttgaagtgtacccctggatattcctcagtgctttttagagcttaagggtctgtagcccctagtacaaagagattgaagacctcttttttttttttttttttttctagagagaaaaagcactgggtggtttctccaaagagccacacttgttttctttttctgggtaaagggatccaagaccacttttcaaccctgggctatgacttatgggctggaaaataatgaagcagagagagagtaacagatttgaattcagagaaaatgtcaaagccactcacgagtcaagtactggatttttttcctctctgcaatggaatgaacagggaagagtcatcaaggtgctcaaagcgaggataggaagacatgtctggatctctgggggaatggtaacttactgagttcctcctggaggctctctcttaggcttatttcccgctctgttgcagcatatcccatttctttcatctcttgctcactttctatctcactggacagagcagttatttccttctgttgtctccacaagaagtaactggctccggcgaggagcagcagcaagataggcagggtcctgcatggctgcgatcagggctggcgctctg

SEQ ID NO: 3468 - DNA, 567 bp, Homo sapiens
  misc_feature (1)...(567): n = A,T,C or G
gggcaccattctgccagagcctgggagtctgcgaagnccgggacccggttccccggccacagtgggggtgtgcaaacccgagagaactgggtaagttggggtcggcttgcagtttggggtaccccgagggcggtgtacgtcggtaagattgtaacagtattactggaagaattattcgactgtcctgatgatacttgtaataggaagtgcccgtcagaagcgataactgacgacgtctaatgtctatctgaccgcagtcgcttgaaacctcttacaacttagttgaccgtaacttgccagagccctgccctggaattcctgttccttaattccctctttaagattgcgtacccactgcagagtgctgaagacggggtagccacgaggtgagaggctctctggtgttagggttttaacatgggaacgtagttttgtcactttgaatgcacggaaattggcgtttttgacagttttctacgtttaggtgttttatacactttaggggtaacgtttatccatggtcattggcattagggtgggaacttaaaataggaaactgggagatgg

SEQ ID NO: 3469 - DNA, 699 bp, Homo sapiens
cgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggtgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttta

SEQ ID NO: 3470 - DNA, 408 bp, Homo sapiens
tagcggtcctgacgtgcaaatcggtcgtccgacctgggtataggggcgaaagaccaggatggagggggagatgataaaagggaagagggcagcctgacgatcacaaatattcccaagctcaaagcatcgtggagacagctgcttcaaaacagtgttctactgactttgcagacctatgccccaggccttaaaaactgaccaaggtttactcagtaataagggaggtctatgcgaaactcagctggaggggaccagcaagccttacaggttcgctatggtcagaagatgatctttacatcagttgttggagctgacaggttagcagtttccctgttccctgaaggaacggcaataagaactttattctaagctaatactcattgatgtttgaaaaagaggaaaaaaaaa

SEQ ID NO: 3471 - DNA, 522 bp, Homo sapiens
ttttgcgtggataatcttttttattttttgtggaaatgggatctcactctgttgccctggtcttcaactcctgggctcaagcgatcctccctctttgtcctctcaaagtgccaggactacaggcgtgagccctaaagatgatcagcagtatccttagaagacggatttgactgactggagaagggaagaaagcttgtggtgacacgagcagactggagtgatgcgctttggaatctgaagatgtgagaaagccaggagccaaggaaggcagaagcagctctaaaagctggaaatggaaagagggaggccctgtctcaaaaaaaacaaaagaataatcaaagtcaagactgagaagccaagtgcctgacccagagaaaacacccacgaggtctgtttcctcttccctctctccagggccagtttttaaattgcttggtgtctgtcctcagggaaatccccttccagcttgagtaagaggcaacctatctcactacccccaccccttccactgcacccttctgc

SEQ ID NO: 3472 - DNA, 2746 bp, Homo sapiens
gatctagtcttactaaagacgtgggaggaagttctccagctgagcagctttccccaacgtggaagggaccatagcaaggacccctgagttctccaacagacgttcaacgccaggggattcacaggtgggtgcacctgtgtggaagtaaagctgttgcttattctgggagcccaatcctaggctgagggaggtgggcgcggggctgtttaagcgttggcggaggccgggctgggtcgctgcgcgtctgctcctccttctcgcgcttctgctgccgccctaatcctgccttggccatgagggaaatcgtgctcacgcagaccgggcagtgcgggaaccagatcggggccaaggttggcagccggggctctgagggcccagcccggcctgccgggtggccggggaagatgttggcagcggcgggacgggtgcccctgcattgcggcccctgggctccctgccggggacggtggaaccgggtggctggcgaggcggccggggtggaccccagggacagggcggcctagggatgggggtgcgggtgggggtgggagagcggctggggcgcctccgtgactcagccccggcctgtctggcccctcccgtctccgcagttctgggaggtgatctctgatgaacatgccatcgactccgctggcacctaccacggggacagccacctgcagctggagcgcatcaacgtgcaccaccacgaggccagcggtgcgacccccgtccttcccccaccgccctcctgggaacgcggccctcccctcgctcatgccctcccgccccacgcaggtggcaggtacgtgccccgcgctgtgctcgtggatctggagccgggcaccatggactctgtgcgctcggggcccttcgcggaggtcttcaggccagacaacttcatttcccgtgagctgcgggcgaggactggggtgcggctccttagccagggcagctcgaaatccaggaacgctccaaggtcatcctgtgggaactgtggcgccagggcccctgaacaccctcctgtcctccgagtcgagtcgctccatctgcctcctaaacgggcttcgggaggaaggcccgggtgtctcctcaaggtgaggagctactgatgtaaactccctgcaaggacctgagctggggccgtggctactgccttccctgagaatgggccacctgcagcgaggtctgtgaacccgtctcaggttcgactcctgacttaattcctaacaggggaagctgctgtcctgtaactccgggggagggggtttcatttgttccacctgcagtgaggttagcccctctcaggtttgactcctgacttaattcctaagagaggggaagctgctgtcctgtaactccgggggagggggtttcatttgctccacctgcagggcgaatggtgctctcacctcacacgtgacacttggccctttctgcattatggtggtgaccactgatgaccgtatacctggccgtcgagtgaccggctgtactgtcttacaggtcagtgtggggccggaaacaactgggccaagggacgctacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagcgctatatgacatatgttccaggaccctaaaactgcccacacccacctatggtgacctgaaccacctggtgtctgctaccgtgagtggggtcaccacgtgcctgcgcttcccaggccagctgaatgctgacctgcggaagctggccgtgaacatggtcccgtttccccggctgcatttcttcatgcccggctttgccccactgaccagccagggcagccagcagtaccgggccttgactgtggctgagctcacccagcagatgtttgatgctaagaacatgatggctgcccgtgacccccgtcacggctgctacctaacggcggctgccattttcaggggtcgcatgcccatgagggaggtggatgaacagatgttcaacattcaagataagaacagcagctactttgctgactggctccccaacaacataaaaacagccgtctgtgacatcccaccctgggggctaaaaatgtcagtcaccttcactgggaacaacacagccgtccaggaactctttcacgtgtgtctcagagcagtttacagcaatgttcaggcgcaaggcccttcctccactggtaacacgggcgagggccatggatgaagatggaattcacccgaggccgagagcaacatgaatgaccctggtgtctgaatatcagcaatatcaggatgccacggcccaaggaggaggaggatgaggagtatgctgaggaggaggtggcctagaactctccttttctaggtaaagcgggggaggcagtgtgtattcttcactgtgttgtgacagctatgtgtcactacgcacttgttcatttgtgtcttcacatctcctgctgctgcattttaaagcacttttatagtgtgcagttttgactaataaagtattctcacagcaaaaaa

SEQ ID NO: 3473 - DNA, 473 bp, Homo sapiens
  misc_feature (1)...(473): n = A,T,C or G
tctttttccttggagactcttccatggcctctggatcaccatcacccatgggagagcagctgctgtgccgaagtgggtcctggtgcaggccgccttcttcaccaagaccttctgctcctttcctcctccngtttcctgctgctcgcgtggtggccgtccgtaacacatcccacctgctggccattcacctgtggctgtgtgccatcttcctgccgtctgacagcgggcagctgtgcctggccctccctcctgtacatggggctcccaggctgtctctgtgtctgcccctcctgcatgggcgctggcatgctgtgtcctccgggcgcttcttcttcttcctcttcctcttcccgtggggagccgcagtggcctccctgatgtgctgtgggaggcgcgtctctgagcccagcctctgcggctctcccacaaaggtctttttcctcttctcagaggggctccgggggggctcactg

SEQ ID NO: 3474 - DNA, 3383 bp, Homo sapiens
gagcgcgctccacccacccgccactaggggtcccagcggtcaagggggtggaatgcgggcgtccatcgcgaaggcattctgctcgcaagccttggcacaggcgcgggcttcgctaccggaaaagtcccggtaggattccggaagccggccacgcgttccgcgcaggcgcaaactgctccaaaagtcggcgtcgctctgctcggcgccccggcccgcgccgaagtcggaagtgcagctcagggcgcagtttcttttggagtcctggacctgagcaagcgctgttttatgcgtcatcatcccgcgcagacacaggaagtgccgcacagagcgagcccctgtcgtcttgagttctgggccagaggtcggctattatatcatcattaggcgtcaacacaggaagtgaggatacttctggcgagcgcggttgctgtttcttctcaggctcagggaccggccgcggccccgtaggggtgagttccgactgggcggaccaggtgtgggagcgcgacgagaactgcgcaccgaggtctttcttccgagcaggcctcggagcggggcggacccgggcccgggggcgaagcgacaccctcgcttccgcggacagtctcatcccgcacggaactttgggtggtggaggcggcgggtccaaacgctgtctggagccaacgtctgccaaggctgaacctcaagttgttgcgggacttgaacccgaggaaattagccccagtgccccgggtcaggtggccttgttcgcgaagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcactgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtcttggaaagaaaaagttcatcacagaaaagatgaaaagaggaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggggaatgatggcttttgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgagcccccctccgagtggcccatcccagggtgacccgcccgggcccacccacagccgcccatctgtcgttgcaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 3475 - DNA, 569 bp, Homo sapiens
tttttttttttttttttttttttacatgaaaagggttttatttatttaacaaacagacaattgaacaaacaaacaatggaagcaagtcatttgccaaaaggaacacagagggtcatgatgatctactcctccaaggatttcagggttcccagacgcctagttttctgtctagttctggaagatgttattcttggggagcaataggtcctcgagtttggggctttttcaggttctctctccatttccccattctgctctcttcaaaggactaaaagctaaaggcgacaaaggattcattcgacaagtcctagtcgtgcgcccttgtgagtgccaaaccctgctccctgccaggggacccacgagcgaccctcaccaccatccctgccctggtggagccccgggcggaacacaggatccgaagatggcagcggaagctccgcagcagcccaacagcgactgggcagggtggatacaggctccttcactgggtgaaggcggcacaaagaaccggaagaaccatcccgggagcccaccgggcgttcagcttcccttgggaccccaggcgtctc

SEQ ID NO: 3476 - DNA, 915 bp, Homo sapiens
acttcttcttggccaatgcgtctcgggcgcgctcagagcagttcatcaacctgcgagaggtcagcacccgcttccgcctgccacccggggagtatgtggtggtgccctccaccttcgagcccaacaaggagggcgacgttcgtgctgcgcttcattctcagagaagagtgctgggactgtggagctggatgaccagatccaggccaatctccccgatgagcaagtgctctcagaagaggagattgacgagaacttcaaggccctcttcaggcagctggcaggggaggacatgggagatcagcgtgaaggagttgcggacaatccttcaataggattcatcagcaaacacaaagaccttgcggaccaagggctttcagcttaggagttcgtgccgcagcatgggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgacttttgacaatttcgtttgctgcctggtgcggctagagaccatgttccgatttttcaaaactctggacacagatctggatggagttgtgacctttgacttgtttaagtggttgcagcttgaccatgtttgcatgaggcagggactcggtccccctttggccgtgctcccctccctcctcgtctgccaagcctcgcctcctaccacaccacaccaggccaccccagctgcaagtgccttccttggagcagagaggcagcctcgtcctcctgtcccctctcc

SEQ ID NO: 3477 - DNA, 553 bp, Homo sapiens
  misc_feature (1)...(553): n = A,T,C or G
cgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggttncgtgggagactcggcgctgcagctggagagaatcaacgtctactacaatgagtcatcgtctcagaaatatgtgcccagggccgccctgggtgggacttagagccagggcaccatgggacagcgtgcggttctgggcctttttggccaggtttcccgggcctgaacaacttcatctttttggccagacgtgttacagggaacaacttggggcgaaaggggcacttacacggagggcgcggacttaggttggacgcattgcttgggacgtggtgcggaaggagtgcgagcatgcgactgcctgcaggnttccagctcacgcactcgctgggcgcggcacgggctcaggcatgggcacgctgctcatcagcaagatccgtgagagttccggaccgcattnatgaanact

SEQ ID NO: 3478 - DNA, 6070 bp, Homo sapiens
cgggcaggccacctggtgcccgctcgcatgaccgtgcgcggcaccgacggcgcccccgcctagctccatctacggccgcccacgccgctcagcgcccttcctcactccgggacctggtcaggacccccgggcccctggcaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtgaggtcagaacggcccatcccagaactgtgggccttcccactcgagaccggggaccgccctccgggagctgggaccaccctgcgcctgtccgcggagacccactacccccgagccctgcctcctccccaggtcccgcggcctatacggtgccctcgctcttgggtccgcgcgtcatcggcaaagtctccgccccaacttgctccatctacggccgcagagcggctggcagtttcttcgaggacctcagcaaggtgggggaggggccggggcggacgcagggggtccctggtccgcggcagtggaggcggcagccagcaccctctgccctctcgcagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcaggtggcctggagcccagggtcaagggtcagagtcaggagagtggggagggcctgaggtcggagtgatgggatcagagtccccgggggtccaggggtcccggcgcggagaggatgccggccccgcgaggtcagcggtgtctccgggcccgcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggtgcgtggggagggttgggcgttcctgaccccgactgggaggtcagcccgagagactttgggtccctgggggtgcgacggtgccccactaccagcaccggccccagggtgccccaccgctgtgggctgccaccctcacgcgtacccccacataccaggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggttagaaaccacctcctttccagacgggagcctataccgcacatgcagcaaccagtccatccacaggcagctcccaacctcaagcctggcccaaagcctccaagaccctaccaaggcttctccccaccctgctccccagcacagttctccccaccccgttccccagcacagcgcttggggcccctctggctccagaccaggccccttggagcaggaaaaagatccactgatggaattcagacccctttccccttgggtccccagacagctcccccaagggaggagctgaggacttccctccctctgccccaagccttgtttccccaaggagaggtaccaacctcctcccctactgacacttctcaaccaagaaaacttcctttccattccctcaccagctgggcacccctatagctgcttaaatactttccaaatccagctgcactcctagccagggaaggtgaagggatgcacagaggtgggggaggggtactgtgcagggtactcagcatccctgaccaccaggtgccaatgatcagcggacgtggtctggggcacacaggaggcaccttggataagctggagtctattcctggattcaatgtcatccagagcccagagcaggtacggggcgccacggatcagtcattgatccaggttgatgatccagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacaaggcaaaaccccatctctacaaaatagttcgctgcgtgtggtggtgcacgcatgtggttccagctactcaggaggctgaggcaggaggatcacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacagaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacaggtgacctgactccatggcctgcttctgcatgttcacaggctcctgacctccaaactcaagtcaagggcctctcgttaggagttacccgtcacctgaccgtgtgcccccctacccccatcacaagatgcctgaccaccaccatgtgggtggcctgatactcaacccaccaggtgctgccacccccataataagggacttgaccctcaatgctcagggcccctgaccccaaagtcggcatccccgaactctcccaagaagctccaggttctccattgtctccaacctcctctgcctcccccaaagcctccattctcagtaagaaactcgtggaggggctgtccgctctggtggtggacgttaagttcggaggggccgccgtcttccccaaccaggagcaggcccgggagctggcaaagacgctggtgagcggtgtggcctttccctgggcaagcgtcttgatgcgggcccagcctacccttcacccctcccgtccccactgcctccctccactcagcagtcctgcctaaccccagtcccaccctcttctgcccgaagtccctccctccttcacggcttcctaacctgctgtgactttagaggtcaaggctggcccggcctggacctggggaagccctctgtggggttcctgccccagaccaagtacaagttcctcctggccccatggcgaggtgtcgcacttcactcgtgtctcttccccaccccaatccttccctgacttcatgctggggggctggcaacccaccctgcagcaggggctggagttcgaccaagaaccggctgcagaaggccccgccatggggggtccacgctgagcctcctctccgcaggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcggtgagggggacggggtgtaggggagcggaggcggcggggggtgcttcccgctggggccgccccgacccggccgcgcctaagacccgtccccgcccgcagggggcgccctgctctggctcagcggacacgcggggactcaggctcagggcgctgcccgggtggccgcggcgctggacgacggctcggcccttggccgcttcgagcggatgctggcggcgcagggcgtggatcccggtctgacccgagccctgtgctcgggaagtcccgcagaacgccggcagctgctgcctcgcgcccgggagcaggaggagctgctggcgcccgcagatggtgagcgtcgggggagtccccgtccttccgcctccgccatccccttcccttcccgaggccccgccccttcccgagcccgcgcctctcagcccctctccccgcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtggtgagcgccgcccccgccctgctggccccgcacccccgcccagctccggccgcgcggcctctaacagcccctcgctctgcagggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggagggatccagggctgcggaggcgggggccgtctcgatgaacacgtgacccccggcgggctccgccttccgcgcacgcgctgagagcctgtcagcggctgcgcccgtgtgcgcatgc

SEQ ID NO: 3479 - DNA, 1719 bp, Homo sapiens
aagcttgtggcttcttctccttactcttcctccttggtgtctctatgttagagggccgttagcatctgctggggcctggtcgcattcaccctgctctgccactcactggctgtgtgactctggacaaattaacttctctggacctggcagtttctcctctctacaatgagaatactggagagtccttatcttatgggttgctacagaattaagtgacatctcacacacaacacacttcctacagtccctgttacacgctaaaagtactcaactagcttcggatacgtcatcagcaaccaccccacgggttactgtgatgctgcacaattattaagccctggctgctacagagttgtaacctgtctgcacttccaaccggcgccgcaagcagcattcccagtcccgctttcacccgcgcgctaacggctcaggttcgagtacaggacaggagggaggggagctgtgcacacggcggaggcgcacggcgtgggcacccagcacccggtacactgtgtcctcccgctgcacccagccccttcagcccgaggcgtccccgaggcgcaagtgggccgccttcagggaactgaccgcccgcggcccgtgtgcagagccgggtgcgcccggcccagtgcgcgcggccgggtgtttcgcttggagccgcaagtgacttctagcgcggggcgtgtgcaggcacggccggggcggggcttttgcactcgtcccggctctttctagctataaacactgcttgccgcgctgcactccaccacgcctcctccaagtcccagcgaacccgcgtgcaaccgtgtcccgactctagccgcctcttcagctcgccatggatcccaactgctcctgcgccgccggtaagaggctggggatgcccagtgtagactgtagcgctagagaagcaatttctgacccctctttctttctctggtcactcaatttcaggcacaggagttgctccttcccaaagagttttggggtatctttctctccattctaggttattcggagccccctttttaccgttaaggagatctgagttaatggcttgctcaagttcccagggaatcggttgtgggactgagggaactcgggccccgggttctttagttacgccgtcccttgtttcaggtatccaggggacggttctcacctctgtcttttctccttgcaggtgactcctgcacctgcgccggctcctgcaaatgcaaagagtgcaaatgcacctcctgcaagaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccggtttgctatattcctttttctatgaaataatgtgaatgataataaaaccagctttgacttgaaaaaaaaaaaaaaaaaaaaaaaaaaaaa

SEQ ID NO: 3480 - DNA, 1589 bp, Homo sapiens
  misc_feature (1)...(1589): n = A,T,C or G
tttttttttttttttttttttcttgagacagagtctcgctctgtctcccaggctggagtgcagtggcgtgatctcggctcactgcaagctctgccttccgggttcatgccattctcctgcctcagcctcccgagtagctgggactacaggtgcccgtcaccatgcccggctaattttttattttttgtatttttagtagagacggggtttcaccgtgttagccaggatggtcttgatctcctgaccttgtgatccgccctcctcagccttccaaagtgctaggattacaggcatgagctgctgtgctggccctcagaggttaattttcaatcttcactcgaccactcgtgagctaaatgagttccccttttctgcagtctatttttccatacatccaatttatttaacaagggtggagcctcatctgaagcatttcctcaccaggcttgaagagggccatttttccattagagcatcagggctgacttattggtatcggacgaagactcctctccacgagtcaagtacctgggatttttttcctcttgagttcctcctggaggctctctcttaggcttatttcccgctctgttgcagcatatcccatttctttcatctcttgctcactttctatctcactggacaagagcagttatttccttctgttgtctccacaagaagtaactggctccggcgagaagcagcagcaagataggcagggtccctgccagggctgcgatccagggctgggcgctcctgaagaaggggtctgcgatggaaatgctggctgtcttttccaggccgaggagggaatttctgatgatgcaggatacaccctccccgggagccgcctctcatgatcacagatgctgctacttcatataggcccactccatctgcaaccacaggtgcttccacaagctgggatgttctctcccttggcgttgctccactgtatttggggttgggggtaccagccggtggacctgcactccagatggatccctccatcctcataacccttcacttcgacgtgaagattagaacccagtgctgcaaccttcagctccaccagggctttttcatagaagtcaccatcttggaaataacacaagtactttccactgtcagaggctgtgacgttgtgtattcggagagcagccttccctgcagtgatgccatccccgtcagaaatcgaaagtttctcccctcgatacggtgcactctgcctgtcttcccacttcctttccatctgcatacacgttcaccacctgcctttaggctggaacttacccacttcagctccatggtctctgcactcatggtcgggaacaggtgacagggcagatcagcgtcttcacccaccatggccaggatgggcccagagggtccaagcacagaaaactgagctgagcaaggagtgagcagctggaccaagaggagggagacatgaaagttgagcagaaggaaagccagggaacttgccattttcatctactntctgccaaaaatgtctgtccttgagtgtctttacctttgggttccaagtatggaaaaccaatcccttggtattcccattggagaagtca

SEQ ID NO: 3481 - DNA, 513 bp, Homo sapiens
tttttttttttttttttttttttttaaaaaaaatatgaaaagggttttatttatttaacaaacaaacaatggaacaagcaaacaatgggagcaagtcctttgccaaaaggaacacaaagggtcatgatgatgctactcctccaaggatttcaaagttcccaaacccctagttttctgtctagttcttctggaaaatgttattcttggggagcaatagggcctcgagtttggggctctttcaggttctttctccatttccccattctgcaccatccctgccctggtggagccccggtgggcaacacaggatccgaagatggcagcggaagctcctccgcggccccgagagcgactgggcagggtggatacaggctccttcactgggtgaaggcggcacaaagaacgggaagaaccatcccgggaggccaccaggcgttcagcttccccttgggacctcaggcggctcgggctgggtcgccgaccggggagtttctggggtctctccctctggct

SEQ ID NO: 3482 - DNA, 467 bp, Homo sapiens
ttttttttttttttttagcagttcacatagtttattcagcaatataacaggagagaacctccattgtaagagacataaggcagatacagggtgcatctctggggtacattcttcatacagactaacaaataacttcaggtttcacaacatgtagcaagtatgatttgttgcacaccaacagccattcattcctcacgttttccttgctaaaagagccctggtcaggcacggtggctatgcctgtaatcccagcactgtcggaggtcagggcaggtggatcatctgaggtcaggagttcaagaccagcctggggcaacatggtgaaaccccgtctctactaaaaacacaaaattttgccagacatggtgggcggggcacctgttaattccccactactcaggaggctgaggcaggagaattgcttgaacctaggaggtggaggttacagtaagccgagatcgtgccac

SEQ ID NO: 3483 - DNA, 821 bp, Homo sapiens
gtgcgcagacagcaagaggaagaggagaggaagaggcggccgccttctcccgagccgagcacgaaggtttcagaggaagccgagtcccagcagcagtgggatacttcaaaagggagaacaagtttcccaaaacggtttgccagctgaacagggatctccacgggttagttaccgctctcaaacctaccaaaactacaaaaactttaatagcagacggacagccagtgaccagaccatggtctggactgtgaagttcactaccatttgtcaagaatcaccctttccaaatcctctgggttttgactttttgggcttccacttcacccaaaatgttaaaatttttacttaattcatagccttccttggtttcatatttgtttgcatttaattcatgtttgagtctcttaactgatggatgcccacttgccttaaagcaggcatacttattttttgtttatttattgtgagctgtttactctattaagattttacagcgaaacccttacatgagtaattgaaatgaaattaaatgagattacagccataatgaagaagaaaactagaatcctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggct

SEQ ID NO: 3484 - DNA, 2726 bp, Homo sapiens
ggatccatttgtctcgggctgctggctttctgccatttcctcctctccacccttatttggaggccctgacagctgagccacaaacaaaccaggggagctgggcaccagccaagcgtcaccctctgtttccccgcacgggtaccagcgtcgaggagaaagaatcctgaggcacggcggtgagataaccaaggactcttttttactcttctcacacctctgaagtgggagcctcttgagtcaaatcagtaagaatgcggctcttgcagctgagggtctggggggctgttggggctgcccaaggcagagaggggctgtgacaagccctgcgggatgataactttaaaagggccactcctgctggcttctcacttgggcaacttaacaccggcaaggaaaaaaaaggggaagggttctgtctctcctgcgtgcttggagagctgggggggctataaaaagaggcggcactgggcacctgggagacagggacagacgtaggccaagagaggggaaccagagaggaaccagaggggagagacagagcagcaagcagtggattgctccttgacgacgccagcatgaggctccttctccaccaccaccgtgagcttcctccttttactggcattccagctacctaggtcagaccagagctaatcccatgtacaatgccgtgtccaacgcagacctgatggatttcaaggtagggccaggaaagcgggtgcagtctggggccagggggctttctgatgctgtgctcattcctctcgatttcttccaagtcagtgaggttcatcccttcccctgtatttccctcccctaaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccgggtaagaggaactggggatggaaatgggatgggatggacactactgggagacaccttcagcaggaaagggaccaatgcagaagctcattccctctcaagtttctgccccaacacccagagtgccccatgggtgtcaggacatgccatctattgtccttagctagtctgctgagaaaatgcttaaaaaaaaaaaggggggggggctgggcaggtggctcacgcctgtaatcccagcactttgggaggccgaggcaggcggatcatgaggtcaagagatcaagactatcctggccaacatggtgaaaccccagctctactaaaaatagaaaaattagctgggtgtggtggcgggcacctgtactctcagctacttgggaggctgaggcaggagaatcacttgaacccaggaggcagaggttgcagtgagcagagatcacgccactgcagtccagcctaggtgatagagcgagactgtctcaaaaaaaaaaaaaaaaggccaggcgcggtggctcacgcctgtaatcccagcgctttgggaggccaaggcgggtggatcacgaggtcaggagatggagaccatcctggctaacacggtgaaaccccgtctctactaaaaatacaaaaaattagccaggcgtggtggcaggcgcctgtaagtcctagctactccggaggctgaggcaggagaatggcgtgaacccgggaggcggagcttgcagtgagcagagatggcaccactgcactccagcctgggcgacagagcaagactccgtctcaaaaaaaaaaaaaaaaaaagcaactgccactagcactgggaaattaaaatattcatagagccaagttatctttgcatggctgattagcagttcatattcctccccagaattgcaagatcctcgaagggcttaagtaaaatttactctgatgagtaacttgcttatcattgcatgaagctcagagggtcatcaggctggggtgggggccggtgggaagcaggtggtcagtaatcaagttcagaggatgggcacactcatacatgaagctgacttttccaggacagccaggtcaccaggccgagatatgcctagtgttctcttggcgttctgaagtataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaatgcctgcgttggtgtgctttctttcttcttgggaagagaattcaggccgatattccttgtcgttttactctttgtcagaggaaagaatgctgagtttttcttcttcctttcatttcaccctccttttttggtaggtggttgggaggcctaattcatctagtgggtttttt

SEQ ID NO: 3485 - DNA, 793 bp, Homo sapiens
gctggtctgagagtcgtgcgggcgaacggcgcttcccctgccctgtatgcgggaagccttccgcttcaactctatccttgctttgcacctgcgggcgcacccaggagcccaggccttccagtgccctcactgcggccaccgcgcggcgcacgtgcgtctgctgcgctcgcacctgcgcacacaccagcccgagcgcccacgtagtcctgctgcacgcctgttgctggagttggaagagcgcgcgctactacgcgaggccccgactggggagagcccgaagctcagggggcatgcaggccaccccttgccactgagggtctggcgcggccccaggcttccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgc

SEQ ID NO: 3486 - DNA, 2562 bp, Homo sapiens
atacaggaagtgacgatacttttggcgcgcgcggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagaggaaagaaaaatgtaggcatcatagccattcagcagaaggggggaagcatgctagagtgaagaagaaagaaagagagcacgaacgtcggaaacgacatcgagaagaacaggataaagctcgccgggaatgggaaagacagaagagaagggaaatggcaagggagcattccaggagagaaagggggaatgatggcttttgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcgtgcgcagaagccagcacagttaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgattcacgtcgctgagggagatcaacaccattcctcaaggcccagcattcccaacattcgttcaccgtttaggagagatttttggtggggcagcaacatggacaagatctacatcgtgatgaactacgtgggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 3487 - DNA, 2273 bp, Homo sapiens
  misc_feature (1)...(2273): n = A,T,C or G
gccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccagggagggcaggatcctcttacaagggtaaatcttggcccttgggaacttacaacccagagggaagttcgtgctgttcttgggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaaggcaaacaactcccaggctgagggaatgcagggccacagcacccaattcaaggacaaattgttattatcagaaaatgaagcaacacttgagctgttcagggccagttccctgttgaagaaacagttccctgtttgaaggaaagtagagcctgacacttgctcccactttggagaccacattccctgcacacggtctttgagagagcagttgcacactacaggcacacttctgaggtacggtatctctctccagccactctgataccaagtaattcaagctggcattccttctattagggaaattcattttacccaatttgcatttatggaattgatcatttaagacactaaattagtttttagaaccaattatgggganggaattccacgttgttaggaagagatgaggagttggaagaggagggattagaaacaggaggaggcagtcatcctctccttggccaaaagatttaaacctgttccacattggtgggtgatgatgggtgagtttccatgggtaacacatccctaaatttttaccaagggaagaggagagtactcacttttaccatctttgaatatatttccatagaaatcctagctctctggtacccctgaaatcttcccactagccctcaccttttccaacagagtccaccctagaagggaagggttggccttccccaaaagccataacccttgacccaaacccaaacaataggcacccagcaatgcctgtcattcagttatgcagaagcctcatttgtgaaattctgtttctctgatttccttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacccgaattattaaaatatatcaggctaaaaaaaaggaaccgcaggttcagacatttggtgtatgtgcttggctgaggagccaatggggcgaagctaccatctgtgggattatgactgaacgcctctaagtcagaatcccgcccaggcggaacgatacggcagcgccgcggagcctcggttggcctcggatagccggtcccccgcctgtccccgccggcgggccgcccccccctccacgcgccccgcgcgcgcgggagggcgcgtgccccgccgcgcgccgggaccggggtccggtgcggagtgcccttcgtcctgggaaacggggcgcggccggaaaggcggccgccccctcgcccgtcacgcaccgcacgttcgtggggaacctggcgctaaaccattcctttag

SEQ ID NO: 3488 - DNA, 868 bp, Homo sapiens
agcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagccccggtcccggccgcagcttcggagggcttccgcccgctgtcctctgctctcccggcccgggctcgccgggcaccgtgcggaggagcctgaggaagaagaggagggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatcttttccgctcagcacatcacctcaaagtgcatctgcgagtgcacacaggcgagcggccctacaagtgtccgcactgcgactacgcgggcacccagtccgggctcgctcaagtatcacctacagcgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgc

SEQ ID NO: 3489 - DNA, 724 bp, Homo sapiens
aattcggcacgacgggaaggctttgatttgaggaagagattctgagactccagcaggatgtcttatcaacagtagcaatgtaagcagccctgccagccacctcctgtgtgccgcctgccaaaaaggcgtccaaacccaatgtccaccccctaaagttgcctgagcccctgccccccccaccaaaatgtcacaagccctgcccacctcaaacagtgccagcagaaatatccttctggtgacaccttccccaccctgccagccaaagtgtccaccccaagagcaagtaacagcttcaggattcatcaggaccacgaaaaagatagggataattggctcacctcgttccacagctccacctgcatcttctcatcaaagccatccagggatacacagggagcttctttccccttagcctgtgatctgcccatgatgatccccgacagcaaaaggtttcctttctgaggctgccatgctgccactgtccaggtggagactgagcaaaggaagtcctcagctgtaccggcctttcagagctttggaaggaaggaccagcagctctttccctgggaaccatcagagaattctgttgatgtgttctgtgtctgtctgtcacctggtcacgagcttctaccacctttgcaattgtcacttatctttcactccctgaataaagtatctatgcataaaaaaaaaaaaaaaaaagctgtcgcggccgcaagcggat

SEQ ID NO: 3490 - DNA, 752 bp, Homo sapiens
gtgagccaagatcgcaccattgccctccactctgggccacggagcaataccctgtctcagaaaacaaacaacaaaaagcagaaacgctgaaggtgtcggtttacgggaaaaccgcctgtcagaacacttggctactcctaccccagatcagtggacctgggaatgagggttggtcccgggaggcttttctccaagctgttgccaccagacccgccatgggaaccctggccacagaagcctcccggggagtgagccagagcctggaccgctgtgctgatgtgtctggggtggagggagggtggggagtgtgcaagggtgtgtgtgtgcccggggggtgttcatgcggcaagcatgtgcgtgcctgtgtgtgttgcgtgcccctcccctgcaaccgtcggtggtatctccctccagccccttcgccaccttctgagcattgtctgtccacgtgagactgcccagagacagcagagctccacgtggttttaaggggagacctttccctggacctggggggtctcgccgtatctcatgaccaggtgctaaatgacccgacatgcatcacctgcctttcgatgaccaacctccctgtccccgtcccgctgacctgcccccgtggcgtctcacggtgatgcctgctcctgacattggtgttcactgtagcaaactacattctggatgggaattttcatgtacatgtgtggcatgtggaaaatttcaaataaaatggacttgatttagaaagccaaaaa

SEQ ID NO: 3491 - DNA, 631 bp, Homo sapiens
  misc_feature (1)...(631): n = A,T,C or G
cggggcgcctcatttccctgtcctcggatcacagtctcttctcactacagtgtcgccgcctctgcctgcgtagcccggccatggctctgtagcctcgacccctttgtgcccccggcccgtctccgcgctcaccacgcctgcgctctccgctcccaccttctttcttcagccgaggccgccgccgcctctccttgctgcagcccatgggagtcttcccantttcgccttggtgcccttgtcttcgcccacctgaggcatcctcccaaaacctcgtgcccaantgctgggtgcaggcttctcctgttgcccatacagtgcccagcacctgtgctaacagccatgttcactcctgggcgaccctgggggctgggagctgggacaggggcctgtttccaagttaattggggttgggatgggcttcgtaagactatgggggaaacttcccccggcccctgcccccctgggttccctatgaggtccttgggggacgcctggagggcgggcttccagtggggggagagcccctggcaggtaagggcaggtggaaggtggagctgcggagtggagggcaggggaagatgggggaggaagaactcatccatgtattcaataaatattgagtgcctacaaa

SEQ ID NO: 3492 - DNA, 588 bp, Homo sapiens
tctctcagcccgtcggttcccgagcgccttcccggtgaccccgcagtgggtgtgtgaggggaggacggacagacccagacgccgccggaccaggaggacgctgacgaggcaccatgcgtgagatcggtgcacatccaggcgggccaggtgcggcaaccagatcggcgccaagttttgggaggtcatcagtgatgagcatgggattgaccccactggcagttaccatggagacagtgatttgcagctggagagaatcaatgtttactacaatgaatccactgcgtcacaggatatgttcctcgggccatcctcgtggatctgggagccagggcacgatggatttcggttaggtcttggaccatttcggccagatctttcagaccagacaatttcgtgtttttggccagagttggagccgggaattaactggggcccaagggccacttagcacagaggggagccgagcttggtcgacttcggtcctgggatgtgggtgaggaaggagtcagagagctttgactgttttccagggctttccagcttgacccacttttttggggggcggcacggggtcccggaattgggcaa

SEQ ID NO: 3493 - DNA, 2315 bp, Homo sapiens
acccacaagagccgtgccctgcaggagattgtggtgggcagcaacatggacaagatctacatcgtgatgaactatgtggagcacgacctcaagagcctgatggagaccatgaaacagcccttcctgccaggtacagccgcgccccggggtcctgtctgcgtacaagtgggggcagtgtcctggtcacccccgcggtgacagtgctgcagggagggccagctgcatccacagggaaagccctgagaagcctctgttgctgccgaggcgagcgggccaccctgagtgcctgggcttggggcggccgggtccacatgggagcctccctccctccaggggaggtgaagaccctgatgatccagctgctgcgtggggtgaaacacctgcacgacaactggatcctgcaccgtgacctcaagacgtccaacctgctgctgagccacgccggcatcctcaaggtgagcccccctccgagtggcccatcccagggtgacccgcccgggcccacccacagccgcccatctgtcgttgcaggtgggtgattttgggctggcgcgggagtacggatcccctctgaaggcctacaccccggtcgtggtgacccagtggtaccgcgccccagagctgctgcttggtgccaaggtgagtcctgggcgtctgagtgcctccctgtcccccatgcagccctcccacacgttcgcgggcactggcttcctgaacacctctcctggcgtcttaggaatactccacggccgtggacatgtggtcagtgggctgcatcttcggggagctgctgactcagaagcctctgttccccgggaattcggaaatcgatcagatcaacaaagtgttcaaggtgggtctggccctgccgcaggtgcgctgtggggttgtggaggagttgcaggaatggggctgcggggcgcacaggtgctgggttgagatggggaccagggccactgagagccctcctggtggcttgtcttctctgacgggacacaggtgccaacactgtgggccacttggtgtggctgttgaagcacctctgtctttcaggagctggggacccccagtgagaaaatctggcccggctacagtgagctcccagtagtcaagaagatgaccttcagcgagcacccctacaacaacctccgcaagcgctttcggggcttctgcttttcagaccagggcttcgacctcatgaacaagtgagcccagtgcagccgggtgggcgaggtccgagccatagcgtgacttcccagtcccaggcctacctgctggctcaccacgttcccgaactgctctggtgcctggcgtcccatgccctgagccccgtcccaacacagcccatctttgggggacccagtggagcacacgagcacctcctgggtccctggtctcctccccccaggttcctgacctacttccccgggaggaggatcagcgctgaggacggcctcaagcatgagtatttccgcgagacccccctccccatcgacccctccatgttccccacgtggcccgccaagagcgagcagcaagcgtgtgaagcggggcaccagcccgaggccccctgagggaaggcctggggctacagccagctggtgaggggcctggtgggtggggcgtgcacaggtgggggctggcttgggcagggttctcacggtagccgactcgtcccagggtgacgacgacctgaaggagacgggcttccaccttaccaccacgacccaaggggggcctctgccgcggggcccgggcttcagcctcaagttctgaaggtcagagtggaccccgtcatggggagaactcagccgggaaccacaggcgtggctactgcggctggagctgcgatgagactcggaactcctcgtcttactttgtgctccatgttttgtttttgtattttggtttgtaaaatttgtagaattaaatcattttccttgttgtggaggaaagaagcatgtgttttctccgtgacttgcccagggcggagagggtgggcatcttcggggtgcccacgtggggcagcacaaacctccacacacccttttcccacttttcgacacgcacggggcttggctgggccgtgatttggaaaggaactggtgggagccgggtggattgtttaatcttcgggagctggagacctgtttctgtgttgggatgagcgatgccctcttgccccaacccactcgtccagaccagccctgtccacacgtagcccccggcccccaaccacccagccccagctgttgccagcaggactcgaacaggttttttattacaaggttgttggagttttaaaaatgttattt

SEQ ID NO: 3494 - DNA, 1434 bp, Homo sapiens
gaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacagatgccagctgtgaggacaagtcagctgccagagggctggcccaggaggctgtaggagggcctcttcagatacatgttccggccatcccagcatacacgcagccgccaggtgacttcagcccagctgtggttccacaccgggctggacaggcagggcacagcagcctccaatagctctgagcccctgctaagcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccgggctgcccatgccaactgccacagagtagcactgaacatctccttccaggagctgggctgggaacggtggatagtggtaccctaccagtttcatctttccacaactgtcatggtggttgtgggctgcacattccccccaaacctgtcccttccagtccttggggctcccccctaccccagcccagccctactccttgctgccaggggcccagccctggtgtgctggcctccccagggaccatgaaggcccttaaatgtccgcaccaccctcggatggaggttactcgtttcaagtatgagacagtgcccaaccttctcacggaggactgtgcttgtatctaagggttgggggtcttcgttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatg

SEQ ID NO: 3495 - DNA, 1109 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaaatttgcggtgcaggggccgcggccaccgccttcttgtccgcaggtgctgcgagccgtaagcgccccccacccgcgctatgggctcggacgcctgggtgggcctttggcggccacaccggccccgcggccccatcgcggcgcactacggaggccccgggccaaaaatacaagctgccgcccaacaccgcagacgacgtgcggccccgggccaggccacctggtgcccgctcgcatgaccgtgcgcggcaccgacggcgcccccgcctactccatctacggccgcccacgccgctcagcgcccttcctcactccgggaccttggcaaggtacttcccggagcgagcggggaacgcaacgtaccccagtgcgcctcggcacaccattgctccccgaaactgggggtgtccaggcggaacagcagagcccaggttcccgcggcctatacggtgccctcgctcttgggttcgcgcgtcatcggcaaagtctccgccccaacttgctccatctacggccgcagagcggctggcagtttcttcgaggacctcagcaagaccccgggcccctgcgcctatcaggttgtgagtccaggggttttacaagtcccgggccccccagttcacgattttggcgcggatttcgctcccccaagacaacactcggaagccagggcccgcggcctacaacgtggatcagcaccggaagccccgcggctggagtttcgggatccggcactcggactacctggccccgctggtgaccgacgcggacaattgacccgccaggcgggagcggccccacacgtgtttgcttaaagtttgcgagtccgcaaaaaaaaaaaaaaaaaa

SEQ ID NO: 3496 - DNA, 1340 bp, Homo sapiens
tttttttttttttttttcgtattctcatatttaatagattttaagaccttcaaaacgacacaaagaggatcagaacccgtatgtgatatttttgtgcgtcctgtctggtgaccgttggttcaccttatctctgtttccctttcaggtgctgctagctgaggaggggatagctcctctttcttctgcaggaccagggaaagaagaaaaactcctgttggagaaaggggttttctcctttgcttccagttcagactatcaaggaggaagaaatccagccttccctgatctttgcagggtgggtccgtgtaaatagtataaattctccaaattatcctctaattataaatgtaaggcttatttccttaggatcattatccaggggactgcccggaaggtggggtagggatgaccctgggggttttcaattgacttctgttccttgcttttagttttgattagaagggaagacctgccagtgcacggtttcttcccaggctgaggtacctggatcttgggttcttcactgcagggacccaaacaagtggatctgcttgccagagtcctttttgcccctccctgccacctccccgtgtttccaagtcagctttcctgcaagaagaaatcctggttaaaaaagtcttttgtattgggtcaggagttgaatttggggggggaaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgccccctcaactttgccaaagacccaccctaggccccaactgaaccgccatgggtgtgagccagcttgagaacactaactactcaataaaagcgaaggtggacatgctgggctctgtggttttattggcgtctgattcctaaggcacccaggagaggctggaaaagaaagagggtgttgatggagacgatggtgatagggaagaggcaaggcctgaagttcacccaaagcagcagttggagcacttgcacaggcacacacttgacaacacaaattgccagttttcccagtgctagtcctgcacagctcacctcttttccctggcgtctctgaccttgttccttgggacctttggacctgctggttaacttaggccttttgagggttcttaataagacaagctcacgaggggtagggccccctgaacattagggcacgaaagggcccagttacaggtgcttcattcccactgccatccccaccctgaggcctgggagccagc

SEQ ID NO: 3497 - DNA, 550 bp, Homo sapiens
tttttttttttttttttttttttttttttttttttaattttaaagatacatgaaaagggttttatttatttaacaaacagacaatggaaacaagcaaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgctacaatagataaacaaacaaaaacaattctcacttccagaagatcccgcctgtacgtctgcacgagcccttcaggaggtctggatgtctggttcacaactcccctgcttcttttccagcttttgcttttcccttcccccgctcccgccctaccgccccacgacccgaccaccgccctgcaaacaggcagtcctcagctctggacttctggatcacgacgtcgatatccttctgaattcggtcttgccttgaacacatccccctcg

SEQ ID NO: 3498 - DNA, 948 bp, Homo sapiens
gtcagagtgatctgttggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatgggacaagcccctgggtcgctgcgtgggccacgcccctggagggtgaagaaggcgctgctctgcatggacggcgcagggcccgccagacttaaggggacctggtcaccacgctcggggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagatacgccgtcacttgctgcctcgcgcccgggatcaggaggtagctgctggcgcccgcaaatggccccgttgaagttggtccgggcgctcccgctggcgctggttctgcacgagctcggggccgggcgcaaccgcgctggggagccgctccgcctgggggtgggcgcaaaactgctggtcgacgtggggtcagaggctgcgccgtgggacgcccctttcgtccgccttcaaccgggactggcccctgcgctcacaggcccgcagaaggcggccctgcaggaggcgctcgtactctccgaccgaacaccattcgacgccccactcgcccttcgcagagctagttctgcccccgcaccaataaagctcctttgccgcgaaaaaaaaaaaaaaaaaaaaaaaa

SEQ ID NO: 3499 - DNA, 8654 bp, Homo sapiens
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggtggaggcggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtcttcacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgcccaaggggaggagccgacaaacagcagatggacgctgagctgcggaaggagatgatggcgatttggcccaatctgtcccagaagacgctagacctgctggtcacacctcacaagtccacggacctcaccgtgggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcagcaggcggtggccaggccgggccgggcggccaccagcggccctcggaggtacccaggcccgcacggccgacgctactggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcggggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 3500 - DNA, 3389 bp, Homo sapiens
cggcggcgactgcagtctggagggtccacacttgtgattctcaatggagagtgaaaacgcagattcataatgaaagctagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcggagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttgggaaagaagtggccctcccgggcccccatctttcaaaaagaggaatcatctcactccctgggaggattcgtccccaatctccccacccccaagacccaagaagtcctacagtgggctttaggtccccaacccggtgtgtctcggaaatgcttgtgattcaacacagggagaggagggagaggagccggtctcggaggaaacagcatctactgcctccctgtgtggatgagccggagctgctcttctcagaggggcccaagtacttcccgctgggcccgcagagctcccgttcccagcaagactcctcttgaccctgcctcccagctcagctactcccaggaagtgggaggaccttttaagacacccattaaggaaacgctgcccatctcctccaccccgaagcaaatcttgtcctccccagaacccctgaatcctggaggctcacgcccccagccaaagtagggggactggattttaggcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggaccagggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattaatcccagagactgcccagaaggtgggtagggatgacctgggggtttcaattgacttctgttccttgcttttagttttgataggaggggaagacctgcagtgcacggtttcttcccaggctgaggtacccgggatcttgggttctttcactgcaggggacccagacaagtggatcttgcttgccagagtccttttttgcccctccctgccacctccccgtgtttccaagtcaagctttcctgcaagaagaaatcctggttaaaaaagtcttttgtattgggtcaggagttgaatttggggtgggaggatggatgcaactgaagcagagtgttgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgtgccagcttgagaacactaactactcaataaaagcgaaggtggaaaaaaaaaaaaaaaaaaaaaaaaaaaaaaaaaaaaaaaaaaa

SEQ ID NO: 3501 - DNA, 1115 bp, Homo sapiens
tttccctttcaggtgttattattatcccaatttccagatgaatacacccggagcacagccaaagtggctcccaaaagccacctctagctccagaatacacgctttagggaactgagtcctctctctctcttgctttctctttccctctcatctgccactccatcagctactttaggttttgtgaatgagtgagggaaaaatagagaaaagagaaagaagaataagacaggaagagtggaggaaaggaaaaaagaatggagaggttttaccctacttggaataaaattctttctagtagctatccatacctgctcatctatccagaactacagagtagaagggatctttgagttcatcttacaggtgtgaaaacaggcttgagaagggaatgactttcccacaaccacagagggagttagggatcaaactaaccactagaactattttcctgacagaatctttgccttgcatgtttcaggcccacctggctcctttcacctttcttacacaggtgacattcccagaacctggagggccaggctatgacacagagtcaatccataacccgggagatctgtgatataagccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccagaggttttgaaatcccatcaggtcaccgcggaggcctgactggccttattgttgaataaatgtatctgaatatcccctgttgtttccatttgctttttcctcaaaggtatgtttgattataccagggtcaggggactttggtaagactgagaatagaccaagttta

SEQ ID NO: 3502 - DNA, 1047 bp, Homo sapiens
  misc_feature (1)...(1047): n = A,T,C or G
aggtccgtagcggtcctgacgtgcacatcggtcgtccgacctgggtataggggcgaaagactaatcgaaccatctagtagctggttccctccgaagtttccctcaggatagctggcctccaagcgggtggacatccagaaccaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccctagccagccgccgagcagctggcggcgggcgccgaggagggcggcgggccgcggcgcgcgctcaagagcgaattcttggtgcgtgagaaccgcaagtactacctggacctcaaggagaaccagcgcggccgcttcctgcgcatccgccagacggtcaaccgggggcctgggctgggcgtccaggcagggnccagaccattgcgcctgcccgcgcaggggctccatcgagttccgtgacggctctggccaagctcatcgaacgaactacggagtgtgaggaggagccggccgagctgcccgagggcaacctccttgactgtggacaacaagcgcttcttcttcgatgtggggctcccaacaagtacggcgtgtttatgcgagtgagcgaggtgaagcccaccctattcgcaacttccattaccgtgcccctacaaggtgtgggcccaagttcggacacaccttctgcaaagtactcggaggagattgaaggagatttcaagagaagcagagggagaagcgggcctgcctgtgagacagacttcaccagcagcaacagcagcagcagggaggagaccgccgcttgcccacctgctactgcagggtgaggaagaaggggaagaagcctgatcaaactgaatgaaacccccacacacacacacatgcatacacacacacacacagccacacacacagaaaatatactgtaaagaaagagagacaataaaaagttaaaaagtt

SEQ ID NO: 3503 - DNA, 1676 bp, Homo sapiens
ccaatgaccagccgggccctgttgcccgacacccatcctgaaagtgatggcataggcatgcggcagtccaaagtggataatctgtacgctggtctgaaagaccttgctgaagagagaagaggcaagctggatgagagacacaggttattccagctcaaaccgggaggtggacgacctggagcagtggatcgctgagagggaggtggtcgcagggtcccatgaactgggacaggactatgagcatgtcaaactgttttaatttttcaaacaaatggaacagaagccattgtggttcatcctgattacttgaacgttgcacttggtggaccgtgcctggggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagccggtgacagagatggtttccttgtaccgataaaaacaaaaccaaatccatattatacatcaaaaccttgtgagacattcacttgctcttttgccatatttagatgtgttagtggaatcagaaacctgttttgatatgtgttctccatgagttaagtctgatttgtctttttatttcatgatgcatgtctttttttatcttttgtcaggataacgtcatatagcatcttgtttgttattccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgccttgtctttggtcattagggagctctaatgtgtgtttgtggctccaagttacattttgtggtttccattgatctatatgtatatatgtgatgttttcatatatatatgtgtgtgtgtttaaattttgtatcatcaggactgacacccaatttgacactttttgtatctagaagaccctccaaaaaacggaaccacataagcacacaagaaaagagtgctactgatgttcttagcatttgctatcatgcctatttttatctagatttttaaatgtagcttggtcataaccaaaattttaaattacaattggccttgtatgagaaggaaaaaggtatttttatggttttggagtgatgaccgcagagactcaatgaactttgaaaatagcattgcttcgtgcactttgaataccaatcaggtgttttctgtgctactagttgtcacgttgcattcatgttcacctcctgatttaagtatctccgggtgtgcccagccactaaagcactctggactaatccgctaaagagaagcaaccgtggggggtggggtttgcgagggatgtgttcacatgtacccatcatttgatcatagcactgtgattgcttttgatgtgtgtctctagtggtgtgttgtctgtctggcatgcttaaagcacatgtccattaaaattcattttgttccttttaaaaaaaaaaaaaaaaaaaaaaaaaaaaaaaaaaaaaaaaaaaaaa

SEQ ID NO: 3504 - DNA, 5532 bp, Homo sapiens
ttttttttttttcgtaagaaattatttaatattagtattttttcttttatagacaaacataacatacacatggtttcctaccttcctataaggacaaagtagaaaactaaccgttactgcatttaccctcaaacacagcactgactgtgcccacagataacatggtccaaaatattcaattctatagataggccatggtattgaatgcatggttaagttttaggaaaggcatatatttcctgaagtatgtatgttaaatacacaaatatctataaataacaaaaaagttaccagcaaaaaccgtttcaggttataacattcccaaacttcctaacattttaagtgttttagatatgagttgtctgaccagttcatttggttacagttttaaactagcaaaccattgccctataagaggagctaaactaaactgttaacactacacaaacttcccaagaaaggtaacttgaaaagtctaaaaagtgattccaattattctaattaacatttgagatgctaaaagaatcaatgactcaagaaacactttgaagtaattccatttttctttatcattttctaaaaatgtattcacataaatttaagatccagattgcttaagagtatgtcttcaaagtaggttaatcactaaagcattctgatccaaagacatagtcttaatgcttctaatatgtaattctaacctaaaatcacaatccttggtttgaaaacatcaaaggtaagaaacaaaaaaataaatcagggtgaaaatgtgcagcagctatagctacaagagtggaaaataaattctactttttccataaagactctgtgaaaatataaagcccaaagtcagtgacaacagaagtccacatataaatggtgtttaaaaatagaaagttttctaaagcttctcatgagatgtcaacgaatagtcataatctgaattaagaccttataaatcaaggttaagttatacataaccatgatgatttacataccttctacaatgtccaactgacatacataatttagatacccataggaattcataatgccctatcatatcatctcccaatactggatgtttactgttttatagttttactactttaagtaccaagaagcattttcagaggaagagttccatctcttcccttgatcccccaaagtataggtaacaaaatataaagttaaacaagattgatgtttgataaactaacatataaaattatcattgcaattttcacagtgactgcttttaaacataacagtcatcataaagcctataaagtatatacttagttttataaaagaaatgcagattgtctcaaggtaaaaaaatacagtgctggatgctaaaaagcactttgttgcaataagatgtgcaataaggagcaaaacttcagaaaacatgaatatgttccccaaacttttaatattagtaaagcaagaattgctccgcagcagcaggatgctttttagtggctgacactataaagctaacgttaagaaagaaaaaaggcagaaagtgtgagcagcaaatggtgtaaccaaattattgcaaatggagattagcaataagaagtgaggaaggtgaccgtccactccattctgataagacaccatctttaaatgttaaatttttttgcaggaagtggaacacccatgtcagcaaacgatgactgtgaaagcaaacttgaaaaactgggctctgtgtgaatatccaatgttgaagcaccttcctggaatgagtgaacaaagttaaggacttgcagagagagttttctactggaatgtaagaggtttttgaaggctctcttttctgcaaaggccatgtgtagcaatttttctatatactttccggtttaattcggaactgaacagtggaattccaaagcacagctcgagaggaacccaatctgcttctgttgtggcaccagaggtttgctttgttgctgaatctatagttgcttcttcaatgaccatttcaaatgactctgtactcccatttaacatctgagccagaagccaaatcaggttttcctctctcatcagaagcatcactgagttttctatttgcaagttggctggaagcattcaacatggtgacatatccgcagagatgttgtaagtccactctgttccttagtatctgcaatgctttatgaacacccatattgacacgagtcttcttgtagttctgtttcatcaaatggaaatgggacatggacagtttctcctatcccatgcagaccatgctcctgaattaaaactgcagaatgtgttaaagcatcattcaacatcgtgagcacatttgaggtaggaactactccaggatcatgaccccaagatgttattagcaatcgatcgtaactctgaaatatatctggcagttttcgaggtcttgtacctttggataataaaagggatggtggtccttgtccagtgatatgataaacgtaaatgtactgtttaaaccagacagagctgacttctgggatagctggtccaatatgctgaggggtgcagctgctgacaggccggatttcattggtgaggggagccatggaaacaagcagtgtgtaatttttgtttagaactctgctgccagttgcagggtccagaccaagaaggctttcacagcgtaagagatccagaggaaaaccataattgggttggtctggctgtgcagtttgcacaactagatctttgttatgacgcagaaacagtgttgtgtttctcagagtaagcgcatgctcaaaatatctctgtgcttctctttcaccagtgctctgaactggtgaaagatttcccatcattaagaaggcagtaagagtggagtcaaacaggaatgcgatgtgcttcgtgtgtcctgcagacagactcaggcttcttacactggctgtgtcagctggatcttcttgactatttgtatcagtgtcagttgccgatgaagcttcttgtacaggcctcctactttcccctccaccccatgacaagagcatcttctatggatctaaggtactctttaatctgtttatggatggaacattcttccatgatgaatgaagttgatccaaatttattacttgtcccttcttatgggcaaagcccaatcagcaatacattgaaacagcattcttaaccagggataagtcaatctcaaggacatttgcaagctctgccacatttgtgtgctcatctactgaaacaaatatcttatagagtagagtttcaaaataatcaaaataagcactcgattcattacaaaaccttcaaggggtgcaactgctatacaactgtcatcagacattggtacatccagataaataaatccttttttatacaaactatgtactacattgtaatctagtgatccagagagttgagggcctgaatcaacggtcttatcagtagcacatttctcaggccaagtgcatatcttgatgtcatcttctgtgatatatccagcctgcaccacccaccatgcctctatggcaatttccactggctttattggtagaagatcaccggctgttttccttctgaagaatttttttgatgatctacactgaatcataagatcaatatactggtttcttcctatgccaagaagccttagacagtcagcagcagtaaaattgtgcccactgttcataatattctccataatcccagtgtaatatgaaaatggtgttatgctgaagcccttcaccataatatccaatagacggtaagggtacagcatgagatgatctcggctgtagtttagcagttcctcatagtatccgcgttcatctttcttgacatgtttaagttatttctgtatcgtaactgattgcagatactgtacaggacaacctgattttcatattctctctgtgaatttccaacacggctgggattttctttctcctctgccactctgaacagcaggaccaatacttcctgtatttcctcctcctcagcctctggaaatttgattcaggcaagtcgggggagtctccggtattcttctctgagaactctgttttcattatacagctggacaatggaatctatgatttgcctgtagaggttagaggtgcatcctgggagccagtggcttttgcctgtcttcatttttcttaccattgtgattttctctactccaaaaccagaggactgcccaggtgccttcaagtctgtccctgttgtgcttcctcagatgttgttgggggtaattctttttttttcttctcagtttgttagtgagcattggggttgattctgtagtcccagctacttgggaggctgaggtgggaagattgcttgagcccaggaggcacagattgcagtcagccaagatcatgtcactgcactccagcttgggtaagagagcaagactctgtggcaaagttttctgacaaggatctctgtcaagctggcttccttgtaccatttgctcacagaatctctgtctctggtagtaggcaatgtcagtgttcctgagaaggcccctcaaaaagacttgaactgtgttccttcaacatgctgggtaaaaaggtagcagacacctctcccttcctgtgtcttctgtcgtaagtggggtcagttcttcagcctgagcctgaattaaggggatcatgtatctatatttctgcagggtgattgggccagggggagtagggcagtagctttgggatgtcagggaatttctctgtgagggtcttgggaagttctgtttgcacttttccagttcagagcggaagtactgattggtttccaggatgctcatttctgcccttggaccaaaacaagtggtgagagatactgccatgctgaagcttgtggagaaagtacaatcagagcctctcttcaaaggactaaaagctaaaggcgacaaaggattcattcgacaagtcctagtcgtgcgcccctggtgagtaccagaccctgctccccgcgaaggggacccacgagcgaccctcaccaccatccctgccctggtggagcccccgtgcggaacacaggatccgaagatggcagcggaagctcctccgcggcccggaaagcgactgggcagggtgggcacaggctccttcaatgggtgaaggcggcgcaaagaacgggaagaaccatcccgggagcccaccgggcgttcagcttcccttgggaccccaggcgtctcgggctgggtcgccgaccggggagtttctggggtctctccctctggctccagaatctcctaacgcgcaggtgtccaacgtgaccagcgcgattcaccgctctaatatctctggttttccaaggacttgctcagtcgtcctgccaggcgggccctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaag

SEQ ID NO: 3505 - DNA, 595 bp, Homo sapiens
tggccccggatagttttaggggccatgtaaaagctccatttcccgtctcgccgcttagccctttaagcaaacctggcgggtccaaccaaccccgctctgccgccgctgctggaacccaggaggcgtgcttgcaggcttcgggcactacgcggggctggaaataccacgcactgccccttcgcctagacccccgctcgagccacgcgggttctgccctcaaagctggtagctgccccagacttgggggtggggggaggggaaggggcgaggctggcgccccctcccgcttttggctcccgcgttcgttgcagcagctgtcgccaaatgaaccccggaatgcggacgtgcaaaccctccaccccacccccagccacacacgtcgcggtcggagaactgagaagggggcgctgggtccgaggttctggaaaagcaagaactcacctgcaaacaggcagtccttctcagctctggacttctggatcacgacgtcgatatccttctgaattcgctcttgccttgaacacatccccattaaataaatccttgcataaaaaaaaaaaaaaaaaaaaaaaaaaaaaaaaagtcgtatcgatgt

SEQ ID NO: 3506 - DNA, 608 bp, Homo sapiens
ccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggccgtgtatgtctgaggaggcaggcttacgagacacccgacttggaccccgagcttgttgaggtactttgctgggacggattctttgcgggaagcgcggtactccgagggggtgggcagccccgcgccggcctccgccgtgccgccgaacacgatgtgggcttttgagctgccccctgagggcgtgctggggggcgctgctgcgtgtgaaacgcctaaagaccccggcgccccaaggtgcctgcacgcgcgctctcttgcacaccctgagacactgcccggatcccgtgacaccctgggcacccagaagtgccccccgccatcccgccaccaggactgctccccgccagcacgtccagagcaacttaccccggccagccagccctctcacccgaggatccctaccccctggccccacaataaacatgatctgaagcagc

SEQ ID NO: 3507 - DNA, 2849 bp, Homo sapiens
agatctctgcgcctgtctccatgtctctttctctctgtgcacctaggattttccgagcacccaccccggtgccccgcgggccccggctgggggcagggcccccaacgagtgcagagacacaatcagtggagcgctccccaccctcaccccacccccagcccctttagacccacagctgatgaggcacgtggagtggcagagatggaagaggggagggagaggaatcgttcctggccgcctgccgagtgccagtccctgccccgggtgcgtctcttcactcccactaaggaggaaacggctcagagaggggaagtgtttggccaaggtcacccagcgagtaagtgggaaccgagattccaaaccccgtcccagagatgccaaggcctcctgagagacagagaagcagacagcaactgagaggcagagagatggtgacagacacaaagagacaaaagagagagacagagacggaacagagcacacagagacaaacgcggggttgcggagagaaacacctactcagacaggagaaccagagagacagttacagactcagagatagagatgttgagagatagggccagaaagacaaaaacagaggcagagagagcggcccttggcagcaggggtggggacacccccccaccccccgaccccgcctcctctccccccacccctcctttcctctccctcccccgccgaggcctggctgccccaggcgccgcgggccgggagggggcaagcggggcgcggcgcgggcggggcgcagggcaggctgcacctcagagcggcgggagcagcggcgggtccaggaaacccctggggcgtacgggtggccccgggggggccgggggcggggaggcgggcggccggcaccgccccggccgacaaaagtcccttcagttcagccggctgcaggggaagtcccggcgcccggcgaaaccaccctcccgtgcagccgagcccagccgctctccggccgccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccattggtctccacgttccctctggtgaacctgcctacacccctataccccattattgtgccccatggaacaccccctttctgctgacatgccaattggccaccgtggcagatgaggacggaagacacgcccttctccaattgctgtggtgcagggtaacctggccagctgtgcaccgggctggtcaacctcttccagcacgggggtcgggagctcgacatctacaacaaacctacggcagacaccgcttccaccctggctgtgatcaccacattaccgtctgtggtccggctccctggtgacagctggtgccagccccatggcgctggcacccgcgcagtgccagactggccgctgcacgctgggcgtggcgcagccaccggcagccgcgacgctgcctgcgagccctgctggaaagcgcaagtccggggcacgtttgagccttgaaggcccgaaattatgcacgggcgtcacccgccttgcacggtggaagtgaacaccggattggcaataaaaccggtgaagttcttgtaaaagcgccgttgcgaacatcgacgcagtggaacattaagagcggccgctccccgctcatccacgccgtggaaaacaacagccttagcatggtgcagctgctgctgcagcacggcgccaacgtgaacgcgcatatgtactaccgtcagctccgacctgcactcagcgtccggccgagggctcctcccgttgagtgccacgctggtccgcagcggcgctgacagcagcctcaagaactgccacaacgacacgccgctcatggtggcgcgcagccgcagggtgcatcgacatcctgagggggaaggccacccggcctgcttccacctcccagccagacccctcccctgaccggagcgccaacacctcccccgagagcagcagccgcctctagctccaatggtcttctctccgcatcaccatcctcctcacgctcacagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggacttcatgaggaggggcccccctgccctgtggggtcaaacccttctggaaactgtgaagatctgacttcgcccccccccccccccatcttcgggaccagggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacatgccagtctactccactctctaccatataactggagggggtgagatgtgggccgtaacgtcgcacggatcacgatggtaaattatgaagcattttggttggatttcttttgtaataaactatttttgtaccataaaaaaaa

SEQ ID NO: 3508 - DNA, 1542 bp, Homo sapiens
cgggaggatggagccgctgaaggtggaaaagttcgcaaccgccaagaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaattatgggatgggagcacctttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaacttgttcgatttgtgttcaatggggccccacctctttacttgcgagcagtccgagacatcgaggtgggagaaggagctcaccatctgctacctggatatgctggatgaccagtggaggagcgccggaaagcagctggagggaccagtactgctttgaatgtgactggtttccgttgccaaacccaggacaaggatgctgatatgctaactggtgatgagcaagtatggaaggaagttcaagaatccttgaaaaaaattgaagaactgaaggcacactggaagtgggagcaggttctggccatgtgccaggccgatcataagcagcaattctgaacggcttcccgatatcaaccatctacccagctgaaggtgctcgactgcgccatggatgcctgcatcaaccctcggccctgttggaggaagcccttgttctatggtactcggacccatggagcccatacaggatttttttccccaggaagcccatcccgtcagaggggttcaagtgatgaaagttggccaaactgccagcctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgccttgttagctgtgtgaacctctcctattggaaattctgttccgtgtttgtgtaggtaaataaaggcagacagtggtttgcaaaccacaagaatcattagttgtagagaagcactgattataataaattcaaaatatttggttgaaaaaaaa

SEQ ID NO: 3509 - DNA, 1062 bp, Homo sapiens
ctctttttaggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaacccagctgtatttgtcaaaggatgggaagtactggcgattctctgaggcaaggggaaccgcccggcagggccccttcctatatcgccgacaagtggcccgcgccttccccgcaaagctggactcgtcttttgaggagccgctctccagagaagcttttcttctcctctgggcgccaggtgtgggtgtacaccaggcgcgctcggtgctgggcccgaggcgtctgggacaagctggggcctgggcgccaaaggtggcccagggtgaccggggccctccggagtggcagggggaagatgctgctgttcagcgggcggcgcctctggaggttcgacgtgaaggcgcagattggtggatcccccgaagcgcccagcgaggtggaccggatgtttccccggggtgccctttgaaaaacgcgaagtttttcacgtatcccgagagaaagcctttttctgcccaggaccgcttcttactggcgcgtgagttccccgaagtgagttgaaccaggtgggacaaagtaggctaacgtgacctatgactatcctgcagtgccctgaggactagggttccctgtcctgcttcgccagtgccatgtaaatccccactgggaccaaccgtggggaaggagccagtttgccggatacaaaactggtattctgttctggaggaaagggaggagtggagcgtgggctgggccctctcttctcacctttgttttttgttggagtgtttctaataaacttggatttctctaccctttaaaaaaaaaaaaaaaaaaaaaaaaaaaaaaaaaaaaaa
